United States Patent 10,888,096 (BIOPESTICIDES FOR POTATO LATE BLIGHT DISEASE) - sequence listing, part 7

SEQ ID NO: 12 - DNA, 848157 bp, Pseudomonas fluorescens KENGFT3
tagtatgctatacgaagttattacgggtgaacttgcctttgccatgcaactcgtccagcaaggcttcgaactcgtgatcggagatcagtccgtcgccggccggtgcggcgctgctggccgctggagccgctggagccgctggagccgctggagctgcggcagcagtggcggcgacttccggcagggcttcggctacaaacgtgcctttgccgtgcagttggtcgagcaatgcctcgaattcatcgtcggtaatgtcggtgctggcgctggcagccggtgcttctggcgcagcgggtgccacggcatcggctgcgaactggcctttgccatgcaactggtcgagcagggattcgaattctgcgtcggtaatgtcttcgctggtcggcgtggcaacaggcgccgccggggcttcggcttcggccttgaccgcattgagcgaatcgagcagctgttcgaactcgctgtcggtcacatccgcctcggcctccaccactggttccggctcagcttgtgctaccggcgcagccgcagccggttccgccaggcgcgccagggccgccagcagttccggagtggccgcagtgatcggcgcacgttcgcgcacttcactgaacatgccgttgactgcatccagtgcttctagaatcacgtccatcagttccgagtcgacctgccgctcacccttgcgcaggatgtcgaacacgttctcggcgatgtgacagcactccaccagctcatggagctggaggaagccggcgcccccttttacagtgtgaaaaccgcgaaaaattgcattgagcaggttcgcatcatccggtcggctttccagctcgaccagttgctcggacagttgctctagaatttcgccggcctctacaaggaaatcctgaaggatttcttcatcggcgccgaagctcatgggtgtgctccttagaagcctaaactggataacaggtcatctacgtcatcctgacctgacataacgtcttcacgtttatcggcatgaatctgcggaccttcacccttggcgagatgtttttgtggatctttttccgagaggatcgcttcgcggtcatgctcgatgccggcaaaacggtcgacctggccggccatcagcaccaatttgagcaagttgctttccacttcggtgaccaactgggtcacgcgtttgatcacctggcctgtgaggtcctggtaatcctgggccagcaggatgtcgttgaggttgctggccaccgtgcggttttcctgttcgctgcgcgacaggaaaccctcgacccgacgggccaattcccgaaactcttcagcccccacttcgcggcgcatgaagcggccccaatcaacgctcaaggcctgggcttcgctggccatgccgttgaccagcggcgtggcgttttccaccaggtccatggtgcggttggccgccgcctcggtcagcctgaccacataggacaggcgttcggtggcgtcggtgatttgcgaaatctcttcggcctggggcatgcgcgggtcaatctgaaaattgacgatcgcactgtgcagctcgcgtgtgagcttgcccacttcctggtacaggccgcgatcacgggtctggttaagctcatggatcaactgcaccgcatcggcgaactggcctttttccaggctgtcgaccaagcggtgagcatgttttttcagggtcgactcgaagtcggcctgcgatgattcgttatgctccatagctcccccgtggcagcatcaatgaccgatgcgttcgaagattttttcaatcttctctttcaaggccagcgcagtgaatggcttgaccacgtagccgttgaccccggcttgggcggcttcgatgatctgttcacgcttggcttcagcggtcaccatcagcacaggcaggctgcgcagtttttcatcggcacgtacatggcgcaacagatcgataccggtcatgcccggcatgttccagtcggttaccagaaaatcgatgctcccgctgttgaggatcggaatcgccgtgatgccatcatccgcctcgaccgtgttggtgaacccaaggtcacgcaacaggttttttatgatccgccgcatcgttgagaagtcatcaacgatgaggattttcatgttcttgtccaattcgacctccaagcagtcttaaacgcgcccagcacctggacgcgccatttcaatcaacaggcgttacacaaaaaggactgcccagggcaccacggaacgaacccgcgaaaccttgcggcttcgcggtagcgtctgcagtgtccccacactgcctgtcagcgcgcgcgccactctcccaaacgcccccgcaagcgggccgcgcactggctatgcaactggctgacacgcgattcgctgacccccagcacctcaccgatttccttgaggttcagctcttcgtcgtagtacagcgccagcaccaggcgctcacgctccggcaaattggcaatcgcgtccgccaacgcgctctggaaacgttcgtcttccaggtcgcgggacggttcgagatgtgcactcgcgccgtcctcgtgcagcccttcgtgttcgccgtcctgcagcaggtcgtcgaaactgaacaggcggctgcccaaggtatcgttcaaaatcccgtaataatcgtcgagactcaattggagttcggccgcaacttcatgatctttagcgtcacgaccggtttttgcttcaattgcacgaattgcatcactgaccatccgcgtattgcggtgtaccgaacgcggcgcccaatcccctttacgtacttcatcgagcattgcgccacggatgcggatgcccgcatacgtctcgaaactcgcacccttgcttgcatcgtatttggtcgacacttcgagcaggccgatcatgccggcctggatcaagtcctcgacctgcacactggccggcaggcgcgccaacaggtgataggcaatgcgcttgaccaggggcgcataacgctcgatcaattcgccctggctgtcacgtgccgactttttgtaaaggttgtagccgctggatgtcatagcaccggtcctgcgctcgtctgatgcaccaaacgctcgacgaaaaattccagatgcccccgggggttggcgggcaacggccaggtatcgaccttctgggcaatggccttgaacgccagtgcgcacttggaacgagggaacgcttcgtagaccgcacgctgcttttgcacggccttgcgcacacactcgtcgtaaggaactgcgccgacgtattgtaaagccacatcgaggaagcggtccgtgaccttggtcaacttggcgaacaggttgcgcccttcctgcgggctttgggccatgttggccagcacgcggaagcggttcatgccgtagtcacggttaagcagtttgatcaacgcgtaggcatcggtgatcgaagtgggctcgtcgcacaccaccagcagcacttcttgcgctgcgcgcacgaagctgaccaccgattcgccgatcccggcggcggtatcgatcaccagcacgtcgaggttgtcgccgatatcgctgaacgcctggatcagcccggcatgctgcgcggggctcaggtgcaccatgctctgggtacccgaggcagccggcacgatgcggatgccaccggggccctggagcagcacatcgcgcagctcacagcggccctcgatcacatcggcaagggtatgtttgggtgtcagccccagcagaacgtccacgttcgccaagcccaggtcagcatccagcagcatgacgcgacggccaagctctgccagggccagggacaaattcactgacacgttagttttgccgacgccacctttgccgccggtcaccgcgatcacctgtacgggatgcatgctgcccattttatttctttaccttgtcttgcttagacgcaggctacatggcttggccgcgtgaatcgcttgcagaccatcgatgtaggtacatttcacggtgttcatcctgccttaaccgacccgtttagccgggtggtggtaaaggtcggcgaacatatcggccatcgcttcctcgctaggctcttcttgcatttgcacacttacggcacggctgaccaactgatgacggcgcggcagatgcagatcatccgggatccgcggcccgtcggtcaggtaggcgaccggtaattcatggctgatggccaagctcaacacttcgcccaggctcgcagtttcatcgagcttggtgaggatgcaaccggccaggccgcaacgcttgtaactgtgataagcagcggtaagaacctgtttctggctggtggttgcaagcaccaggtaatttttcgacttgatgccacgcccggccaggctttcgagctgcatgcgcagcgccgggtcactggcttgcaggccggcggtatcgatcagcactacgcgcttgcgcagcagcgggtcgagggcattggccagggactggcccgggtcgacgtgggtcaccggcacattgaggatgcgccccagggtcttgagctgctcctgggcgccgatgcggtagctgtccatgctcaccagggcgatattctgtgcgccgtacttgagcacataacgggcggccagcttggccagggtggtggtcttgcccatgccggcggggccgaccatggcgatcacaccgccctcttccagaggttcgatttccggcgtggcgatcatgcgtgccaagtgcgccagcagcatgcgccaggcctggcggggttcttcgacttcggcggtcaaggccagcaaatcgcgggacaatgggccagacaggccgatgcgttgcaggcgacgccagaggttggcctgttgcggcttgctgccttgcagttgcgtccaggccagcgagcccagctgcacttcgagcaattcgcgcaggccgttgagttcaaagcgcatcgaatcgaacacacgttggtcgacagcggcggccggggctggcgcagctggacgcggtggctcgacgaacgtcggttctaccagcggctcggcagccgtcaacggcaggccggcgaacaattggcgattggtgctggcgtcgctgtcgccacgcatgctcagttcagcctgggccgacacaatgcgcgaggcagtcttgcgcagctcgtcttcgagttccatgttcggcacacgcggggccagggcctggggcgtgtaatccagcgcagccgtcagctcgacaccgccggcaatccgacggttaccgataatcgcggcgtcggcgcccagctcatcacggaccagtttcatggcctgacgcatatcggcggcgaaaaaacgcttaacttgcataacccactacctcagccattgggccctactgtcgcgacgatagtcacttgcttattgtcaggaatttcctggtaagccaacacgtgcaaattcggtacagccaggcgtccaaaccgcgacaacatcgcccgaaccgggccggccaccaaaagaatgaccgggttgccctgcatttcctggcgctgcgcggcgtcgatcaacgaacgctgcagcttttcagccatgcttggctccagcaaaacaccttcttcctggccctgaccggccttctgaatactattgagcaatatttgttccaaccttggctccaaggtgataacaggcagctcagactcaatgcctacaatgctttgcacgattgcacgggacaatccgacgcgcactgccgccaccagcgcggcagtatcttgactcttggcggcattgttggcgatggcctcggcaatgctgcgaatgtcgcgcaccggcacctgttcggccagcagcgcctgcagcaccttcagcaattgcgacagcgtcagcacgcccggcaccagctcttcggccagtttcggcgacgacttggccagcaagcccatcaattgctggacttcctcatggccgatcagctcgtgggagtgcttgtaaagaatctggttgaggtgggtggcgaccaccgtgctggcatcgaccacggtgtaacccagggactgcgcctggctacgctggctgacttcgatccacaccgcttccaggccaaaagccggatctttggcggtgatgccgttgagggtaccgaacacctggccggggttgatcgccagttcgcggtccgggtagatctcggcttcggcgaggatcacccccatcagggtcaggcggtaggcactgggggccaggtcgaggttgtcacggatatgcacggtgggcatcaggaagcccaggtcctgggacagcttcttgcgcacgcccttgatccgcgccagcaattgcccgccttggttgcggtccaccagcgggatcaggcggtagccgacttccaggccgatcatgtcgatcggggttacgtcgtcccaacccaactccttggtttcctgggcgcgggctggggatggcagcagttcctgttggcgtgcaacctcctgcagggcctggaccttgacctggttctgttttttccagaacaggtaggcaccgccaccggccaaggcggccatggtcaggaacgacacgtggggcatgcccggcacgatgcccatgatcgccatgatgcccgccgccacggccaaggccttgggagacgcgaacatctgccggctgatctgcttgcccatgtcttcggagcccgaagcacgggtcaccatgatcgccgccgctgtggataacaacagtgatgtcaattgcgccactaaaccgtcaccgatggtcagcaaggcgtagaccttgccggcatcgccgaaggtcatgccgtgctggaagatgccgaccgccatgccgccgatcaggttgataaacagaatcaacaggccggcgatggcgtcaccgcgcacaaacttactcgcaccgtccatggagccgtagaactcggcctcctgggccacttccaggcggcgggtcttggcttggttctggtcgatcaggccggcgttgaggtcggcgtcgatggccatctgcttgccgggcatcgcatcgagggtaaagcgcgcgctcacctcggaaatccgcccggcgcccttggtcaccaccacgaagttgatgatcatcaggatcgcgaacaccacgatacccactacgtagttaccgccgatcaccacctcaccaaaggcctggatcaccttaccggcggcggcgtggccgtcctggccatgaagcatcaccacccgcgtcgacgccacgttcagcgccaggcgcagcagggtcgcaatcagcaggatggtggggaataccgcgaaatccagcggccgcagggcgtacacgcacaccagcagcaccacgacggacagggcaatgttgaaggtaaagaacacatcaagcaggaacggcggcatcggcaacatcatcattgccagcatcaccagcaacaacaacggcacacccagattgccccgcgacaggtcagtcagggtgccacgggccgtgttgagcatttgagagcgatctaccaccggtattcctcgtgtccttgaagcaaagttttgacgctggaaggcgacttgaaggcggtattgcaagaagccttccaactttgcttttgggcccggagaacctcgcaaacaccccgggtcaccgggtttaaatcaatccaaatgtgggagggggcttgctcccgatagcggtgtatcaggcactgatgtttggctgattcaccgctatcgggagcaagccccctcccacatttgatctgtgtatagccggtgctatcgaggaaatttctgacaaggatttggggttgcccctaggaaaccggctctctagtctccgtacaccgctgcaaacgcagcggtcgggcgtcgcggcccggtttaccaatgcgcagaagcgtcattgtccgctttcagtcagcgattttttgtcgtctactgtgcggccttatggtggctgtgcgcgggataccttcgggtatgccgggttccttggtaaccggtccgcgaacctgcgcacagctgccaccctccatcgcgtcgcggcgatctgtggcagctccacctttaccgaggaacttcacaatgatcaaacccaccccaaatccccccatccggctgtttaccgtagccgacggcatcagcaccgaagacctgctggtcaacctcagtgaaacactcgcttcggccaatgccctgagctgcgatctggcctttgacctggacggccctaaacgagaggaattgcttggcgttgcgcagttgatcgaactggcgcaattactggctgatcgtgtgcacgctggcgcagcactgacgagcgcggccagcagcggataacacggtccatacgtgggaggggcggtgcgacgattcgacttgctccctcccacatttgagcctttaagcaggtcgtatattcacggcctgaggaccttttggtccttgtgctatctcaaactcaactttttggttttcttccagagttttgaatccactcgacgcaattgccgagtaatgggcaaaaacatccggcccctcatcatcctgggtaataaaaccaaagcccttctccgcgttgaaccacttcacagtacccgttgccattgcctttctccttacaccgatagacccgccctgcacgctcgcgccgacgggaagcgcataaacgcccttgggtttatggatcatctgaaacgttatctgctcaccaatcgacagtgcagcccaatgccaatcgctccagtcgatgaaaacactttcttgctcgtcatccagcgcaatcaaccactctccccgggtcaactcataggatctgacagtacctgtagccagcctcaataccgctctcccctgcatccggtttattacatgcgcgaagtgcctgatctgtactaaacaacggcacgcgccctttggctactgtcaaagttgacaggtagacgcgagcgctcgatgggtgctagagcgccggttcatacatccggtgatggttttcgcttgcggggttttcgtcgcttgggcgcggcgggcggggcttcactgcccttggcatctttagactccactgcaacctcattgccatcacggtctcgggcaataaagccaatgcccttgaccgcatcgaaccacctgaccgtgcccttatccatctgtgcctcccgagacgcgcatgcctgcgcgcctcatcgctgtatcaaacagtgaaggcggcgtcgtggctactgtcaaagttgacaggtagaccgcacacctctgtaggagcgagcttgctcgcgaaggtgggtaacgataacgcggggaaacaggatgaactcagcgactctgagtttttcgcgagcaagctcgctcctacagaggcaggcataaaagcgcgttttcaggaatcgcggcgcaaatccggcgggatcggcaggtctttgagcgggtccgggcgcttacccttgccggcgcggtattggcggatctggtagacgtacgccaacacctgggccaccgccaggtacaacccggccgggatttcctggtcgaggtcggtggagtagaagatcgaccgcgccagcgccggcgattccagcagcaggatgtcgttggccacggcgatttcgcggattttcagtgcggtaaagtcgctgcccttggccagcagcatcggtgcgccgcccttctcggggtcgtatttgagggccacggcgtagtgggtcgggttggtgatgatcacgtcggcgtcgggcaccgaggccatcatcttgcgctgggacatctcgcgctgcagttggcggatgcgttgcttgacctcggggcggccttcctggtccttgtgttcgtcgcgcacttcctgcttggtcatcagcagtttcttgtggctttcccacagctggatcggtgcatccacggcggcaatgaggatcagccccagggccatccacagggaactccagcccaccacttgcacgctatggatgatcgcggattcgagcggctcatgggcgatgcgctgcaagtcatcgatgtcggacgacagtacggccagggccacgaacagaatcaggatgaacttggccagggccttgagcagttccaccagggccttggcggaaaacatgcgtttgagcccggcgccggggttcatgcggctgaatttgggcgccatgctgccggcggcgaacaaccagccgccgagcgccaccgggccgatcagcgcggcgagcaacagggtgatcaggatcggttgcaccgccaggatcgcgatctggcccgagtgcagcagatactggcccatggcgccggggctgagcagcacctcgcggggcaggctgaagttgtgcttcatcagctccatcaggtccagcgccaggccaccgccgtagatcagcaaggcaccggcgccggccatcatggtggcgaaggtattcagctctttggagcgcgcaatctcgcccttttccctggagtcctttttacgtttctccgtggggtcttctgtcttgtcctgaccactctcgctctcggccatggctcagcgcgcccgtgccagatcacgtaagaactgcagggcgtcggtggccagcggttgatactgattgagaatgtcagccaggccgacccagaaaatccccatgcccaacaccagggtcagggggaaaccaatcgagaagatgttcagttgcggcgccgcacgcgtcatcacgccgaacgcaatgttgaccaccaacagcgccgtgatcgccggcagcaccagcaacaacgaggcgcccagcacccagctgaggcgtcccaccagctcccagaaatgattgactaccagccccgagcccaccggcaaggtggtgaagctctcggtgagcacttcgaatgccaccagatggccgttcatagccaagaacagcaaggtcaccagcatggtcaggaattgcccgatcaccgccacggacacgccgttggtggggtcgaccatcgaggcgaagcccatgcccatctgaatcgagatgatctgcccggcgatcacgaacgcctggaagaacagttgcagggagaaccccagcagcgcgccgatcaggatctgttcggcaatcaacatcaaggcactgaggtccagggcattgaccggcggcatcggcggcaggccaggcacgatcaccacggtgatcgccacggcgaaatacagccgcacacgctgcggcaccagggtagtaccgaacaccggcatgctcatcagcaccgccgccacgcgaaacagcggcaggatgaacgaggccacccaggtgctgatctgggtgtcggtgagggccagcaacgactgcatcaggtcagccgatcaactgcggaatactgccgtacagctgcaggatgtattccataaaggtttgcaccagccacgggccggcgacgatcagggtgaccagcatcaccagcaggcgtggcaggaagctcagggtctgttcgttgatctgcgtggcggcctggaacatcgccaccaacaggcctaccaacaggctcggcaccaccagcacggcgaccatcatggtggtcagccacagcgcttcacggaacaggtcgacggcgacttctggggtcatgctgcttcacctaacaaatcacacgcctccgaaactgccggccagggtgccgataatcagcgcccagccgtccaccagcacaaacagcatgatcttgaacggcagcgagatgatcagcggcgacagcatcatcatacccatggccatcagcacgctcgccaccaccaggtcgatgatcaggaacgggataaagatcatgaaacctatctggaacgcagtcttcaattcagacgtgacgaacgccggcaccaggatagtcagcggtgcctggtccggggtggcgatgtcggtgcgcttggacaggcgcatgaacagctcaaggtcgctggagcgggtctgcgacagcatgaagtccttgatcggaccctgggccttgtcgatggcgtcctgagcgttgagcttttccgcgaggtaaggttgcagggcttgctggtttaccttgtcgaacaccggcgccatgatgaacagcgtcaggaacaaggccatgccggtaaggatctggttcgacggcgtctgctgcaggcccagggcctggcgcaggatcgagaagacgatgatgatccgcgtgaagctggtcatcagcatgacaaacgccgggataaagctcagcgcggtcatgatcagcaggatctgcaggctgaccgaatactcctgggcaccggtcgcgttggtgcccagagtgatcgccgggatcgacaatgggtcggcccccagggcaatcggcgcggccagcaacagcatgagcgtcaagaaaacgcgcattacttcttatccttctgatccttgcccagcaactccatcaggcgctgggcgaattctggcgtggccggctgggattgatccacgttcaccggtgtcttgagtacatgcagcggggtaatgcggccgggagtgataccgagcaggatctgctcctcgccaacctgcaccagcaccaggcgatcccgtgggccgagggcgcgcgagccaaccagctcgatgacctgggcattgcccgggccgataccctgtacgcggcgcatcagccaggccagcacaaagatcaagccgaccaccagcaacaggcccagcaccagctgggtcaattgcccgccgacaccgctgccgaccaccggcgccgcagccgcctgggcaaccggctccgccgccagggcgctcaatggcagcgccagcaacagtcccgccatcgaatacttcatctcagcgcaacttcttgatgcgttcgctcgggctgatcacgtccgtcaggcgaatgccgaacttctcgttgaccaccaccacctcgccgtgggcgatcagggtgccattgaccagcacgtccagaggctcaccggccaggcggtcgagctcgatcaccgaaccctggttgagttgcagcaggttgcggatgttgatttcggtgctgcccacttccatggagatcgacaccgggatgtcgagaatcacatccaggttcgggccatcgagggtcaccggctcgttgttcttcggcacgctgccgaattcttccatcgccaggcgattgccagccggtgcggtggcggcgtcggcggccagcagcgcgtcgatgtcgtcctggccgacatcgccggtttcttccagggccgcagcccactcgtcagccagggcctggtcttcggcggaagtgttttcgtgttcggtagccattacatgtcctcggcgaagcaaacattcataaataggggtgcatcagcggcggttgatcggctcaaccacttgcaacgccaggttgcccttgtgggaaccgagcttgaccttgaacgacggcacgccgttggcgcgcatgatcagttcttccggcaactcgacggggatgatgtcccccggttgcatgtgcaaaatatcccgcaggcgcaactggcgacgagccacggtggcgctcaggggcacgtcgacgtccagcaggtcttcgcgcagggccttgacccagcgctcgtcctggtcgtcgaggtcggactggaagccggcgtcgagcatctcgcgcaccggttcgatcatcgagtacggcatagtcacgtgcaggtcaccgccaccgccatcgagctcgatgtggaaggtcgacaccacaatcgcctcgctggggccgacgatgttagccatggccgggttcacttccgagttgatgtactcgaaattgacttccatgatcgcctgccaggcttccttcaagtcgatgaaggcctgttccagcaccatgcgcactacacgcaattcggtgggggtgaactcacgcccttcgatcttggcgtggcggccgtcgccaccgaagaagttgtccaccagcttgaacaccagcttggcgtcgaggatgaacagtgcggtgccgcgcaacggcttgatcttgaccaggttgaggctggtgggcacgtacagcgagtgcacgtattcaccgaacttcatcacctgcacgccgcccaccgccacgtccgccgagcggcgcaacatgttgaacatgctgatgcgggtatagcgagcaaagcgttcgttgatcatttccagagtcggcatgcgtccacggacgatgcgatcctggctggtcaggtcgtagcttttgacgctgccgggttcggcagacatttcggtctgtaccagaccatcgtccacgccgtgcaacagcgcgtcgatttcatcctgggacagcaggtcctgcacggccatgtcgtgatcctactgcaatacgaagttagtgaagagcgcttgctcgaccacgactttgccgagttctttctgggccacttcctgcacgctggcagtgaccttctgacgcagcatttcctggccgaccggggtggcgaggctgtcgaaggcctgcccggagaacagcatcaccagattgttacggatcaccggcatatgcactttgagggcatccaggtccgcctggttgcgcgccagcaaggtgatgctcacctgcaagtagcgctgacgaccgttgacgttgtaattggcaacaaacgctggaagcatctgttcgaagattgccggttgcttgacgttagtggcggtttcagcggcgggcaccggcttgcttgcactgctgtgcatgatgtaccaggtgccgccaatcgaggcaccgatggccaggagcaagcccagcacaatcaacaggatcagcttgagcttgcctttgcctgctgcggggggagttgctgcgtcgtcgctcttcgccatgccaataatccgtcactattctgggattcatagatctacgggaaggcaagagcaagtgttatgccagagttgtctggcaatacgggaagaaccaacaccacaaaacaaatgtgggagggggcttgctcccgattgcggtgtatcagcaacggatttgttgactgacacactgctatcgggggcaagccccctcccacattttgaccttcacagggcttgaatcaggcgtagtagtcgacggcgctggagccgatgacagtctgggtcaccggcgccacggcttcagctacatccacctggccgccgctatcgccaccgcgcccgccgccagcgctcacaccacgggtatgggcctgctgttgctgctgctcctgtccacgggactggtcagacacattcacatccacctgccccataccctgctgggcgaacatttcgcgcaagcgtccggactggctttccagggcttcacgtaccaccgcatggccgctcatgaaactgacctgggcctgctggtctgcggtcatgttgaccttgatatccaggcgccccaactcggccggctgcaactggatctccgccgacttgaggttggcgctggagaggtacattacgcggttgaccacttcttcggtccagccgctctggtgcatggccagcggcgcattgttgaccggcggcaaggcattcgcggttttcggcgtggcggcctgggtcagcgcggccaggcggttggcgaaatcatccacgcgggtgtcactgttggcgttcttgaggtcctttaggccgtcatcgatcagcccgctgaaagcattgtcgccaccctggtcggtgctgtccttggtggcttgctggtcgaccatagtggccaggccggcggcgaagctctgcgcggcggtcggttggtcctggatcgcggttttctgcgccgcctggctgctggccgacacgtggccgccctgctccatcgccaggcgcacagccggcatcgcatccagggggtcagcctccgggtcgaaggccgtcggcttggcttcatcggtcacggcgacgggcagggccgcgtcctcggcggccacggcgggagctgaggcttgcacgggcacaggcaccggcgtcactgcagcgatcaccgccggatcgaccaccgggtcaaccgggggctgttgcgcctgggacgggtcggtggctttgtcgccgtcgctgccagcgccgtcgtcggccttggccggcggcttggcaggcaaggaattgccgctatcggcaaccgctggtttgctggcggcaggggtttcgctatcggcggccggtttggcgttggtatcagcaggcttgtcacgtgtgactttgcctgggctgtcgccggccttcggcgccggcttgggaccttggttggcaaacacttgagcaaagccagcacccttgtcacgcggggccgcaaccgctaccgccggggtggcgacaggcgcttgaggcttggccgcgggggcagcctgtagaagcgaattgggagcgactggcataagtaagggtctccactgcatgaaggtcggggatgcagtctatggagatagagcaagagtcgggccaggtttggcgcgacgattcagaaactgaagcgctggcgttcggactcatacagcggacggaccaacgcgaactcatggtcgatctggtcaaccaattcgcccagatccgatgatggcttgacggactcagtctccagccgctgacacaactgcgccagccgcaccgccccgaggttgccactgctgcccttgaaactgtgcgcaatccgccccaatgccttggcatcgtcgcgcgcgttgcgcagcgcttcgatgcgtttttgcgagtcatcaaggaaggtgtcgagcagtttgggatactcaccctccatgacgtcctgcaaacccgacaacacgtcggggtccaaatgaatctcagccacttgctcgctccttgatcaagaatcggcggattatgccagagcctcccaacaaaattccacgcagacactgcgcccgccatcggaccagcgtacggcgctgctcaattgacgcaccaggctcaagccccggccagacagacggtcggcgtccaccggccgcgccaattccttgtctacgtcaaaacccgacccgctgtcttcaacccgcaaggtcatagtgccaccctggtcggtcggcgccacctgtacatgcacgcgcacatagccactattcaattgcgccagccgctcattgcgttgacgataatactgcgcaaaaccctgcgcatcgcgcttgagcgctgaatccaagcccagcacgccatgctccaaggcattggaatacaactcggccatcacgctgtagagcgccccgctctgctcgcgcaggccgtggacctccagcagcagttgcagcaagtacggcagcgggttgtagtttttgagagtctgggcgcgaaactcgaaactcaccgaccagtccagcgggctcgactggccgctgtcggcatacatcggctcagccacacgcagcggcggagcggacagcaaagtgatctcgaccatgctcacatcgtcccgcgcctggccgcgaaaggctgccagggcctgttcgatatcctcgaacaggcggtcgggctcgcggttggccgcgaacacctgttgcaagcgggcggcgccgaacagctggtcgttggcgtcagcggtatccagcacgccatcggagagcaggaacacccggtcgcccaaggccatgggccagacctcggtgctgtcatcgaacgcctccgccgacaacacccccaagggcagatgtcgcgatatcaacggcgtgcgccggccggtggcgacttcatgcacatagccttcgggcatgccgccgttccacacctccaccgcccgccgctgggcgctcaggcacagcaaggtggcgcagcagaacatgtccaccggcaggatacgcttgagcttggcgttcatctctcgcaacgtctgggtcaagccataacccttggcggtcatgccgtagaacacttcggccaatggcatggcgccgatggcggccggcaggccatggccggtgaaatcgccgagcagtatgtgcatgtcaccggacggtgtgtaggccgccagcagcaagtcaccgttgaacagcgcatagggcgattgcaggtagcggatattcggtgcggcgttaatacaaccggaatgggcaaccttgtcgaacaccgccttggccgcccgctgctcatgcagcaggtgttcgtggtgcctggcgatcaggtcacgctgctgcaggaccgtggcctgcaggcgccgcaggcggtccatggcgttgatcttcgccgccaggatcagtgggttgtagggtttggccaggaagtcgtcgccaccggcatccaggcactgggccagcgcttcgctctcacgcaacgaggtgaggaagataatcggcaccagcgcctcccccgccaattgcttgatctgtcgggcggcttcgaagccatccatcagcggcatcagcgcgtccatcaacaccagttgcgggcgctcgtgggcaaagacctcaaccgcctcaacaccattactggcagtcaacacctgatggccctggcgacggatgatggtcgacagcaacaaacggtcggcggcgctgtcttcggcgatcaggatggtcagcgcctcaaggacaggggccagggcgctcaactgatgtcgaacagcttgtcgaagttggagatggcgaggatcttgcgcacgtcggagttgctgttgagcacacgaacctcggcgtcatctccgcccgcatgatcacgtagcagcagaagcatgcccaaggcagaactgtccatataggtggtctccttgagatcgacaatataggtctcgggcaccttgtagaaccgctcgtaggcctcccgaaacgcctgatggctgccgaaatcgaaccggcccttgattgcgatcgtcaacttcttcccatccagggatacttctgactcgattgacatgtgactgcttccttgtcgttggcactgtgcaacaaggtgtagcaggcgaaccggatccaagcaacacatcgaatcaaatgtaagagcaaacccctcccacatttgtcctgcgtcgttagttagaactgttcgtggcggggaaggcgctgggacagttcatcgagcagcttttgctcgcgtttgtcttcaatcgcccgcgcttcgtcgatatagcgctgcaccagcttgcgcaacccttccacacgggcaaacgccgcttgccaggcctcgcgggccttgtcgaggttgttctggtgccaggccaggctttggcgctgttggccgacagccgtctcaagctggttgagaaagccctggtaacccatcagccactggcccgacacgcccttgctgccgcgctcgatccattgctgctggtattcgacgcgaaagcgctccaggtcgcccagcttgctctccgccaggcgcacctggccctggaaataacccaggcgctgcacggcggctttttcggccttctcggccatgtccaccaccggggccaggcgggcggcgcggctgttggccatggcttagccgcccggcgcgggggcgaagatggactgcagatgcgcctggctttcggccatgctgatcttgtcgttgaggccctggcgcaggtaggtcaccagttgcggttgcaaggcgatggccaggtcggtgtcgcggtcgccaccggctacataggcaccgacgctgatcaggtcgcggctctgctgataacgcgaccacagctgcttgaactgctgggcacgggccatatgctcaggggtaaccaccgacggcatgacccggctgatggacgcttcgatgtcgatggccgggtagtgcccctcttccgccaaccgccgcgacagcacaatgtggccgtcgagcacgccccgcgccgagtcagcaatcgggtcctgctggtcgtcgccttcggacaataccgtatagaacgccgtgatcgagccaccgccggcctcggcattaccagcgcgttccaccaatttgggcaacttggcgaataccgacggcgggtagcccttggtggcgggcggttcaccgatggccagggcgatttcccgctgggcctgggcgaaacgcgtcagcgagtccatcagcaacaggacattcttgcccttgtcgcgaaaatattcagcgatgcgggtgcagtacatggcggcgcgcaggcgcatcagcggtgcatcgtccgcaggcgaggccactaccaccgaacgcttgagcccttcttcaccgaggctgtgctcgatgaactccttcacttcgcgcccccgctcaccgatcaagcccaccacaatgatgtcggcctcggtaaagcgcgtcatcatgcccagcaacaccgacttacccacgccggtaccggcgaacaggcccaggcgctggccgcgaccgaccgtcaataaaccgttgatgctgcgaatgcccacatcgagcggcacgctgatggggttgcgcttgagcgggttgatggtggggccgtccatgggcacccagtcttcggctttcatgccgcccttgccatccagcgcgcgcccggcgccgtcgagcacgcgaccgagcatgcccatacccatgggcaggcggccggtatcggccaggggcaccacgcgggcgccgggggcaatgccggcgaggctgcccaccggcatgaggaaaatcttgctgccggaaaagcccattacttcagcttcgacctgcaccgggtggtagctgtcgctgttgatcaccaggcagcggctgcccatggcggcgcgcaacccctcggcttcgagggtcaggccgaccatgcgcaacaggcgcccttcgagaatcggctggccgggcaactcggtcgcctcggcgtagctgcccaggcgcttggcgaaactggtgcgatcaaggcgcatcgggggcgtccaggtcaacgctcaagtctggctctgccgggtgcagtgcttgctcatgcagttggtccagcaatttgtccatgatctggctgatgcgggtttccaccgtggcatcgatgcggctgtgttcggtctcgacacggcaaccaccgggcaacaacgcggcgtcctcgacgatgcgccaggtttcttcatggcgctcgcgcagggccttgacctgctcgaaatcctgcgggttgatgtacaaccgcacattgccgacacccaggggcagcagcttgagggcttcgcgcatcacgctttcgatctggctggaatccagcaccagctcgcgctggatcacctggcgggtgatgtgctgtaccagtccgaccatggatttttccagctgcgtgtcctgttcggcaatcgggtcgaataggttacccatcaggcgctccaggctggccagctgggtggccagcgccgcctcggcttcctggcggaccttgagggtggtgctgcgaaaaccgtctttttcacccgcggcaaagccttcgttgtaggcctcctggcggatggcctccaactcgtcgagggtcagtggctggacttcatccagcggcacctcttccatctccaccggcgtttctacgaccggttcaggctcaggctgcggcacatggggatcgaagctgggcagcgaccagatgtcgaacccaccgacatcccgcgcgcgaatcagatcgctgggcgtctcatctttgttcgacatgggaggcgccttagatcatttcttcgccgcccttcccgccgagaacgatttctccggcttcggccatacggcgggcaatggtgaggatttccttctgggcggtttccacgtcgctgacgcgcaccgggcctttggcttccaggtcgtcgcgcaacagttccgaggcccgcttggacatgttcttgaagatcttctccttgacgttttcgtccgaacccttgagggccagcaccagcacgtcggaggacacttcgcgcagcaacgcctggatgccacggtcgtcgacatcggcaaggttgttgaacacgaacatcaagtcttcgatctggccggacagggtgtcgtcgatctcgcggatcgagtccatcaactgtccttcgaccgagctgtcgaggaagttcatgatgtcggccgcgcgcttgatgccacccagggtggtgcgcgaggcattcgagttacccgagaattgcttctcgagaatcgtgttgagttctttcagcgccgccggctgcacggtgttcagcgacgacacgcgcaggatgatgtccaggcgcactttatggtcgaagtggccgagcacttcaccggcctggtccgggtccaggtaggccaccacaatcgcctggatctgcgggtgctcgtagcggatcacgtcagccaccgcacgcggctccatccacttgaggctgtccaggccactggtgttgccacccagcaggatgcggtcgatcaggccgttggccttgtcttcgcccagggccgaggtgagcatcttgcggatgtagctgtcggagccgacgcccaggctggtctggtcgccgacgatctcgacgaactcactcatcacctgctcgacttgctcgcggtgcacattgcgcatctgcgccatggccacgcctacacgctggacctctttagggcccatgtggcgcagcacttgggcggcgtcggtttcacccagggacagcagcaggactgcggctttgtcgacccgggaaagcttggccacagcggctcgatcattcatctgcgttaatccactctttcacgacctgagccacacggcccgggtcttctgctaccagactcttgattgcgttcaactgagcgtcatagccttcgctcgggcttggcaacaggatgctttgcgggccgccgaggctgacgcggtcgttggccagctcgccgtccaggccgcccatgccacccaactccacatcgccaccggccaaggccagctgtttcttgctgccaccggtgatgttgttgagcaccgggcgcagcacgccgaacaccagcaccaggatgaacaacacccccagcacttgcttgacgatgtcccagaaccacggctgggtgtagaacgcagggtcggcgatcacttcactgcgttcggcggagaacggcatgttgatcacgctgacgctgtcaccacggctggcgtcgaaaccgacggcgtcctgcaccaggcgcgtgaagcgcgccaattcgtcggcggtccagggtgcacgggtgacagcaccgtcagcggcgttgaccttgacctggtcatcgaccaccaccgacaccgacaggcgattgatcttgccctgttgctgcttggtgtggctgatggaacggtcgagttcgaagttcttggtggactggttacgcttgtccgccgggtatggcgcaagcatcggctggccggtggccgggtccatgatctgctggccgttggcatccagcagcggctggccgggctggatcgcgccagcagtggcagcggcgccaccggtggtctgcggtgccgaggcggccgacggtggctggttgctcaaggcccccggcacaccttgcgggccattggcggcggtgcgctgctcgctggtggactgctcgctgcgcagcgccggctggtcagggttgaactgctcggaggtggactcaacggcgctgaagtccacgtcggcagacacttccgccttgtagcggtcgttgcccagcaccggttgcaggatgttgtgcacgcgctgggtgagcatgctttccatgcggcggctgtaatcgaattgcttgccggcctgggtcagcgccgagttttccgccatgtcggagagcaggttgcccttctggtcgaccacggtgatttgcgacttgctcaattcggggacgctggtggccaccaggttgacgatcgccagaacctggccaggctccagggagcggccggagaacagttcgaccagtaccgaggcgctgggcttgcgttcgtcacgcacgaacaccgagcttttcggaatcgccaggtgcacacgggcacccttgacgttattcaggctggagatggtgcgcgccagttcgccttccaggccacgacggtagcgggtggcttccatgaactggctggtacccaggccctggtccttgtcgaggatttcaaaaccgatattgctgtcggacggcgtcacgccagcggcagccaatttcatccgcgcacgggccacatcatcggccttgaccagcaaagccccggagttgggctccacggtgtaggcgatgtcggcggcggcgagggtttccatgatctgcttggaatccatgcccgccaggctgccgtacagcgggcggtaatcaggttgttgcgaccacaacaccacggcaaaaccgatcgccacgctggccgccaggccgaccatcaggcctacctgacgcagcatggtcatttccgagaggttttccaggaacgacaggccaaacagaggcggtttgccgtctgtcttggcggggaggttgtcggagagtgcttctgccatgacttaaatctcgtccttaaaccggcatctgcatgatgtcttggtaagcctgaaccagcttgttacgcacttgagtcagggcctggaaagacacactggccttctgcgaggcgaccatcacatcggtgaggtccacgccgcttttaccgatctcgaacgcagtggccagctggctggacgcctgctgagtatcactgactttattgattgcctggccgagcatgtcggcaaaactgctttggcccaattccggtgctggcgcgacggatttcggctgagccatggcgtccatttgcatggcgcgcatatccaacatcaaccgattgaactcaataccctggctcatgaacttctctctccgacaacccgcatttttttgacgctacgccgctcttacaggggaggtagcaacaagggtgccaggtccgtggcgactcgtaagaaaaggcgacaaaccatgtcagccgaagcatttttcaggtggcgaaaaggtaggcttccacgtccattccggcatcgcgcatctgtgccagcttgtagcgcaaggtgcgcgggctgatgcccaggcgctcggccgcttctttgcggcggccgcgttcggcgcgcagggtgtcgatgatcatctgaaattcgcggcgacgcaggtcatcgcccagggcaccggccgattccgcctcggcaaccactggcgccggcgccaggctcggcaacggcgccgcgccattgcccatggccaggcagaagtcctggggctggatcaggccgccctgttgcaaaatcaacgcacgctggatcgcgttgtccagctcgcgcacgttacccggccatgggtagctgaccaggcaggcctgggcctcggccgacagccgcgcctgggcgtgcttcatttttttgacgtggttgttcagcaggcgctcggccagcgggaggatatccgccgggcgttcgcgcaacgggcgccaggccagcggaaacaccgatagccggtagaacaggtcttcacggaagcgccccgccgctacctcgccagccaggtcgcggttagtggtggcgaccacgcggatatccagctggatcggcttgcgtgcgcccacgcgctccacttcgcgctcctgcaacacgcgcagtaacttggcttgcaggcccaggggcatttccgagatctcgtcgagcaggatggtgccgccgtcggcctgttcgaacttgccggcctgggccgcgatggcgccagtgaacgagcccttttcatggccgaacaaggtggcttcaagcatattgtcggggatcgccgcgcagttgatcgcaatgaagggttgcttggcacggctggattgctggtgaatgtaacgcgccagcacttctttaccggtgccggactcgccggaaatcagcacggtggaatcactgcgcgctacccgcgccgccaattccagcaattgcgcgctggccggttcaaaagcaatcggcccatcgccctcgcccgccgaaatcacacccagggcgtgtcgggccaccagttcgatcaatgccttgggttcgaacggcttgaccaggtaatccgccgcgccctggcgcatggcgtccaccgcccgctcgacggcaccgtgggcggtcatcagcagcaccggcagctgcggctggcgtgcgcgcagcaggccgagcaactggtgaccgtccatgccgggcatgttgacgtcgctgaccaccaggctgaaggcttcctgctcgactgcctccaaggcttcctcggcagagccgaccgtacggtagtcatggcccgccaacagcagcgtgtcagccaatgcttcacgcagggcgcgatcgtcttccaccaataaaaccttgatagccataattcttttactccgcgcttgccgcactggaaaacagcggcaaggtcatcaatgcacaggtgccacgccccaggcgggaacgcagctgcaattgtccctgatgggcccgggccaccgccttgaccacggtcaggcccaggccagtaccgttggtcttggtggtaaaaaacggttcgcccaggcgttgcaacacctgcggctcaatgccgctgccgctgtcgctgatacacaggcgcagggtttgttcacgggtatagaggtgcactttcaggcgcgcgcccgggccgctggcctgggtggcattttcgatcaggttgagcagcgcgccgaccagggtgtcgcggttgcacagcaactcgccctggtggctgtcacactgccaacgcaggttggcgtcctggacatgggtggccgccgccgcttgcagggactgcatcaggccggcaggcgtgacgcggtcggtcagcggcaattcgccgcgggcaaacaccagcatgtcgcgcacctggtgctccaattcatgcaggcgctccttgaggcgcccggcaaagcgttggtgggtggtggccggcaattgctcatcagtcaaatgactggcgtagatcaacgccgccgacaacggcgtgcggatctgatgggccaaggacgcgaccattcgccccagtgacgacaagcgttcgtggcgggccaactggtcttgcaggtgacgggtttctgtcaggtcgttgagcaacaccaattggcccggctcggcgtccagggagcgggtggcaatagagaggcgacgcccgtccttgagggagacttcatggccgtcgtcttcacgcggcgcaaagcagcgggtgatgacttcacgccacagctcaccttccagcggcaggccgagcaggtcgcaggccgccgggttggcttcgcgcacgcggccctggtcgtcaatgacgatcacgcccccgggcagcaggtccagcaggttttgcagacggttggccaggcgctctttctcggccagctcttgcatgcgctgggcgctgaccaccgccagttcgcctttaagctcggacacccgggcttccagcagactgtaggagtcggtcagttggctcgacatctggctgaactgtgagaacgcttgctccaggccctggcgggtcggcggttctacaggcgaaaccagcccctggatggcaggggccgtagctagttgggcggcgtggggcatgatgctctctcgcttggctgaccgtcagttaaacggaacgttgcgagggctgtagcaatacccgtgccgaaaaaatcgccggtgtccgacctcgccaatacagttccgttttgacgagtgactgttgctgtcagacaaggcgccgcgacgactcatagctcgctatggggaggagcggcaacgcagtatgacggcaacaggcaccgtcataaactgaacagtattggtgaggtcgggcaccctaaatcaatgtgttgaaaaacaggcgtcaatcatccgcctgttcatcaccttctttgcggctcataccgtacttgcgcatcttctccaccagggtggttcgacggatacgcaaacgctcggcggcgcgggcgacgatgccatgggcgtcgtccagggcctgttggatcagcccctgttccaggttgccgaggtagtctttcaggtccaggccttcgggcggcaacagcgcggtagcaccgaagtccggggtatggccgttgatcgccacgcgctcttccatgtcactgcgcaggctgtccagttgctcgtcttcatcgtcgacgtagcggaatttcttcggcaactcgaccacgccgatcacaccgtaggggtgcatgatcgccatgcgctccaccaggttggccaattcgcggacgttgcccggccagccgtggcggcacagggacatgatcgcggcggagttgaagcgaatcgaaccgcgcttctcatgctccatgcgcgagatcagctcgttcatcagcaacgggatgtcttccacgcgctcacgcagcggcgccatctcgatggggaatacgttgaggcggtaatacaggtcttcgcggaagctgccgacctcgatcatgctttcgaggttcttgtgggtggcggcaatgatgcgcacgtcgacgctctgggtcttgttgctgcccacgcgctcgaaggtacgctcctgcagcacgcgcagcagcttgacctgcatcggcagtggcatgtcgccgatttcgtcaaggaacagggtgccgccattggccagttcgaaacgcccggcacggctggtgatcgctccggtaaaggcgcccttctcgtggccgaacagttcgctttcaagcagctctgccgggatcgccccgcagttgaccggcacaaaaggcccgtcgcggcgcttggagtgatagtgcaggttacgtgcgaccacttccttgccggtgcccgactcgccgaggatcagcacactggcgtcggtatcggccacttgctgcatcatctggcgcacgtgctggatcgcccggctggtgccgacgaggctgcggaacaggttgggttcacggtgacggccgcgctcgcgggcctggtcgtacatctcgcgatagacctgggcgcggtgcagggaatcgagcaatttgctgtagctgggcggcatttccagattggaaagcacacggcggcgctggtcttccggcaggtccacggaagaaatatcgcccatcagcaacacgggaaggaactcatcccaggttgacagtgtctttaacaagcccagaactgcgccaggagcgtttaccgtcccgatcaacacacagatgacttcacggctcgacgccaacgagctgaccgcctgctgccaatcgtggctgccgcagggcaaattttcttcaccgagaaaatttaaaatcaccgctaaatcgcggcggcggacgctatcgtcatcgatcagcagaattttggtttcacgccacatgcaatagcaacttccctagtaaaacttcctgccccggaatgagggcaatcaagacgcttgtaagatttcttacttactagacgtctgaaatctgaaaacagcactagttaagtcaaaaatgctggcacagtcaaatatatgacgcaccgttcggaccaactgagcccattcatccgaacagatggtaaacctttgacgcatttttagcttggttgatctgcgacatctcttcgaaaatcgcctggcgctcgccggtcgtgacttccagcaactgctgataaaccaccagcaggctctccaatttctcgcgcaatgcgccctcgtccaccggcacttcgctgagcacctcatcaatcaccgcacggcaacccaggtccaactcgccgacagcttcccaattacgctcagccagcgcgccgagaagggcttcgcgggtttcgtcgatgcgttgcagtgcatggctcatgatgtgtacctcaaggcgatcggccttattgtggagcgatggcatcccagccttctttgacggttatcagcaagcgggcaacttcatcgatgatttctgggtcattgctggcgtttgctttcaacaggcgcacgttcatgtagtcgtacaacgccgcaagacgctggatagtggcgggatcctcggccttcgtttcgtccaagccttgacgcaacccggtaatgatgtcgatagcctttgtgagtaacaaacctttttgtggaatatccccacgcgccattgcgcccttggcttgggcgaggcgctcaagcccaccttccatcagcatctgaatcagacgatgagggctggcctcggatacttgagcgtgggaattgaccttctggtattggcgaagggctctcatagggttcatgttgctacctcaaaacaggccacgggcgaataggattgctctatccagtctttcgactgcaccggcaaaaactttaatccagaaccgaagccgagggcgcaaagcgcgccctacttcaatcagttcgatttaggattattcaatgcgttgagcgtggtcatgatgctggagctggtgttgttgatctgcgcaatcatagtgtccatcgcggtgtacttagccgtgagagacgtctgcagggcctccattcggcgatccagggtgctctgctcagtggtcagctccgtcaacttgttgttgaggtctgttgcgcgtgcggccagcgtgccagtggcgccaacatagcctgaggtcacattgttcatgcggctgatcaagcctttgtcaccagtgaacatcttggcaatatcacccgctccggtgaccacagccttgtcccaggtcttgtcgtcaaggctgagcaggccggtcttctggtcggtggtgatgcccatttgggccaggctgctgatggcgccgctgcccgaaccgttgaccagctcaccacgcaaactgttcaccagttggcgcatcgatgagtcgccagtcaaagccgccgcggtagtagtcgaggaatcacccgtggccgtgactttggtctgcgcattgactgatgtcatcagcgcgttgtaggccgtgacgaacgattgcaccgacgtcttcagagtctcagtgttactgcccacggtaatggtggtagtgagcggcttggtcgggtcctcagtcagcaactccaggcttacaccactgatcgccgagctgatcttgttggtggtggactccatcgcaacgccatcgatcgagtatttggcggtcttcggaacctggcccggatcataaccggcggccagctccgagttaccactaagggtaatcgcagtgccgtcaccgctgttgctggagccgataaccagacgcgaacccttagagtcactcaatacgttggcattgataccttgcgccgacaactgagtgttgatggagtcacgcacctgctgcaaggtcgcaccaccgggtatggtcacatcgtaacttttacccgactgattgatagtaagcgtctgattgtcgtcagagctgtttgccttggcagaggtaccgccctcgaaaaccttggtcgtcactttcgacgtcgttgccaggttgttcacgacgagtgtgtacttcccgctggaagctccatccccgagggtaaccttgacgttcttctcttcggaactggtagccgcaagaccgttgaacgaggaaatgttgtccaacttggtgattgccgcccggtaggcttccaacgccgtcttcaccgtgccaacggccgacagtttgacggtcgtatctttttgctgactggtgatctgggtctgcttcggcgccctttcagcacctaccagagccttgacgatagattgcgtgtcgtagcccgaacccgggccggaaatcgttgaacttgccatttgcaattctccttgtcctgcggctgctgcttttttggcgcattaacgctcaggcagcaatcagaaacatgtttcgtgccaactcacgccttggtatcaaacaacaggctgccggccttgctcagatcctgggccagcttcagcgcagtttccgagggaatctgtcggatcacttcaccgctatcggtggcgatcactttgacgacgactctatgggtagtgtcatctatggagaagtccaggttgcgttggctcgcctgaacaaactcacgaatatcggttacagcttgctccaatgccgcacgcttgggctcatcggcaagagctgattcagcctgcgccacaggtttggccacgctagcaggcgtgccagcgaccggggttgcaccagacgggtaagacgcgttcagcttaatgctcatgtccatgtcatcacctcataactgaaaaaacgaaagggtacgtaaacgcacccttccgttagtcaaccgttaccgatgttactgaagcagcttcagtacagcggatggcagctggttggcctgtgccaggatcgcagtggaagcctgttgcagggtttgttgcttggtcagctcagcagcttcggcagagaagtcagcatcttctacgcggcctttggcagcgctggagttctgcgaaatgctctgcaggttggcagtggtgctgtcgaagcggttttgtacggcacccagttgcgaacgctggctgtcgatctgctgcatggcgccttccagagcctggatggcctgttgcgagcttgccgcagtcaggacgctcaggttggaaacggtggtttccagggtggtagctttgctggagccagcagtcagacccagtgcagccaggccagtgcccgcgctaccgtcagccactacgatgtctttcttggagaacagagccaggctgccgtcagagtttttgctggcggtagcaccggtgcttgcactgttgatcgaggaaacgatcgcgtcagtgttatcacctgccttgaacttcacttcaacgccgttcaggctgatcgaggtgtcagcggtcagtttggcctgggaagtaccagccgacagacccagagaagacaacgagccagcagtcgtgttggacagggctacgtcagcgccgccagcagacttaacttggatacgaccatcagaaccgatggtagcgtcgccaccagtgcctacagcagttttgatgctggtcagcacagaagtgatagttgcgttggcggcccaggtcacggctttgccgttaacactgattgcgccggcagcgtccagagtggttgcgccagtagcaggggctgcagcagttttgccatcagcgataccgatagcggtggcgccaccggatacgttgattgccgcaggagaagacaggctgattttaccgccagtttcatcccaggaagcggtaacaccggcattggcagtgttgatcgcagcagcaaccgcggcacctttgtcaccagcagtcagagcgatatctttaccgttgatgttaatggttgcgccaccagcagcaacaccggcacctgcagtttgcagagcagtttgcgctgcaccggaagcgaccttggcacccgagagggaagcgccggttgcagtggcgctgatgccagccagagcagcaccgttcacagtggcttcgctgtacgaacctttcagggcagtagcgctggtgtcacccataccgaacgagatagtctcgttggcgttggcaccaatctggaaagcaacgttgttgaacgtaccgtccagcaggttacgaccaccgaaggtagtggtgttggcgatacgggtcagctcacccactttagcggtgaattcttgctgcagggaaacacggtcagcgtcgcttttatcaccgttggccgcttgcagggcgagttcacgcagacgctgcagggtgttggtggattcctgcattgcgccttcagcggtctgggcgatcgaagtaccgttggcggcgttggcaattgcaacgttcaagcctttaacctggttgcccagacggttggcgatctgcatgccggcagcgtcgtctttggcgctgttgattttcttgccggtcgacagacggttcatcgcagtgctcagagcgtcggaagctttgttcaggttcttctggacacccagggaggtgatgttggtgtttactgataatgccatgacgaaatcctcgttggttggatactgcggcttccggccctggcgaccgccgggtgtggcctagagaacctacgtaatagttatcgtcgtggtagccggttgcttgaggacttttttgattttttttagtagccccgtgccaccctttgcatttcaagggcttacaccggcacaaaaccccggtttcattggcttttctgacgccaataaaaaaacgccgatgaacgaagggtcatcggcgttttttatgcagcggctaaaacatcacgggcgatagagaatcgccgagccccacgacaggcccacaccaaaaccactgatcgcaacacgcttccaggtggcgtccatcacatgcttttccaacagcaacggaatgctcgacgacacggtgttaccggtctcgaccatgtccttgatgaacttgtccaccggcgcttcttcgaaacggcgtgccacggcatcgacgatggccgcactgccctggtggatacagaaggcgtcgatgtcatcggccttgaggtccgactcggcgagcagctcgtgcaagtgcgccggcaccttgagcaaggcgaagttgaacacctggcggccattcatgaagaacacaccgtcgctgaccttcaggtgcggcgcgccggagccgtcggtgccgaacttggacttgccgagcaaccacggcgcgtcttcgcccatccaggtggcggtggccgcatcaccgaacagcatggtggtgttgcggtcttcggggtcgacaatcttcgaatacgggtcggcggtgatcagcaggccgtttttcaggccggcggcttccatgaagcccttcatcgcgtagatgccatagacgtagccggaacagcccagggagatatcgaaggctgccacgtgggtgggcaggcccagtttgtcctgaacgatggctgcggtgtgaggcaagccctcttcatcgccgttctgggtgacgacgatcagcgcgtcgatagactcgcgcttcaacgccgggttgttggcaaataaagcgttgaccgcttcgacacacaggtcggacgtctcctgtgcagcttccttgcgcggcaggaacgccgaaccgatcttgccgatgatgaactcttcatccttggcgaatttggcaccctgggcgtagttatcgatcccgtctgccggcacgtaactggcgatgctttttatgccaatcattatggcttcccaatactaaatagctggagaacacccctcgggctacgccgggagtgctgacaataaaggggataaccccatgaaaatctcgctgaaagccaccgcgcaaggaccctgcgacgacttatccttttcacacgatacagtgaagatgcgctttatgactcacaggtcactcaattttgtgtgctttgtgcaaaacctttcaacaattaaaccccataaacgacaacggcccgccctgtttccagagtaggccgcttgacgaaacaccgtttacatcttgttgaacaggctcaactgcgagattttcacaaaggccagctgcgaggcctgcaacatggtctgctgcaagctcaggttgatggccgcttcggcgaagtcgacgttgcccagggcgctcatggtggtggtattggccaggtccaggctgacgttttccctggactgaatgtccaggccattgaggcgcgcgcccacggagccacgcgcctggtcgatctgcccgtaggcattggtcagattgccgatggacttggccaccacgtccttgagctccttctgcgccgctggattgccgtctgacggggtttccaggattttgcgcaaatggctcagggtgtcgaggacgttttcgttcttgttgctggtggcgccgatcgaaaattggtcgccagcggctggagccggtgcggtggtgacatcgaaggtcacccctgccgccgtgatcgaggttgcaccggccgccagggtaccgctggcgatggattggctgtctgccgtataaggctgcgcgtacaggtcataagcgccggccgcaccgaacttgacgatgacgccggagttgggaaaggtgctggcgtaggccgccggatcgctcaccgtgccgccgctcagctgtgccgtggaggggttactcggggtgcgcgatacgctgaaggtgtccggcttgaccgagaggctgaactcacgatccttgacgatggcgtccgctggcgcaccaggcagtatgtctttgcccagcgcgtctttgcccaggttcaagccaatatcgaacttgaccccgcgcagcttgatactcgatccgccttccttggtggcatcgaaggtgccattgcccggaatctctgaggtaatgtctttgccagcattgtccgttaccacatattgggtgctgctggtgaacgtcagcttatacggctggccatccgaaaagctgctgtcgtagttggagttagccgcaatcaggccggccgacaccgtgaccttcccatcatcgaccgctggcggcacgaggataggtgctgtttgcgtacggccagtgttcgccgagctttccagcatgcttttggcggtattgcccatggctaccgacagattttccgcaactttcaggctcaacggcgtgtcatcgccctggtagctgtaggtgccatcattgttacgggcgtagggaggcgtgtcggtcttgctcccggagaacatgtaattaccactggagtccttggtattgagcaagcccaggacctggtcttcaatggcgccgatctccgcggcggtcgatttgcggtcagcgtcactgatgccgacgttgcccgccttcagcgccaactcactggccctctgaatcgcgatattgatattttccagcacgctgtcctgggtggtcagcgagtttttcagggtgtcgatgttgccattgaactgccccagcatgtctttctgctgttgcagcatcagcaagcgcgccgccgccaccggatcatccgcggcggtttgcacgcgtataccggtggtggcctggtcctgggccttgaccacactggaatagttgctctggtacttggcggaactggtctcgaaatactgctgtgtagaaatacgcatcgtcccagcctcccttaaagagcattcatcagtgtggtgaaggtttcctgcgcagccttgatgatttgcgacgacgcggtgtagtactgctggaacttgatcatgtcacccgcttcatcatccaggttgaccccggacaccgagttgcgcgcttccttgttggcgctcagcaacgcgccggtggcggcggtgtcgaccccggcctggctggccttggcccccacttgcgagaccagcttgctgttggcccccaccaggctggtgccgccgttgccatcgcccatgccaacggtggctttggtttgcaggttcagcagttcctgggcgttgcggccgtcggacttgccgccactgttgaaggcgaaggtggtgctgtcgccttgtgccggtgagccgttgacggtggtgtcgaacttgaagctcttgccggggatcgcgaccccgttggcgtcacgcatcggcacgtccacggtgatcttgttgccctgccccggaataatcgagccggtgctgatcgggttgcccttggaatcgctgatcgtgtaggactgcgtaccatcagcggccggtttggcaaagaccattttcaccggcatcgagttttcaataccggcgcgcagctgtgcggtgtcggcgccgccattaatatccagcggtactgtcagggacggctgggtgaacgtgcccgtgccactgttggtgttgctgctggtacccgccaacgggccggcaaacgccagcttgttcgcatcggtgagcgccacgccaatcgcgctggccccagtggcagtcgggctgaccttgaagctgtcgccataggccatcgtgcccttgccatccagcgccagggtgaagccgtccatggtcggcggcggcgtggcggacatatcaaaggtgcccatggccttgccgtccgagcgcagtaccgtgaccttgttggggtcggtcttgtcgttgaagctcacggtgtagtcaaacgcggacaacttgctgctgtccttgatcgtcacattcaggttgcctgccccggcactgttgcccaatgcgccctggctgcgcgaggcaacggcgacggcgctgttgatgtctttgaacatcgaaacgccaaagtcaccattgaggtccaagccctggcccagttggttgttgatggtgtctgcggtcgctatggcgatacggcccaggtcattgatagccggcatcaaggcatcactgcgataacgcaacaggccgccgatgctgccgccgctgatcacgccacccaagtccatgggggtgccgttggtattcaactggatagtgtactggctgttatcggttttgctcggcactgcagaaatcgtattggagatcccgccttctaccaaggactggccggtgccggtggtcacgctgaactggccgttcttctcggtggccgttacgccgatcaattcattgagcgagcgtaccgcctcgttgcgcgagtccagcaggttggccggcgcattgcccgacgcgccttgcacctgggtgatctgcttgttaagcgaggcaatcgaggcggtcaattgattgacctgctcactcatgctgctcagttggttgttgatggtctctttctgctgggtcaactgcgtcgaaatcgagttgaaacgactgctcagggtctgggcgttggtcaccagcagctgccgcgcagacaggtcactggggttggacgccgcggtctgcagggtggcgaaaaacgaactgagcaccgaggacaaaccggtggtcttgtccgacaacactttgtcgacggcaccgacctgatccagatacgccttggcatcgttattcagggccgtgctgttctggtaggcggtgtcgaggtattcgttgtacacccggcgcacgtcagccagggtggtaccggtgccgatgaacacaccgccgaacgggttcgacgcgttggtattctgcgtggtctgctgccgcgagtaccctggggtattaacgttggcgatgttattactcaagaccgacagcgatccttgagcggcgttgagccctgacatcccgatactgagcaaactcatggttcagaccttataaatgtgtggttgcgccagcggcagcgtagttctggtaactgttcatattttttgcgatctgcgaaatcttgctggcgtaagccgggtcggttgcataaccggctttttgcaactcgcgtacaaactgttccgggttatcggctgatttcaagacttctttatagcgatcatggctttgcagcagggtcacaaggtcgtggaagctgtcctggtaggagctgtaggaacggaactgcgccgtttccttgaccatcgcgccatcgcggaactcgctggtgatcgcacgggcctggccgccctgccaactctggccggccttgatgccgaacaggttgtggctgctgctgccgtcctcggcgcgcatcaccgatttgccccagccggtttccagcgcggcctgggccaccaggtacttggggtcgataccgatacgcgcggcggccgccttggccatcggcaacatggtggcgacgaattcgtcctgggagctgaaggcttttttcgccggcgccagcggtggttgggcaatggcgcggccatagacctgcatttgtccgcttggcacggcaaagctgcgggcggcgctgctgaccacattgtcgtcggcggcgctgttgcgcaggggcgcgcttttggcttcggcggcaaccggggcactcggcacgatgccagccagcaggcggtcggccagtttgcttggcaaggcgatacggcgctggttcatcagctccatgtcgttggtgtgcgcactggtgccctcaggaaccgccacgcgataagcccacaaaggccgctggccattggagcggcccagcggcccgtcggcctgagtaccggcgccaatctcggtcggcacatcgactttcttcaccggcacatccgccgccgggccttgcaaggtggcggcctgggcctgcaccggcttgttcttctgcatctggcgcatcagcacgtcggccaggccgataccgccgccttcgcgggacatcgagaccgccagttgctggtcgtacatttcctgatactgcttggccgccggggtgttcagcgggttgtccttgcccagggcgtcggtggccgagcgcatggacttgagcatctcgttgaggaacagcgactcgaactcctgcgccaccttgcgcatattgccgtcgctgttcttgtcggcgccgactttgagctggttaagccggttcaagtcggaataagaccccgagtccgccgtgctgctgatgccgcttttgcgcatatccatggccatggcctcagatcacaatgaggtcggcttgcaaggcgccggcctgtttcaaagcttcaaggatcgccatcaagtcaccgggcgctgcgcccacctggttcactgcgcggacaatctcgtccagggtggtaccggggccgaacttgaacatcggcttggcttcttgctgggcattgacccgcgagcgcgggaccacggcggtctggccgttggacagcggccccggctggctgacgatcgggtcttcggtgatggtcaccgtcaggctgccgtgggtcaccgctgccggcgaaaccttgacgttctggccgatcacgatagtgccggtgcgcgaattgataatgacttttgccacggcctggccagggtcgacctcaaggttttccaggatcgacaggtagtccacgcgctggcttgggtccagcggcgcggtgacgcgaatcgagccgccgtcgatggcctgggctacaccagggccaagcatgtcgttgatcttatcgaccacgcgcttggcggtggtgaagtcggaacggttgaggttcagggtcaggctgttgccctggttgaacccgctcggcacggtgcgttcaaccgtggcgccaccggggatgcgcccggccgacggcacgttgacggtgatcttcgagccatcgcggccttcggcgtcaaacccgcccaccaccaggttgccctgggcgatggcgtagacgttgccgtcgatacctttgagcggcgtcatcagcagggtgccgccgcgcaggctcttggagttgcccatggacgacaccgtgatgtccaccacctggcccggcttggcgaacggtggcaagtcggcgctgatcgacacggcggcgacgtttttcaactggacgttgcccgagcctggcggcaccttgatgccgaactgcgagagcatgttgttgaaggtctgcagggtgaacggcgtctgggtggtctggtcacccgtaccgttgagccccaccaccaggccatagccgatcaactggttggaacgcacgccggaaatactggcgatgtccttcaggcgttcggcctgggccacagcgcttaaggccagcaagagtgccgtcgccatcagctgtttgaagttcaaagtggccacctagaaagggaacagcgggctaaggaagaaccggtcgaaccagcccggctgactggcatcagcaaacgaacccgtacccgagtaggtgatgcgtgcatcggcaatccgcgtcgaaggcacggtgttgtcggtggaaatgtcatcggcgcggaccatgccggcaatgcgcaccagctcgtcgccggtgttgagggtcatccacttttcaccgcgtatggcaatgatgccgttgggcaatacgtcggccacagtcacggtgatcgaaccggtcaggctgttgccctgccccgccgcactcttgccgttggtagcgcggtcgccgctgtagccggcatccaggctcaggtcaccgccgcccagggggttgttggtgctgaggccacccccgaacaacgaggtcaggccgatgctcgccttgctgttcttgccgatctgcgagttggcgttcttgctggcctgggtcttctcgttaagggtgatggtgatgatgtcaccgacccggaacgccttgcggtcgctgtacaggttctgttcgaaaccggcctggtagatcgagccgttattggccgccgccggcaatggcgtgcgcggcaacaccggcgcgtagtacgggtcattgggctttggcgtcggcgcaacacaccccgcgagcacggcgatcccactcaatgccaaaacggaaacatagcgattcatgacccttacctcatggtgttgcaggcgctttcgaaagcgccccagactggattacagattctgcgtaacgaacgaaagcatctggtcggcggtggaaatcaccttggaattcatctcgtaggcgcgctgggtggtgatcatgttgaccatctcctcaacggtgctgacgttggaggtttccagggtgctttgcagggtggtgccgaaaccgttcaagccaggggtgccgatttgcggcgcgccgctggaggcggtttccaggaacaggttgttgcccatcgcctgcaggccggccgggttgatgaagtcggcggtttgcaggttgccgatcacttgcgacgccgggttgccggccacggtgatcgacacggtaccgtcgttgcccacggtaaaggtcttggcatccggtggtaccaccacggcaggttccagggcgaaaccgttggcggtgacgatctggccattggagtccaggtggaaagtaccgtcacgggtataggaagtagtgccatccggttgcagcacctggaagaagccacggccgttgatggccatgtccaggggttgtccggtttgttgcaggttgccggcgctgaagtttttctgggtgccgacgatctgcacaccggtacccagttgcaggcccgacggcaattcgctgtcctgggtcgactgggcacctggttgcttcttgatctgatagagcaggtcctggaactcggcgcgatcacgtttgaagcccgtggtcgagacgttcgccaggttgttggaaatggtggtcaggttggtgtcctgggcggacaggcctgtcttggcaacccatagagccggaagcatgctgttctccttcgtgcgcctgtttgttggcgccgtgcgacgaaattaattaggggcttagctcatctgcatgacgcgagtcatggcctggtcgtcttctttagcgctgttcatcatcttgatgtgcagctcgaactgcttggagagcgccagcaccgcggtcatttcctccaccgcgttgacgttgctcgcctgcaggaagcccgaggtcagggtgacgttcgcgtcggcctgggccggctggccatccctggtgtggatggtgccgtccaggcccttggtcatgtttttgaggtcgggctggaccagcttgatgcggtccacttccgccatcacccgtgggccttcgcccatggcacggatactgatggtgccgtctgcacccacttcgattttctgctggggtggcacggcaatcgggccgccgttgcccatgatcggcataccgttgccggcacgcagcacgcccagggcatccacattcatgctggcgctgcgcacgtaggcttcgccgccatccggggtttgcacggccatccagccgtcgccgctgacggctacatccaggtcacgaccggtttcgatcatcgcccccggagagaagtcagtggccggccgctcggtcatggcaaatgcccgcgccggaaagctgtcaccgaacaccggcatcgaacgcgcctgctccaggtcacgctggaagccgttggtggaaatgttcgccagattgttggcatgggccttctgcgccagtgcgttctgactggcgccggtcattgccacataaaggtatttgtccacgctctatcctctttctgacggacgcttgccgtccaccgctgtactaatgaggcttaagcaatttgcgaaccaacttttaaaaagaggctgaagtccaggcgcgacgggggtttgcggcgaaacaggatgatttgaggcttgagcgcgagtcgaaaaaacggcggactactgccgcctgcggcaatcaccgacctggaaaacgacgaagatcaaatgtggggtgctcccgatggcggtgtatcagccagctcacctgtagctgacacaccgccatcgggagcaagccccctcctacatttttgaccgcgtagtgtcagcgaattatttgtcggccttgaggatttcgtaatcgcgcagcttattggcgatggtggtgtgcgacacgcccaagcgtttgccaagctgccggctgctggaatgctcggcataaaggctttccagcacggccttctcgaaccgtccaacaatctcctctaacccgccctccagggaaaaatcgccaaggggctggcgcaccccgtagtccggcaagcggatatgctcggccttgaccaccccaccgtcacacagcgacacggcctggaacagcacgttttccagctgccttacgttgcctggccagtggtagtgactcaagcgatccatcgccgcaggcgcgagcttgggcaaagggcagccgatctgtcggctggcctggtcgaggaagtgctcaaccagtggcaccaggccgtcgaggcattcgcgcaacggcgggatatgcaacgacagcacattgagccggtgataaagatcctggcgaaactcacctcgggcgcagagttccgacaagtccacctgagtggcgcagatcacgcgcacatccaggtacacctcttcgtcactgccaacccgccggaaacagccgtcctgcaggaagcgcaacaacttcacctgcaagcgcgcgctcatttcccccaccccatcgaggaacaaggtgccgcccgccgtcaattccagcagcccgagcttgccttccgcccgcgcgccttcaaaagcgccggggccgtagccgaacagttcggtctcggccatcgactcgggcaagcctgcgcagttgagcgccatcagcggtgattgcccacgggggctggccaagtggcaggcacgggccagcaactctttaccggtgccggtttcaccttctattaatagaggcgcatccagtggcgccatgcgccgcgcttcgcggaccaccgcggccatgaccttggagctctggaaaatgctgtcgaacccgcgcagctcttgcttgcgcacgttatagatacgctcaccgacgcggtcggcgcgatgcagggtgagcaccgcgccggccatggcttcgctgtcatcgtgttcggaggattgcagcggcgcgatatccgccaggaacacgtcccccttgaccttgacccgaagcccattgatgcgcgatttgctggcgcgtaccaactccggcaagtcgaaatcctcagcgtagcgcgacaacggaatgcccggcacttcgtccacacgcacgccgagcaactgcgccgccgcacggttggcggccacgatggagccgcccatgtcgatggacagcactggaaactccagggcgccgagcagcgcattgagttccatatgccgccgctcgctgggcatcagccccactcgcttgacgccgaacacgccgccaatcgcttcgaactgcgggcgtagcgcctggaactgcatattcaccaggttcgggcagaacaggtagatggcattgccatgctccccaccgacctcgcccttggcgacgttgacgccgtactccaccagcaggttgaggatgtcccgcaggatgccgatgcggttctggcaatgcactttgatacgcatgaaaaggctcgaaaagtaggtaggcgccgcgtctttttgtcgcccagcgcagatagtcgtcaagattatgtgacagagcgtaggcgtttcccagcccataacgcggataagtcatccattcgtaacgaatactttacgaaaaacggtaatttttcctacataccctggtgcaacgtagatggaatcctgggcccaccgggttatcaataatgcatcgcaggacataacaagaacgaatgcctagcaggagagccgtatgaagcagacgcactacgtggcccgcgagcccgatgcgcaaggttttatccactacccgccggaagaacacgcggtgtggaataccctgatcactcgtcaactcaaggtgatcgagggtcgcgcctgccaggaatacctggacggcatcgacaagctcggcctgcccctggatcgtatcccccagttgggcgaaatcaacaaggtgctggccgaaaccaccggctggcaagtggcccgcgtgccggcgctgattcccttccagaccttcttcgaactcctcgccagcaagcagtttccggtggcgacgttcattcgcacccgcgaagaattggactacctgcaagagccggatattttccacgagatctttggccactgccctttgctgaccaacccttggttcgccgaattcacccacacctacggcaagctcggcctggcggcgaccaaggagcaacgggtatacctggcgcgtctgtactggatgaccatcgagttcggcctggtggacacgccccaagggcggcgcatctatggtggcggcattctgtcgtcacctaaagaaagcgtgtattgcctgtcggacgagccggagcatcaagccttcgacccgctggaagcgatgcgcaccccatatcgcatcgacatcctgcaaccgctgtacttcgtattgcccgaactcaagcgcctgttcgacgtggcgcaggaagacatcatgggcatggttgagcgcggtatggaattggggctgcacgctccgaaattccctccgaaacccaaagccgcgtgaacctcaggttttaacgccaggtgagtctgttccctggccccgcgttgctttagggtaacgccactgaccttcaaacattcgaattcaggacatctcccatgaccaccttgaaccaagcccactgcgaagcctgccgcgccgatgccccgcaagtcagcgatgaagaactgccagtgctgctcaagcagatccccgactggaacatcgaagtgcgcgacggcgtcatgcagttggaaaaggttttcctgttcaagaacttcaagttcgccctggccttcaccaacgccatgggtgaaatctccgaggccgaaggccatcaccctggcctgctcaccgaatggggcaaagtcactgtgacttggtggagccactcgatcaagggcctgcaccgcaacgacttcatcatggcagcacgcaccgatgaagtggccaagaccgccgagggccgcaagtaatgcacttcgacgccattggccgcgtgcccggcgacccgatcctcgggctgatggacctgtatgcccaggacgccaacccggacaaattcgacctgggtgtgggcgtctataaggacgaccagggcctgacgccgattccccactcggtgaagcttgcggagcagcgcctggtcgatacccaggtaaccaagacctacatcggcggccatggcgatgcggctttcggcacgctgatcagccagttggtactcggtgccgattcggccttgctgcgcgagcgccgtgccggcgccacccagaccccaggcggcaccggtgccctgcgcttgagcgccgattttatcgcccagagcctgcctggccgtggcgtgtggctgagcaatccgacctggccgatccacgaaaccatcttcgccaaggctggactcaaggtcagtcattacccttacgtgggcagtgacaaccgcctggatgtggcggcgatgctggcaaccctggcgacggtgcccgagggcgatgtggtgctactgcacgcctgctgccacaacccgaccggcttcgacctgtcacaggatgattggcgccaggtgttgcagattgtgcgtgaacgccagttgctgccgctgatcgactttgcctaccagggctttggcgatggcctggagcaggacgcttgggcggtgcgattgttcgcaactgaactgccggaagtgctggtcaccagttcctgctcgaagaattttggtttgtatcgcgatcgtgtgggcgcgttgatcgtatgtgcagcggatgcggaaaaactcaccgatgtgcgcagccaactggcgaatatcgcgcgcaatctgtggtcgacgccgcctgatcatggtgctgccgtggtcgcgaccattcttggtgatgccgagctgaaaaaactgtggagcgaggaagtcgaggccatgcgttcgcggatcgcgcacttgcgttccgggttggtggaagccttggcgccccatggcttgtccgagaagtttgcccatatcggcgcacaacgcgggatgttttcctataccggtttgagtgccgatcaggtcaagcaactgcgcgagaagcacagcgtgtatatggtcagttcaggccgggccaacgtggccggggtggatgcgacacgtttgacgctgctggcccaagctatcgccgacgtttacaactgaaaaccccgggacccaatgtgggagggggcaagccccctcccacatttttaaccgagttggtttttagcccgtaaccatttcagccttgagctgcgcctccctggcctgagcatccgccaaccgatacagctcgatatgcccatcccagtgctcgatcaacgccgtgcatgactccacccaatccccgcaattgaggtaatccacctcccccaccttgcgaatctcggcatgatggatatgcccgcacaccaccccatgcagttcgcgcctggtgacttcgtgggcgatggcctcttcgaaatcgctgataaagctcacggcggttttcaccttgtgcttcaggtacgccgacagcgaccagtagccgtagccatagcgtgcacgccaatgattgagccagcggttgagggtgagggtgaattcgtaggccgagtcaccgaggaacgccaaccaacggtgatagcgggtgatcacatcgaactggtcgccgtggatgaccaacagatgccgaccatcggcggttacatgcacggcctcgtccaccaactggatattgccgaggatcagcttggaatagcgtcttaaaaactcatcatggttgccggtgacgtagatcacctcggtgccgcgcttggccatagtcagcaggcggcggatcacgttggtgtgggcctggggccaatacatgccgccgcgcattttccaaccgtcgataatgtcgcccaccaggtaaaccttgtcggcgtgatagcccttgagaaactgtgacaggtgttcagcctggcaatcccgggtgcccagatgcacgtcggaaatccacagggttcgcacccgttgcttgcggctgggcttggtgaactcggcatggctcatgggcatccctcgacgctgttttcgcgagcttgcgccttggcgattaatagcccatgacagccatgcgtcagtctgatgacagcgctcgatgcccgcaaagcgttgtagactggcgcattgccgccctggagaccgcgatgagcccgagcctcacgctacgccattacctcgaagcgcccatcgcccacagccatgatcatgcgcagctggtgttcggtctgtccgggcacctggacctggaagtcgatggccgtggcaaccaggtacgcgaaagcagtgtgatggtgctgcccttctccacccaccacgcctgtggcagccgcgacggtagccgctgcctggtgctggatgtaccgaccgagcattgggtggtgcaatctttgggtgagcatgccgatgccagtcgtcgcttgctggggcaaccgtcgcgactgacgctgaatccgcggcaaagccaactggtgcagtggctggcgcacagcccggtgcacgacccgctgatcgtccagcaaggtgcggtgctgttactggccagtctcaatcagccccaggcccaagcgctgccaggtcgacgcttgccttatgcggcgttcaatgcccatatccagcgccacgctgcgtacccgttgcaggtggctgaccttgcgcgtatcgccgggcttagcgtggcgcgcctgcatgcacgcttcatggccgaatgcgggcagacgccgatggattatctacgcagtcgtcgcctgcatatggcgctggagcttttgcgcggcacaccgttggccatcggtgagattgccgagcgcgttggctatgcctcgcagagcgcattcagtgcagccatgcttcgcgagtttggcgccacccctagcgccctgcgccggggcgactgacaagagccccacgctaaaaaacgcgaggccggcgacagacgcccgcgaaccaaccctctagactgcgaggctgttaccccgttggttcaaggatcacaatgactccccgttcagcccttggcgccctgcatatcggcgcattgatgtttggcctcactggcgtattcggcaagctggcagcggcgtcccctgccatcatcgtatttgggcgtgccgcgtttgccgtgcttgccctggcggtgtttgcccgctttgccagcaacgcgccctggaagaaactggagatgcgcgactggcgccgcttgctggtcagcggtgtgctgctggccgcccattgggtgacgttcttcattgccgtcaaagtcgccggcgtggccgtggcaaccctggggttcacggccttcccggcctttaccgtgatccttgaagggttgatcttccgcgagcgcattcgtgccaatgaagtgctgttggtggtcctggtcagcgttggcctagtgctggtcaccccggatttcaacctcgccagcgaggccacgggcgggttgctgtgggggatcgcctcggggttgttgttctccttgttgtcgttgaacaatcgcgccagctccgggcgcgttcctgccgtgcaggcagcgctgtgccagaacgtggtggtcgccgcgtgcctgctgccggtggccgctccgggactcgcggacgtgcgcgccattgactggttgtggatcgggctgctgggcgtgttttgtactggccttgcccatagcctgtttgtcgccagcctcgccgtgatcaaggcacgcaccgcctcggtggtgtttgccatggaaccggtctacggcatcaccgtagcctggctgttgttcgccgaaacgccgaccttgcgcatgctgctgggcggtgccttgatcatcgtcgccatcgtgctttccggcttgatgggcagcgccagccaggcgaaacagccgacggcaacggcctgatctatacttcaagcgtccgcaacagtctgtagtcgttcaacggataaagactcctcgacgacagccatggtgttttctgaagttgctgcaagcgagtggtcatccctcaatgcgatgcaggagcttcatcatggaaatgctcatcagcttgctggtccagatcatcagcggtgccgtcggcggcaacatcgccggcatgaccaggcagagcctggggacagggctcaatacctttctcggcggggtcggcggcctggtgctgggccagattgtcgccgcactcaccggcaccacccatggcgaagcgctggatgtggctgcggtcggcagcaatattgtcggcggtggcgtcggtggcttggtgttgacgtgggtggtcggttttatcaagcaaaagcttgccgccaagtagcgatagggtcaccgcccctctgtggcggtgaccttcattgcgtacgatcgttatggcccaggtcgcgctgcgggtcgatctggtcacgcacccgctgtttaagcaccttggcttcgggaaagccgccgtcggccttgcgctcccaaatctgcaccccatcgcaggtgatgcgaaaggtgccgccggtggccggttccaacgctacgcgacccaggtcatcggcaaatgtactgagcagctcctgggccagccaggcagcgcgcaacagccactggcactgggtgcaataagtgataacgatctcaggtttgcttgcagacataatttaagcggctcctcacatgacgggcccggcgaatcgggtggctataatagcggcctttatcgcccagcctcgagattgatgatgcgccgcctgttgtcctgcctgctcctgtgccttgtccccctgcttgccgacgccttggaaacatcacgccccaaaatcggcctggtgctgtccggcggtgccgcccgcggcctggcgcatatcggcgtgctcaaggcccttgaggaacagggtatccatatcgacgcgattgccggcaccagcatgggcgcggtgatcggtgggctgtacgcgtcgggctacaagatcgatgaactggagaagctagcgctaggtatcgactggcagcaggccctgtcggacgccccaccgcgggaagacgtaccgtttcgacgcaaacaggacgaccgggatttcctggtcaagcagaaactcagtttccgcgacgacggcagcctcggcctgccgctgggcgtgatccagggccagaacctggcgctgctgctggaaagcatgtttgcccatagcagcaacacccgtaacttcgacaagctgccgatcccgttccgcgccgtggccaccgacatcaccaccggcgaaaaagtcgtgttcagcaagggccacctgccccaggtaatacgtgccagcatgtcgatccctgccgtgttcgccccggtggagctcgacgggcgcctgctggtggacggcggcatgaccgacaatattccgttggatgtggcgcgggagatgggcgtcgacatcgccatcgtggtcgatatcggcaccccgctgcgctcgcgcaagcaactggccaccgtggtggacgtgctcaaccagtccatcaccctgatgacccggcgcaattccgaagaacaactcaaggccctgaaccccaaggatgtgctgatccagccgcccctggccgcctatggcgtgacggacttcggccgcgccaaggacatgatcgacgccggctaccgcgccacccgcgcccttgatgtacgcctggcgcacctgcgccccgccgagcccatcgaccctgaactggtagctgcgcgcacgccgggcgagcgcaccccggtgatcaccgcgatacaggtggaaaacgactccaaagtcagtgacgacgtgatccgctactacatccgccaggggctgggcgagccactgaacctgggccgcctgcaatcggacatgggcaccttgtacggcctggattacttcgagcaggtgcaataccgcgtggtgaaaaaaggccaggacaataccctggtgatcagtgcgcgcggcaaacgcagcggcaccgattacctgcgcctgggcttgaacctgtcggatgatatgcgcggcgacagcgccttcaacctcggcgccagctatcgcgtcaacggtatcaaccgcctcggcgccgaatggctgacgcgggtgcagatcggtgatcggcaagagctgtacagcgagttctaccagccgatggacaccggctcgcgttactttgtcgcgccgtatatcagagccgaggcgcagaacgtagaactggtcctggacaatgaccccatttccgaatatcgcctggaacgctacggtttcggcttgaacgtgggccggcagatcggcaacagcggcgagatccgcttcggcgttggcgaagcctggggcaaggccgacgtacgtattggcgaccgcgacctgccgagcgtgagcttcagcgaaggcttctatgaacttaaatattcattcgactcctttgacaacgtgtacttcccccatagcggcgaggacatcggcctggcctatcgtgaattcgaaccggggctgggctcggaccagcgttaccgccaatgggagttcaagctggacaaggccatgagccatggcccggacacgttgatactgggcggtcgttacggacgtacgctggatgattccgatgtggtgatttccagcttccagctgggtggagcgcggcaattgtcgggctttcgccaggatgcgatctctgggcagaacgtcagcctgatgcgtgcggtgtacttccgccgactgaccccgcgttcgtacctgccgctggacttcccgttgtacctgggcgcctcactggaacggggccgggcgtggaataacgataatgagttcgacagcggctatatcaacgccgcgagtatcttcctcgggtttgatacgcctctgggaccgctgaatttcagctatgggttcaatgatgataaccagaaggcggtgtacctgaacctcggccagaccttctgacacaacaccgaactaatgtgggaggggcttgctcccgatggcggggtatcagtcaacaattctgtagctggcccaccgcaatcgggggcaagccccctcccacattttgatccccagtgaatgggcgatcaggacttttccaggttcgccaggatgtgctcatgcacacgcatgcacacgcgcagatcctcttcattcaccccaacgaacaactcatgacgcaacgccgtggcaatggtctcgatctggtcgatcagcggctgggcggtatcacacagcaggatgcgtttggcgcggcggtcttccaccacggcctgacgttgcaccaggccctggccttccaggctgtcgagcagacgcgccagggtcggcccttccacgccaacactttgtgccaattcacgctgggtaggggcttgtgcaaaacgggccaaatgcaacagcaccagccatcgcgcctgggacaagcccagccccgccaggcggcggtccagctcggcgcgccaacctcgggacatttgcgccaattgcatgccaaaacggtgttgatcggttaacggcataaaaaactcatgtttaagactgaaaataaagtatggctaattattagtcagctaagcatgagccatgtcagtaggcaaggcccggtatgtactgattcgttacattgtcgtaattggcgcattaaatttcgaattccgactgcaaagcggcacgtacgcagtacaaaacgccctcaggaacacgtccggtgaacaacgaggcgatctccgcgacaggtggcaattcgccttctccatcgagaaatgcatcctgaatttcgccgagcaaatcctcaggcaaatcaagggcctgctccaacgacaattgctgcttgccgatggcttcggcgagcaaggtatacacatttttttccgagcattgcagctgaccggcgatctggatcggggtcatgccggcgcgggccaggctgatcagttcgtggcgaatatcggccacttccttcggtgcttcggcctggccaccaagcacttcgaggaacgcctggccgtaacgctccagcttgcgcgcacccacaccgctgacccgggccatttcggccatggtggtgggttgttcgcgaagcatttccagcaaggtagagtcggggaagataacgtagggcggcacgctgtgttcctgtgccagtttgcgccgcaaggtgcgcaaggcttcccactgttcgcgctcctcgccccgtacaagctggctggcctggctggtgctgctgctcttggcggtggtctggggcttgaggtcacggcgcagctccaggctcacctcacccttgagcaacggtcggcaactgtcattcaggcgcagcccgccgtaaccctcgatgtcgatatcgacgaggccacgggcaaccatctgccggaacagcgagcgccactcgccttcggcgcgggccttgccaacgccgtagaccgagagtttctcgtggccgaagctgcggattttttcgttgtccttgcccagcaatacatccaccaggtgacccacgccatagcgctggccggtgcggtagatcgtcgacaatgcctggcgcgccggctcggtggcgtcccaggtctgcacaccgtcgatgcagttatcgcagtggccacagggctcgggcatgtcttcgtcgaaataggccagcagcgtctggcgccggcagcgggtctcttcacacaatgacagcatggcatcgagcttgtgctgctccaggcgcttatggcgttcgtcgccttcggagttctgcagcatctgcttgagcatcaccacgtcttgcaggccgtacaccatccaggcatctgccggcaggccatcacggccggcgcgcccggtttcctggtaataggcctccagggacttgggcaggtccatgtgcgcgacgaatcgcacgttggatttgtcgatgcccatgccgaaggcgatggtcgccaccatgatcaggccctcctcgttgaggaagcgcttctggtgataggcacgcagatcgttcggcaggcctgcgtggtaaggcaacgccggatagccctgttcgcaaaggaatgcggcgacttcgtcgaccttcttgcgcgacaggcaatagacaatgcccgcatcgctacgccgctcggacaggaacgccagcaactgtttgcgcggctgctccttgggcacgatgcggtagaaaatattcggtcggtcaaagctcgacaggaaacgctcggcgttctgcaaatgcaggcgctcgacgatctcttcgcgggtacgtttgtcggcggtggcggtcagggcgatgcgcggcacgtcggggaacagttccgccaactggccaagctgcaggtattcgcggcggaaatcgtgcccccattgcgatacacagtgggcttcgtcaatggcgaacagggcaatgtccaggctctgcaggaaggacagcatgcgcggctgcaccaggcgctcgggtgccagatacaacatcttcacctcgccacgcttgatgcgggcggccaggtcgcgctgctgttcggcgctgagggtggagttcaacgacgcagcggcgacaccgagctcttcaagggtggcgacctgatcgtccatcagcgcaatcagtggtgacaccaccacggccaggccattgcgcaacagtgccggcacctggaagcacaaggatttgccgccaccggtaggcatcagcaccagggcatcgccgccattggccacgcgctcaatgatcgcaccctggcggccacgaaaactgtcgtagccgaagatgtccttgaggacgcgttgagcctgctctagcatgtaaaactccaaaatggtgccgaaatccctctgtacaggctggccgaaaaaatgcgctgccacggtaaataatccgtaagcgaagttttcccggattggcgctgggcctgcaggggcatcacaaaacgcggcagtatacccgagcatcatccgccaaagggcgcgcctgacgaatagacgcccacgctaaaaccgggcaaatgtgcggtgcggctggcctgggcgctcaagaaagcctagaattcagcatcgtttattcccaaggtagcccttcaatgtccttcgctgagcaactaacccgcctgcaagccttcctcgacgccgatgagctgcatgacgaggcgctggactacgtggccgcccacggctacctgaccgccctgtcgatctcttctgacgtggtaccggaccgtgagtggatcgacgccttgttcgccgaagagcctcactacgccgacgccgcccagcgcgaagaaatcgaagccaccctgctggccctcaaggcccacatcggccgccagctggcctccgatgaggaattcgagctgccatgcgacctggacctgggtgaagagccggacgactccgacctgcgcggctggtgcatcggtttcatggaaggcgtgttcctgcgcgaagccgcctggttcgaaaccgccgaggaagaagtcagcgaaatgctgctgccgatcatggtcggttccggcctgttcgacgaccagccggagttcgccgacatcgccgccgacgccaacctgatggacgacatgatcgtacagatcccggaagccctcaccgcgctgtacctgctgtgcaacgcgcctgacgaaaaaccggcgatcctcaagccacgtcaccactgagtcgcttgcccgtggcacccatgggcaaccgctcgctgctcctgcgctacgcgctgctggccattggctggctcagcgtagcgctgggagtgataggcattttcctaccggtgttgccgaccacgcccttcctcctgctcgccgccgcctgcttcgctcgaagctccccgcgtttctaccgctggctggtggagcacccgcgcctgggcccctggatccgtgactacctggacggcaatggcatcccgctcaaaggcaaggtctacgccatcggcttgatgtggttgagcatcgcgatctcctgctatctggtacccctgccctgggcacgcggcttcatgctgaccagtgcggtcctggtgacgatctatatcctgcgtcagaaaaccctgccaccgcgctgacgcacctgcgacattagatcccacacgaccttggtcgacactgactaaccccaggcatcatgcgagactgtccaaccgggcctggagtgcctgggtgttcttatgctcggagttaccatgacgctgtccagcgggctgattgccgccgttgccctggcctatatggccattatgtttgccattgccttttacggtgaccgccgccatgcgccgctgccaccgcgtgtgcgtgcgtgggtctacagtttgtcgctggccgtgtactgcaccagctggactttctttggcgctgtaggccaggccgccgaacagttgtgggcatttttaccgatctacctgggaccggtgctgctgctggtgttggcaccctgggtgctgcagaagatgatcctgatcagcaagcaggaaaacatcacgtcgattgccgactttatcgccgcccgctacggcaaatcccagtccctggcggtggtggtggcgttgatctgcctggtcggcgtgctgccctatatcgcgttgcaactcaaaggcatcgtactgggggtgaacctattgatcggcgccggccccgacaccaccggcacccgggcccaggacacggctttgatcgtgtccctggtgttggcgctgtttaccattgtgtttggtacgcgcaacctcgacgccaccgaacaccatcgcggcatggtgctggcgattgcgtttgagtccctggtcaagctgtttgcttttcttgccgtcggtgcgtttgtcacctacggcttgtacgacggcttcggcgacctgttcagccaggcgatgctcgcgccacgcctggaggaatactggaaagagaccatcaattggccctctatggtggtacagaccggcgtcgccatgatggcgattatctgtctgccacggcaattccatgtgaccgtggttgaaaacatcgacccccaggatctgcgcctggccaaatgggtattcccggcctacttgatcctggctgcactgttcgtggtgcctatcgctctaggtggcaagatgctgctgcctggctcggtgctgccagactcctatgtgatcagcctgccaatggcccaggcccatccagctctcgctgtgctggcgttcattggcggtgcctcggccgccaccggcatggtgatcgtggccagcatcgccttgtcgaccatggtttccaacgacatgctgctgccctggctgttacggcgctccagcgccgagcggccatttgaagtattccgccactggatgctctcggtacgccgggtgagcattgtgattatcctgttgctggcgtatgtgagctaccgcctgcttggttctaccgccagcctggctaccatcggccagatcgcctttgccgccgtgacccaactggccccggcaatgctcggcgcactctactggaagcaggccaaccgccggggcgtctttgccggcttggccgcgggtacattcctgtggttctacaccttggtcctgccagttaccgcgaaaagcctgggttggtcgctcagccttttccccggcctgacctggatgcattcccacccgttcggactgtcggtgacatcgctgaccttaggcaccgtattttccctggcgggtaacttcaccttgttcgtgtgggtgtcaatgctgtcacgcacacgggtgtccgaacactggcaggctgggcgttttatcggccaggaaatcagccagcgtgccaatgcccggtccatgttgtcggtgcagatcagcgacctgctcagcctggcggcacgctttgtcggcgaagaacgtgcccagcagagctttattcgctttgcctatcgccagggcaaaggcttcaaccccaaccagaatgccgataacgattggattgcccacaccgaacgcttgctggcgggtgtactgggtgcctcttcgacgcgagccgtggtgaaagcggcgattgaagggcgggaaatgcagctggaggacgtcgtacgaatcgccgacgaggcctccgaggtgctgcagttcaaccgtgccctgctgcaaggcgccatcgagaacattacccagggcatcagcgtggtggaccagtccctcaaactggtggcctggaaccggcgctacctggagctgttcaactacccggacggcctgatcagcgtcggccggccgattgccgacattattcgctacaacgccgagcgcggcttgtgcgggcctggcgaggcagaagtgcacgtggcgcgccgcctgcattggatgcgccagggccgtgcgcacacatccgagcgcctgtttcccaatggtcgggtgatcgagctgatcggcaacccgatgcccggcggcggctttgtcatgagtttcaccgacatcaccgcgttccgcgaagccgaacaagcgctgaccgaggccaacgagggcctggagcagcgggtcaccgaacgcacccatgaactgtcgcagctcaatgtggccctcaccgacgccaagggcgtggccgagtccgccagccaatcgaagacgcgattcctggcggcggtgagccacgatctgatgcaaccgctgaacgccgcacggctgttctccgccgccctctcccatcagcacgacggcctgtccagcgaggcacggcagttggtgcagcacctggacagctcgttgcgctcggccgaagacctgatcagcgaccttttggatatctcccgcctggaaaacggcaagatcaatccacaacgccagccctttgtactcaatgagctgttcgacaccctgggcgctgagttcaaggcgctggcccatgagcaaggcttgcgcttccgttggcgcggcagccgcttgcgggtagacagcgacatcaagttgctacggcggatcctgcagaactttctgaccaatgccttccgttatgccgacggcccagtgctgcttggcgtacgtcgacgccaaggcgaactgtgcctggaagtctgggatcgcggcccaggcattccgctggataaacaaaaggtgattttcgaagagttcaagcgcctggacagccaccagacccgggctgaaaagggtctgggcctgggcctggcgattgccgacggcttgtgccgtgtgctggggcatcaattgagcgtgcgctcctggccgggcaagggcagcgtcttcagcgtgtgcgtgccgctggcgcgcaaccaggccagcccgcaacccaaggcgccggcggaaaacggcctgcctttgagcggcgcccgggtgctgtgtgtggataacgaggagagcatcctgatcggcatgcgcagcctgctcacgcgctggggctgcgaagtctggaccgcagccaatcaggcccaatgtgcggcactgctggccgacggcatgcgcccgcaactggcactggtggattaccacctggaccatggcgaaaccggcaccgagctgatgggctggctacgggcgcaactggccgagccgattcccggtgtggtgatcagcgccgacgggcgcccggagatggtcgccgaggtgcatggcgcggggttggattacctggccaagccggtgaagccggcggcgttgcgggcactgttgagcaggcacctgcctctgtaaatggcttgtactcggtcaaaatgtgggagggggcttgccccctcccacattttgaccctgtgtttattcggggagatgcgctacgccatccgaatctgtcatcgcccgttccagcagatccgccggcaggctcttactggcacgggcaccgagcagccttagttgctcggtacgactgaccagattcccgcgtccatctgtcagtttgtttcgcgccgcgctgtaagccttgtccaactgctgcaaccgattgcccacctcgtccaggtcctggataaacagcacgaacttgtcgtacagccacccggcacgctcggcgatttcccgggcgttctggctctggcgctcctgcttccacaggctgtcgatcacccgcagggtggcgagcaaggtggtcgggctgacaatcacgatatggcggtcaaaggcctcctggaacaggttgggctcggcctgcaatgccgcggaaaaagccgcttcgatcggcacgaacagcaggacgaagtccaggctgtgcaaaccttcgaggcgcttgtaatccttgccggccaagcctttgacgtgattgcgcagagacagcacgtgctgcttgagcgccgcctggccaattacctcatcatccgccgcgacgtattgctgataggcggtcaagctgaccttggagtcgaccaccacctgcttgtcgcccggcaacatgatcagtacgtccggctggaaacgctcgccatccgggcctttgaggctgacctgggtctggtattcacggcctttctccaggcccgcgtgctccagcacccgctcaaggatcagctcgccccagttgccctgggttttctggcccttgagggcccgggtcaggttggtggcttcatccgacaggcgcaagttcagttgctgcaagcgctcaagctccttggccagggaaaaaacgctcgcgggcttcgttctggtagctttcttcgactcgcttctcgaacgactggatgcgctccttgagcggatcgagcagttggcccaggcgttcctggctggtttcggcaaagcgctgctcacgctcatcgaagattttgccggccagctcggcgaactgcgcacgcagctcatcccgtgagccttgcaggtcagtgaggcgttgttgatggctctcttgttgctcgcgcagctccgcgctcagggccgccgccagggcgtcgagacgccgcagctcggtttccttggcactgcggtcgaggttccaggcgtgggcggcgtcgcgggcgttatcgcggtcgatctgcagcagctcgacttcgcggcgcagggcagccaggtcggcctgtttggcggcattagcgtggctcaggtcactgatctcatcgcggctggcgtccaattgggcagcgagcccctcctgggccagttgcgcggtcgccaggcgctcttccagcagttcccagccggtggcccgcgcgctcagacgtcgctggagttgccagcacagcgccaacaaaggtactgctgcgccaacaagtcccaaggcgatactggtccagtcaacaaccatagccatttctgccatcaccgaaaaaaaacaagggtaaccaagcgcagggctggaggacagctcagtcttcgacctgccccagttcgcgctgggcgcgccggtcgccggcgcgggcggccgagcgcagcaggtcgtagcctatacggcggtcgcgggcgttcccgcattcccgacacatcagttggcccagacggctctgcgcggccaccaccccttcccgggctggctgtttgagcaagcgtccagcgaagtgtttgatgttggtactttgccccaggcgagggctatcgagcagccacaaagcgaccttcaaggagaaacgcttgggggcggtaacagtttgacgagtgtcggtaacagaaggtgatactgagcgaaacttcataaagcactgcgggacagaacagaaggcgcgccactctactctttttttcgtacaggtaaagctgaaaaaacccggcacgcccgttctagagcaagcgctcgggacaatccacagaagctgtggataactcagtggacaaccccccttgaacgggcgcaaaggcccacggaacgggggccgcagtcaaactgacgattttttcaccaataaaaaaaagcgagatttttcattgacttaaattttgaatgcaagcaaatgcgcgccgttcaaggtcaggaacagaggggttacacacgtcgcaaccaatgtgcacaagtacccgcgtgggggttataaggtcagcgttttttgattcaacatgccttaaacatgttactgcccggacaaacccaggtactttccaaatgtgtcgcgtctcgccacactgccccaccgacaacgcaaccctgtagggccgatgaaaggaattctgttattcgccgtgctgctattggccatctgcgcgacctccctgggcatcaatgccgtgctaccttccccggacggcgcgctgttcgccagcgcgatcctgttggcggcggctttcaccgcagtgagcctgtgcattgaattgggtgacggcaggatcaatgacatgcgcgaggtcatgggcgtgatcgagagcgggcagtccttgcgcctgacgcttgcggcctacggcttgggttgcgctctggcagcctcgataacggtactggtctaccgcgggtggctcggcggttgattgaagtttttttgccattgcccttcccttccccgtttcgatccgttactatccgccgcgttagtaccaagctgaaagtcaattctggtcgaacaaatcccctgaacacatgggatcgaccacctcgatggtttccaggtattccttgcgacgacacagcctttgaacaagcaaagggtgtcgcgaagtttcaatactctgaccgaaccaacctgcaaattgatcaggatcttcaccctgggcccagaacctttgcccctgttgtgttgcctgccctcctaagtacctacctgccagcccaagcgcgcctaatttatcagcgcttcaaactggctgctttgttccagtcaggttcttcgcttgatcaatggtgatcagcgttactggaacgttttaacgttgcacggctcttatccgtgtcatttgtaggaacaccaataatatgaacgctcaaatccacactcaggatgccattcgcaccctcactaacgcttttgccccaatgaactgcctgatcatggccgctcgcaaaggctgcttcagcttcaccctggtcaacgaacacggcatcgcacgtcacagcgaacgcctgtaccccgatcaatactccagcgcagagccgctgcaggccgtgatcgagcgtacccgtcaggcattgactgcctgatcgacccgagtcgctgaaatacaaaaaccctgtctgaaaaacagggttttttattgcctggaatatggtcgccaagcccttgaattaagtacaaatagatataaacgttataaccgaatgaagaagatgttttaaaaacagtcctttacatcataaatatgacactacacttcaactcgagcggcatgatccgcttgcgacgggcctgagatccgattcaccgctgccaagccctcccttctcaggctcgtccacccctatattggactgaggcttgtatgggtattgccgccagcgaattgtgtcgttatgtgatcaggccgacgttgatgtacctcggccgccatgacgctgcagccgaatccctgctactgggcattgctgccagccaatcggaactgggttcggccttgcatgatcgacgcggccatggcctctacagcatcaccgaaccgcgccaccgtgcgctctgggatgactacctggcgctggaccccgatcgggcgagcctggtccgcgggctggccagccaacatgccttcctcagtgcacctcagttggaactgactgtaaacctgcgctacgccacggccatcgcttggctgttggtggaacagcgtcgctacaccctgcctgcgcccggcgatgtgctggccatggcgcgtatctggaaagaaattttccatccacaaggtcgtctgcgggatttcactcaagcgtggcaaacctgcgcctgccccataaaacaggcggcgtgttgaccgggcaaaatgcaagattcgccaaaaaacctgaattctggtctgattgtcctacaaaaccgctctatctcctgtattacagcctatagcgcgatgcgaaatttattgatactttccgcagcggtgatcaccacggagttctaataatgaaaaaagtaatgctcaagaccacacttagcctcgccgttgccatggcatcctcccaactgttcgccagcggctttgccctgaacgagcagagcgtcagcgggatgggtaccggtttcgcaggtcgctcgtcctctgccgatgatgcaagcactgtgttcggtaaccctgccggtatggcacgtctggaaggtcaacagatcaccggcggtgttgctgccattgatgcctccactgatatcagcgacgtcagcggccgctcccgcggtagcaacaaaggcgacatggtgcctttcactgccgtccctttcggtttctacaccaataaactcaatgatcagtgggctgtcggcttcggcgtctatgcaccgttcgggctggtgactgactacgaaagcggcttccagggccgtggctttggcagcaagagtgaagtgaaagtcatcaccttccagccaacggtcagctacgccttcaacgaccgtgtttccgttggttttggcccgaccatcaaccgcatcgccggcaccctggaatcagacctgacgctgaatgctcgtgcgccagacaccaacatcaagatcaagggcgacgacaccgcgctgggcttcaatattggcgtgctggtacaagcaaccgatactacccgcgttggcctgacctatcactccaaggtcagctacaagctggacggccacactgaagtcactgcccctgcagcgaccgctgcagccctgcgcagcaatcgctacgatgcatcgctgaagattgatacacctgagtcctatgacctgtcggtcacccaagacctgaccgacgcctggaaactctatgcgggtgcaacgtggacacgctggagccgcttgaaagacatcaccgtcaagaacgacggcgtgagcggcgcaacgggtggtgcgctcgctcctgccctggtgggcactatcaaggaagaccagaactggcacgatacctgggcctacgccgtgggtacctcgtaccagctcaccaagcaagtggtgttgcgtaccggcctgacctttgaccaatcgccaaccaacaacacggatcgctcgccacgcatcccgactggcgaccgcacgatcttcagcctgggcctgggctacgaggtcatgccgaacatgaccgtcgacctggcctactcctacctgaaggaagaagacgtcaaggtttcgcgctccaacgcattggccagctacaacgccaagtatgaaaacagtgccaacggtttcggcctgggtatgacctaccgcttctgattcgcagcggtataaaaaagccccgctctcctgcacaggaggcggggcttttcattggtcgcggctcagggtttggacgccaatgcctcttccaccgccttgatcaggtccgggctgtccggcttggtcacactggaaaagttggcaattaccttgccctggcggtccaccacgtatttatagaaattccacttcggcgcactgctctgctgcgccagcagcttgaacaggtgcactgcatccggccccctgactttctgcggctcggtcatggtgaaggtcacgccgtagttcacgtagcagaccttggcagtctcctccccggtcttggcttcctgcttgaagtcatcggaaggcacgccaattacttccagaccttggtccttgtagcgctggtataacgcctcgaggcctttgaattgcggtgcaaacccacaaaagctcgcggtattgacgatcaccaggggcttgccggcgaagcgctggcacaggtcaatggattccttggcccgcagcttgggcagttggccctccaagagcggcgggcagtcggcagccatggccaagctgccaacagccatgaggacgggtacagcgagccagcgcatcagcatgatcaaagtccttgagtcagttcaggcattgaacttaacagatcgccatgcccagttgcatcaacgccagaccgccctgttgccaaccccaccaggccagcagcaacaggaccaaccccgccgccatggccataacgcgcaccgctagcctcatgccgcctccatctgcgcctgcatacgcgccaccgggcgctcacgcaccggccagttcagggccgcagcgagcaggctgagcagaatcgccacctgccagatcaaatcgtagctgccggtccgatcatagaccaccccgcccagccaaccaccgaggaatgagccgagttggtggaacaggaacacgatcccaccgagcattgagaggttgcgtacaccaaacaaggtcgcgacggtgccgttggtcagggggacggtggacaaccacaggaaccccatcgccataccaaacagatacgcggtgacttcagtgaccggcgcccacaggaacaatacgattaccacggcccgcaacaggtacaaaccggtgagcaggcgcggcttggacatgcgcccgcccagccacccggccgtgtaagtgccgaacacattgaacaggccgatcaaggccagcaccgtcgtgcccaccgtggccggcaggtgctggtcgaccaggtatgccggcaaatgcacaccgataaataccacttggaaaccacagacaaaaaaaccgaaggacaacagccagaaccctgagtgagagcaggcttccttgagagcttcgcccagggtttgctgaccgaccgtggccggcagcggccgatccttgagcatcgcgaccagcggcaggatcaacgccaccatcaagcccaacgccagcagtgccgcagaccagcccaaccaaccaatcaagccgagggtgccggggaccatggcgaactggccgaaggagccggcggcgctggcgatgcccatggccatgctgcgtttttccggggctacggcgcggccgaccacaccaagaatcaccgagaacgaagtaccggacaggccaataccaatcagcaagcctgcgctcagggacagcgaccacgcagagtcggacatgcccatcagcaccaggcccacggcatacaacacgccgccgacaaacactgccttggtcgcgccgaaccggtctgccaaggccccggtaaacggttgggccaggccccagatcaggttctgcaaggcaatggcgaaggcaaaggtctcacgcccccagccaaattcgctgctcatgggcgacaggaacaagccgaagccatgccgtacgcccagggagagcgccaggatcagcgcactccccacaaggatccaaccgctggtgcgccacatcgaggtcatttcttattctccgctcgcgggtatatacccgcttatagtcgaacaaaccgcgcgtcaggcgagttcgtccagcaaggccaacaacgtttcgcgcttttcggcgcccaacttatcaatcagtttctgttgcgccgcttcccaggccggcaaggccgcggccagtcgctcctgccccgtttcggtcaacaccaccaggcggttgcgcagatcgtcaccctcgaccaactgcaccagcccttcgccttccaacacgcgcagattacgccccaaggtgctacggtccaggcccatggcctcggccaggctggaaatgctcggttggtcaaggcgctgcaagttacacagcagagaatactgggcaacgttgatcccgaagccgtcgagagcgccgtcgtagtgcctgctgacgccacgggcggcgcgtcgcaggttggtgcataaacattgggaggcaagcatggagcgtgtatatacccggagttaaggaaatgcaagaaagggttacagggccagcccgaccagtacagcgacttcgagcaactccaagagcgcgccagccgtatcgcccgtggtaccacccagacgcttgaccatcaagtgacgcagccacacgaagcacagcgccgccagcaacaccgcgatgccgccgttgaaaccaccaatcaggacgcacgccaggccgctgagaatcagcacctgttggccgacaatccgcggtaaatgatcggacaatgcctggcccaatcctcctgcacgtacgtagcgcgtggtgagaaacagcgccaacatcgaagcccgcccgatcagcggcgccaggatcaaggccacgccattgtgctgttcgatcagggccaccaacgcgctgaacttgagtagcaacaccaggcccagggtgaccaccgcaatcggcccgctgcgcgggtctttcatgatgctgagggtgcgctcgcggtcaccaaagccacccaaccatgcatcggcgctgtccgccaggccatccagatgcaggccgccactgagcagcacccaggccaccaatagtagtgcggcatgcaacaacaagggcgcgcccatcaacatcaggttcaggccccatagcaacacgccgaacagcagccccaccagcggataaaacagcaacgagcggcccagctcttgggcctgtggcatgcccggcaagcggatcggcaggctactgagaaattgcagggcgatccaaaatggcagcatcgtcaggctccttccttcaagacactgtcggcgccaacctgcaggctgaacaaagcgccgtggccgacttcgacattaagcaattgctcacggggcaaaccgcgtgcgcgggccaacagcaggcgcatcacgccgccgtggctgatcagtagcacgcgctggccagcataagcccgatgcagtcgtgagacagcgccgagcacccgctcggaaaactcactgaccggctcgccttgcggcggcgtgaacgcgtagggatcagcccagaacaagcccagcccttcggcgtcggtttccatcagtgcggctgcgctctgtccttcccaggcgccgaaatggagttcttgcacagccggctcaagactcaccggcaggtcgagctgtgcccccaactcctgggcaaacaaggcacagcgttgcagcggtgaactgatcagacgatcccacggcccctgccccaccacggcggcacgcatctgcgcccagcccgtggcagtcaatgcatcgtccaggctgccacgcaagccgccacccaactcggtttcgccgtgacgcagcaggtccaggtgcaaggtcatgcggggcgatccgccacggccgcttcggcaaacgttgccatctgcccatgcagtgcacacgccaggcgcaacaacggcaccgccagcgccgcgccactgccctcgcccaggcgcaggcccagctccagcaaaggttgggcatccaggctgtgcagcacatggcgatggcccggctcggcgccccgatggccgaacaacagccattggcggcacgccgggctcaagcgcaccgccaccagtgcggcaacgctgcagataaagccatccaccagcaccgcaataccttcttgggcacaggccagataagcgccgaccagcgccgcgatttcaaagccgccgaggttgaacagcgtttgcaacgcatcaccacgctgaacggcatgcaacgccaatgcccgctcgatgaccgcaatcttgtggctgacacccgcggcattcaaacccgtgcccgggcctgtcaggtcactcaccgggcaatccagcaaggcacaggccaaggcgctggccgcagtagtattgccgatgcccatctcgccgccgataaacaactgcgcgccgctgtccagggcgcggctcacgctgtctcgtccggcttgcagggccagttgcccctgggcctgagtcatcgccgggccttcgacaaaattggccgtgcccgcgccgatattcaggtgacgcacgccgggcaaatccagcgacggcgtgacggtgccgaggtcgaccacttccaactgcgcacccagctgccgcgccaacacgctgatcgccgcaccaccggtgacaaagttatgcagcatctgcccagtcacctcctgaggaaatgccgacacgccttcggcaaccacgccatgatcgccggcaaaaatcgcgatccacagtcgatctaccgacggtttgacctggccttgcaagcccgccaactgcaccgccagcgcttccaactgcccgagggaaccagccggcttggtcaactgctgctggcgtgccagcgcctgttcgtgggcagcggcatcaatggccttgcagggcttgagccaccaggaatccgtcataacgcagtacctttcaaagtcaggggcagaccggcgaccgtcaacacaacacgctgacaccgctcggccaaagcttgatgcagccaaccggcttcatccacataacggcgagtcaattcgcccagcggcacgacacccagaccggtctcgttgctgacaaaaataatttcccccggcagcgacgccagggtttgcagcagttgatcacgctcgaacgccagccgatcggcgtcttcgagcatcagaagattggtgagccataacgtcaggcagtccaccaacaggcaatggtcggcagcggcgtattcacccagtacccgcgccagctcaaggggttcttcaatcaacccccaatggtctggacgacgcccacgatgcagggcaatccgctgattcatttcaccgtccagaggctggctggtggcgatgtaagtaaccggcaaaccgctatcgctggcgagcttttcagcgagacgactcttgcccgagcgtgcgccgcccaagatcagttggagcatggaattggccctgtaaaggtcatagatggagcggcaagccagaatgaacgcggcgctctcaggtctttcgcgggcaagcccgctcctacagaaaagcaaaagcccgccgccaaccgtaaccacgatgcgcagcgagccgctcttgatgttgcttttgatcttaggcgccccgttaaaccacgctggccgaacgcaggcttgaagccgtgggtaacccggcaggacgccgggttagccgtcctgggccagggatggcccatgacggcggcccacggattcaagccggagtgagggcacaccgagccaaggcgaggtgccgagtggtggggcaagagcgttttggttacttttgcgctgttcaaaagtgacccgctgtaagagcggaaccataggtggccgttaccgcagcaatggatatgtacaccgacaggccgccatcgggagcaagccccctcccacattcgaacaccgtcaaatcccgcataggttgcgcaacaaaccggtgtccaagtgctgctctaccaagtccgcgagccgctcgatatcacgctcacgcaacccgtgataatccacctcctgcacatcctgcaacccagcccaacgcaacaacgcactgcacgccgccggcgcctcgaacagcccatgcagataggtaccaagaatctgcccatcagcactcagcgccccatcgctgcgcccatcgtccagcagcacggccgcgctcaatagggcctcacccgacgtcacccccgcatgaatctcatacccactgacctccgcatcctcgagcaccaagcgcccgcgcacattacgcagctgcttctccacctccagcgtcgtagtaaacgccagcagcccaagaccagcactcgacccggccacaccctccagcccaagcgggtcatgcacctgctcacccagcatctgcaacccaccgcaaatccccagcaccttgccgccatagcgcaaatgccgcgccacggccgtatcccaaccattggcacgcaagaacgccaaatcgctgcgcacgcttttcgaccccggcagaatgatcaagtcagccgcaggaatcgcctggcccggcccgacaaactgcaaatccacctgggggtgcaggcgcaacgggtcgaaatccgtatggttgctgatacgcggcaacaccggcaccaccaccttgagcacctgggcggccttgtcgacctggcgctgatcgataccgtcttcggcctccagatgcaggtccatcacatagggcaacacccccaccaccggcttgccggtgcgcgtctgcagccaatccagcccaggctgcagcagcgcgatatcaccgcgaaaacggttgatgatgaaacccttgacccgcgcctgttcactgggcgaaagcagctccagcgtgccgaccagatgggcgaacacgccgccgcgattgatgtcggcgatcaacagcaccgggcaatccactgcttcggcaaagcccatgttggcaatgtcgttggcacgcaggttgatctcggccggggagcccgcgccctcgaccatcaccaccgggtaggcttggctcaaacgcgcgtgggaagccagcaccgcttgcatcgcgatagccttgtagtcgtgataggccacggcattcatgctggtcacggcgcggccatggatgatcacttgggaaccggtatcgctgttgggcttgagcaacaccgggttcatatcggtgtggggcgccaggttggcggcctgggcctggaccgcctgggcacggccgatttcgccgccttcggcggtgacggcgctgttgagcgccatgttctgcggcttgaacggtaccaccgccacgccctggcgcaccagccagcgacacagcgcagtcaccagggtgctcttgccggcatcggaggtggtgccctgcaccatcaaggtactcatgtggcgtccttgtaggcggccagggcctggtcgagtcgcagccaatcggcgtcggtatcgggcaggccgaaacgcacgctgctgtcatgcacaaacaggcgcagcaggatgccgcgctgggccatgaactcgtgcaggcgctcggcgtgcggcgtaatcaaccactggaacaacgcgcaaccgccgtggggctcaaagccccggctttcaagcagttcgaacaagcgctggccggcgtcgatgcagcgcttgcgctggcgggtgtgcccggcggtatcgcgcaggcacacttggcccagcacccgtgtcggcccgctgacggcccagggcccgacctgttcggcgagcaacttgagcaacttgcgttcggccagcacaaagcccaggcgcacaccggccaggccgaagaacttgccgaatgaacgcagcacgatcaaaccgacctcatgggtatggctggccaggctcaactctggggtaacgtccatgaaggcctcgtccactatcagccagccaccgcgctgggccagccgtgcatgccagtccagcaggcgctgcggtggcaggctcaggcccgtgggattgttggggttgaccactaccagcacgtcgaggccgtcaagatagaaatcgacctcctgctcctgcacttcgcgcaccacgtagccggcgcgacgccaggcttcggcgtgctcggcataacagggcgaaagcacgccgaccttgccggaacgccgcaggcgcggcagcaactggatcgcggcctgggagcccggcaccggcaacaactgggcggtaccgtaatagtcgctggcggcctgctccaggccgtcgtcgctttccggcaggcgcgcccaggcacgcaacgggatctcggggatcggccacggccaaggcgccaggccactggacaggtcgagccaatccgcctcggcaatcccatactcaatcgcggcctttcgcagccgaccaccgtgttcaagcatagatgtgtgcccctatgcacaggaccaacaaccacaaccatacgccgcgttgcaccagttgccagccgcgatcaatggaatcggcatcggccggtagaccttcacccaacggcgggcgctgatgtacctcgccgtgataaatcgccgcaccgcccagctcgacccccagtgcaccggcaccggcggccatcaccggcccggcgttggggctgtcccaggtcgggccctggacgcgccagcatttgagggccaagcgggttttgcccaataacgcgtaggtcaaagccaccaggcgcgcaggaatatagttgagcacatcgtctatcttggcggccgcccatccaaagcgttcgaagcgttcgttgcgatagccccacatggcatccagggtgttgctcaggcgatagagcaccacccctggcacaccggccaccacgaaccagaacagcgcggcgaatatcgcgtcgctgccattttccagcaccgactcagtggcggcgcgggcgacttcagtgcggtccagtttgctggtctggcggctgaccaggtagctcacgcgtttgcgcgcctcgtccaggtcatccctgcgcagagcctgggccaccggggccacatgctcgcccaggctgcgcatgccaagggcgcagtacaacgccaggatttccacgagccagccaatcaacggcgcccaggacaaagccgtggccagcagggtcagcggcaccaccgcgataaaccacgcggtcacgccatggctgcgccagccgcgtccaccggtattgaaacgctgctcgatacgcccggcgaaattgccgaacgccaccagcggatgccagcgcctgggctcacccagcagcgcatccagcgccaccgcagcgacacacagcaaggccacactcattgactcactccccacttgttttcatacagcatgtcactcagcggtcgcggctcggtccagccttcaagctgcaacatcggtgccggatagaattgcgccaccggtcccaggcataacaccgccaggggcttggcaccgggcggcaagcccagcagctcggccagggcctggggttcgaacagcgagacccagcccatgcccaagccttccacgcgcgccgccagccataggttctggatggcacaggataacgacgccatgtccatttccggcaaggtacggcgcccgaaaatgtggcgctcgcggtcgtccatcagcgcagccaccaacacttcggcacagtcgctgataccttcgaccttgagcttcataaacgcatcggagcgctcgcccaaggcctcggcggtgcgcacgcgctcttcttccaccagttgttgaatctgcccacgcaaaggtcggtcgctgatgcggataaaacgccaaggctgcatcaggccgacgctgggcgcctggtgcgcggcctggagcaggcgctgcagcagttccggggcgacgctgccgccggtgaagtggcgcatgtcgcggcgttcggcgatggcgcggtagacagcgtcgcggtcggccttggggaaggcgttgtcagtcatggcctcatcgggggcaagccccctcccacattggattgggtttcaactcggtcaactgtgggagctggcttgcctgcgatagcggtctcaaggtctggcgcgaacaacgcggcgaccgcgcgcgggttggacgggaaataaaagtgcacgtaggacgcggtcatccgcccttggcgatacaccgcttcggcaccgcgcccaccgttggggctcaggccgcgggcaatcggcgcccattcggtgttggtcagggaatggtggtaggtgtggccacgcaggacaccttccggcagttcgacgctttgcagagccagggctgcaagtttcttttgcatcactgcatcgccctgcagcaggcccaccagttcggcacgagaaccgtgcacatcggtgagcgaatcgagcaggtagagcatgccgccacattcagcaagcagcggtttaccggcggcgtgatgcgcacggatggcctccagcatcgggatgttggccgacagggcctggtggtgcaattccggatacccgccgggcagatacagactgtcagcttccggcagttggcgatcatggatcggtgagaaaaagctcagctcagcgcccatcgcccgtaacaggtcaaggctggcgccgtaggtaaaggcaaaggcttcgtcacgggccacggcgatgcgcacgccggcgagcaacggctcggcctcgatcacggcgggcgcggcaaaggtcacgggcggcggcaaggccacttcacaactgctgcccaaggcctgggcggcggcgtccaggcgcacatcgaggtcatttaattcactggcttgcaccaagcccaggtggcggctgggcagttcgatgccggtctcccgggacaacgcgccgtaccagcgcaagccctcggtgaggctgccttcgagcaactgggcatgacgcaaagtaccgacgcggttggccagcacgccagcaaacggcaggttgggttgataacgtgccaggcccagggccagggcgccaaaggtctgggccatggcggtgccatcgatcacgcccagtaccggcacgccgaagtgccgcgccaggtcggcgctggagggcgtgccgtcgaacaaacccatcacgccttcgatcaggatcaggtcagcctcccctgccgcttcccagagcagacggcgactttcctgctcgcccaccatccacatgtccagttgatacaccggcgcaccgctggcgcgctcgtggatcatagggtcgagaaagtccggcccgcatttgaacacgcgcaccttgcgtcccaggttgcaatgcaaacgtgcgagcgcggcggtgacggtggttttgccctggccggacgccggagcggcgatcaatacggccgggcaatgacggggctgattcaaagttcgacgcctttctgggccttgataccggcctggaaggcgtgcttgagcatgcccatttcggtgacggtgtcggccatttcaatcagttcgggcttggcgccgcggccggtgaccaccacatgctgcatcggcgggcgggcttgcaggtcgctgagtacctggtccaagtccaggtaaccgtgcttgagggcgatgttcagctcgtccagcaccaccaggccgatagaggcgtcttgcaacattgcacgggacacggcccaggccgcctcggcggcagcgatgtcgcgctggcggtcctgggtttcccaagtaaaaccttcgcccatcacatggaagcgcacctgctcgggaaagcgtcggaagaacagctcttcgccggtgctgttgcggcccttgatgaactgcaccacaccgcactgcatgccatggcccatggcgcgggccagcatgccgaaggccgagctgctcttgcctttgccattgccggtcaataccagcaacaggccgcactcattcggcgaattggcgatgcgctcgtcgatcacggctttcttgcgcagcatgcgcgccaagtggcgttcgtcgcggtcgggggaatcggtcatggcagctctccgttggggctggacaaaaaacggcgggcaggaaaaagacaaaacagacagccaagcatcgcccaccgtgatgctgttgaatgttcaaggccggtctccggactcatgagtggcgcgtcttatcgaagcagccgagggcgcgccttcccatatcgcaggcgatacagtggcaaacagcaccgtcttgactcatttaccgttgcgggggcagcgccggaatcgtggcagcactgtgtataaatgcgctcactcaccggcttccctgtttcactctgccgacgcgcacgccacagagcacctggaacaagccgcgaaggttagtgggttgggggtggagcgtcaattaaagctgggcctgtacttgaaccatccgtacaccctgcttctctacccttacaggtatcaaggagaaaaccatgcataaaacccgagtcgccttactgatcatgctcgccggtggcctcgtcgcctgcggtgaaagctctaccttgcaggtctccgacggcaccgggcccgcgcccaagctgccggaaccgaacaagaccctgatccccaccgtcaatatcgccccggccattggctggccggagggcgccaagccaaccgccgctgccggcactcaggttgccgccttcgccgagggcctggatcacccgcgctggctctacgtgctgcccaatggcgacgtgctggtggccgagaccaatgcaccacccaagccggacgattctaaaggcgtgcgtggctgggtattggaaaaagtcatgggccgtgccggtgccggcgtgccgagcccgaaccgcattacgttgctgcgtgatgccgatcacgatggcgtggccgaaacccgcacagtgtttctggagaatctcaattcgccctttggcatgacgctggtcggcaacgacctgtatgtggcggactcggataagttgctgcgcttcccctatcagccgggtgaaaccgcgatcaaagcccagggcactacggtcgtggacttaccgggcgggcctttgaaccaccactggacgaaaaacgtggtggccagcaaggatggcagcaagctgtatgtgagcgtcggctccaacagcaacgtcgccgaaaacggcctggaggcagagcagggccgcgccgcaatctgggaagtcgaccgcgccaccggcaagcagcgcattttcgcctccgggctgcgcaaccctaacggaatggcctgggaaccgcagagtggcaagctgtggacggcagtcaatgaacgcgatgaaatcggcagtgacctggtgcccgactacatcacctcggtcaaggatggcgggttttatggctggcccttcagctattacggccagcatgtggatgtgcgtgtcacaccgcaaaaccctgatctggtcgccaaggctatcgcgccggactatgcggtaggccctcatactgcgtcgctggggctgacattcgccgagggcaacagactgcccgcgcagttcagcaacggtgcgtttatcggccagcatggctcatggaatcgcaagccgcacagtggctacaaggtgattttcgtgccgtttgaagggggccagccaaaaggacagccggtggatgtgctgacggggtttctcaacagcgatgagaaagccatgggccggccggtgggtgtggtgatcgaccagcaaggggatttgctggtggctgatgatgtggggaataaggtttggcgggtttcggcagccaaataacccctcttaaaaacaccacaaaaacaatgtgggagggggcttgctcccgatagcggtgtaacagtcagcacatactcagctgacaggccgctatcgggagcaagccccctcccacatttggatctatgtacgacttaagggttgcgtgccagattcccgggcagcactcgctttgcgctcaggtaggcattttgccaatacgctttggatagcgtatccagcttcaccgtaccgccggtttgcggcgcatgcacaaagcgcccttcgccgacataaatccccgcatggctgacccgtgaaccaccaccggtggcaaagaacagcaggtcaccggtttgcaggttctgctcgctgacgtcctgggcacgcatcacaatcagctcgcgggtggtgcgcggcagggagatcccggcggcatcgcggaatacaaagccaatcaggccgctgcaatcaaagcccgagtccggcgtgttgccgccccaacgataaggcgtgccgaccaggcccagggcgcggaagagcacgtcttcggcagcgggcgagaaattctgggtagcgtagttgaacaccggcttgggcttgaccgctacaggcgcgggcggcggtgggcggctcgcgcaggcgctgagcagggcggcgcaaacaataagaatcaggcgggccgaggtcgacatgtgcagaacaatcctggactggatgcggctttcgctgccgaacgttgaaaaccagaacgcgcaagcaaagctcgcgcgaacggatgacaacaatgttcagggattctagcgcttacacgtcaaacttcaagtatcactttaactttacttactagcggtaaccgtagtcggggccatggcgagtgcgcgcttggcttcgataaaggttttgctccagtagctgtcacccaggttatcgacccggacaccaccactgcggcggctgctggagtgaataaactggttatcgcccaagtagataccggcgtggctgacacgcccacgaccactggtactaaagaaaagcagatcgcccggcttgaggttgttgcgtgcgaccaacggtgcatccacattgatcatctcgcgcgtcgagcgaggcagattcatgccggcttcttcacggaacaggtagccgatgaagccgctgcagtcgaaaccagcttcagaggtaccgccaaagcggtaacgtgtaccgatcagggacttgccgcgttcaagaatgctgtcggccagcaaaggcagctgataaggcttgctgccagagaaatcggccagttccttctcagtagccagctcttcctcataaacagtggaagactgtgcggcgacgaatttttgttgagtctgtggttgtggcttctgctgctctaccacctgctgagggtgggaggcgcaaccaaacaacagggtaacgagtgcgagaggcacgaggggtgcgaagcgatttagcatgggcacgaccgtggctgatgtgtaaagaagccgagactatgccctctatcacatcgatttgcaaattcaatcgcgatctatgtgacttctggtttcgactatgacatctaagccgtaattccatttatcgctgctactgcgtggcctgcttggctcaagcgcaggttttctgacgcctgaaaagtgccgaaccacggcaaatcaatcacttaccaacccaaggtttctttcaggaaagggatcgtcaatttcctttgcgcctgcaacgacgcctggtcgagctgttcgagcaaatcgaacaacgcgctcatgctgcgggtgccacgggtgaggataaagtgcccgacctcgtcggtcaggtgcaggccgcgacgggacgcacgcagttgcagggcacgtaacttgtcctcatcggacaacgggcgcatttggaagatcagcgccagggtaaggcgagacttgaggtcagccagcttcaccggcagctcacgcggtgaagtcgatgcggcgatcagcaggcgccggccgctgtcgcgcaggcggttgaacagatgaaacagcgcttcttcccattccgctttaccggccactgcctgcaagtcatcgagacacaccagctcgtactgctcaagattgtcgaagatgccgatgccgcgatccatcaactcagccaggggcaggtacaccgccggctcccccatctgctcgaaacgcaggcaagcggcctgcaacaggtgggtacgccccacgccatgcttgccccacaggtagatcaggctttcagtccacccggcgtcggcttcgcagagccgctcgacatagccgagtgcagcggcattggcgcctgggtagtagttgataaaggtagcgtcatcacgcagacgcacacctaggggcagctgaatcggtttcatgctgactgaacggctcccatcgaaccgttagtggcctctatgtaaagtttgcaaagtttatacccgtgacgccgggcgcacaatgcagcagaccacaagcaaaatcaaaggtttgcgttaacctggcgaatttacgcggattgtttgacgcacccgccgccataaacgacaaacccggcctgagccgggtttgtgacatcacgattacaaatcaggctcatcaatgcccgtgtacacgtccgaatccttatacaagtcgtgtacgtgccgtaccagcaccatgatcaccgccgccaccggcagcgcgagcaggatgccggtaaagccgaacaactcgccaccggccaggatcgcaaagatcaccgctaccgggtgcaggccaatccgatcacccaccagcagcggcgtcagcaccatgccttccaaggcttggccaaccatgaataccgcgacaatccccagcatcgggtaaaggtcgccgccaaactggaacaagcccgccaccagcgccgcaccgatgccaatcacaaagcccatgtacggcacgatagccgccaggcccgcgatcaggccgatcaacagccccagctccaggccgatcgccatcagaccggcagcgtagataacccccaaggccagcatcaccagcaattggccgcggacaaatgcaccgagcacctcatggcattctcccgccagcgagacgatgcgttcttcacggtcacggggcagcaggctgcggatcttggccatcatgatgtcccagtcccgcagcaggtagaacgccaccaccgggatcagcaccaggttggtcaaccaaccgatcagcgccaggcttgaagcggtcgcctggctgagcaccacgctgacgatgtcggtggtcttgtccatatgttcgctgatggccgccttgaccttgtcgaacttccagaaaccatccgccagcccaaacttggactgcgcccacggcattgccgtgtgctgcaaccagtcgagcatctgcggcgccagttcatagaggcgaaacagctgcttggccaacatcggcaccagtatcagcaccagcgccgtgataatcagcgtgaacagcgcaaacaccgtgaccacaccccaggtgcgcgacataccggctttttccaggcgatccaccacgggatcgaacagatacgcgagcagcagcgccaccagaaacggcgtcaggatcgaatgcagcaagaacacaaaaccgcacagcaggacaatcccgccaagccacacccaacgacgcgtatccgccataaaccactccatctgttatctatctacgccctccttctatatagaaggaggaacatcatttaccaacgaaaacgcagttgcgcctggggctcaggtgcagccgccggttgcgtgccatccaccggcggttgttgaaccggggcttcacctgcggggatttcctgcaacttggcaaggctcaattgagtacgcagctgctcggcgctgccattgacgcgatacacgatgcgattgccgtccactaattgcggttgaccaccaaagggttccagcaagcggcccagtgcggcgtagcgctccaggttcatgccttgcacctcaagcagctgctcgctgctcacccccggcttgaccgcaaagcgcggcgccagcgtttggctgaccgccagcaatacagcatcggccagtgcggcagtgtcagcgccctgggcagtgccctgctcggccttgtcgcccagccacaggcgccatttggcttgccactgattgccttcctggcgcgcgtgcacagcgagcaaagcatcggcgccgtagcgctcggaggctgcgcgcaagggtgtggcgtcggcactttccaggtttggcgcagtggcaaccacctgctcatccagatcgcccagtggcagacgcagcggcaagccacggtgttgcgcggcccggcgcagcgcctgggcaaccgcctggccatcgccgaccaggctgctgccttcggtggaatcgttcagccaccaaccgaggatcgacagccgattgctgccccagatcgacaggcccgcgtcacgcaaggcgcgatcagtgctgaccgggtcgaagtccacttgcaggctttccggtgggcctgcgtcgtagccgtactgactgatgatttgttgcgggtccttgcggatcgccgccagcccagggccgtcagcggccttggcgtcgccggtcaggcggatcaccagggtctgcacggcacgctgggtggcctggtcgcgctcttggggcgactggctgctgacgggctcgagtacttgatagaggccattgagggtttcggcatggctcgccaggctgaccaacgacaagcagcctacaaagaagaatttacacagacgcatggaagattcccgaacgacaaattagcggctggaacagaccgtgtgaaaccggtttagccaggctgtgaccacgccagccagcaaaacattcacaggggcctcgataagttttggtgctgtcataacgattgcggatccaaggctataccttaacagccacccaggcagagccgatcaggattttttcagcggttttctacctatatggccctgcccgtcggcccgaggatggccgctgcccctcaagcctgataaaatcgcgcgccttcgcagaccgtcaacggctgggccttttaccaaaagcgcctgcccgctcggtcgttacccagaaatcccccctaaaggcctggatcatgagcaagcaaccctccctgagctacaaggacgccggtgtagacatcgacgccggtgaagcattggtcgaacgcatcaagagcgtcgccaagcgcactgcgcgccccgaagtcatgggcggcctgggcggttttggcgccctctgcgaaatcccggccggctacaagcagcctgtactggtgtccggcaccgacggcgtgggcaccaagttgcgcctggcgctgaacctgaacaagcacgacagcatcggcatcgacctggttgcaatgtgcgtcaacgacctggtggtgtgcggcgccgagccgttgttcttcctcgactactacgccaccggcaagctcaatgtcgagaccgcgacccaggtcgtgaccggcatcggcgccggctgcgaactgtcgggttgctccctggtcggcggcgaaaccgctgaaatgccaggcatgtacgaaggcgaagactacgacctggccggcttctgcgtcggcgtcgtggaaaaggccgagatcatcgacggctccaaggtggcggccggcgacgccctgctcgccctgccatcgtccggcccgcactccaacggctactcgctgatccgcaagatcatcgaagtgtctggcgccgacatcgagaacatccagctcgacggcaagccactgaccgacctgctgatggccccgacccgcatctacgtcaagccgctgctcaagctgatcaaggacactggcgcagtcaaggccatggcccacatcaccggcggcggcctgctggacaacatcccgcgcgtattgccaaaaggcgcccaggcgattgtcgacgtggccagctggcagcgcccggcggtcttcgattggctgcaggaaaaaggcaacgtcaacgaaaccgagatgcaccgcgtgctgaactgcggcgtgggcatggtcatctgcgtggcgcaagagcacgttgaaaccgcgctgaacgtgttgcgtgaagccggcgagcaaccttgggtcatcggccagatcgccactgctccagaaggcgcagcccaggttgaactgaagaacctcaaggctcactgatgccttcgacctgtgatgtcgtggtgctgctgtccggcaccggcagtaacttgcaggccctgatcgacagcacgcgtaccggcgacagcccggtgcgcatcgctgcggtgatttccaaccgcagcgacgcctacggcctgcaacgcgccagggacgcgggtatcgacacccgctccctggatcacaaggcgttcgatggtcgcgaagccttcgaccgcgccttgatcgaactgattgacgcctttgagccaaaactggtggtgctggccggcttcatgcgcatcctcagcgctgatttcgtgcggcattacgaaggacgcctgctcaatatccacccttccctgctgcccaagtacaaaggcatgcacacccatcagcgcgcccttgacgccggtgacagcgagcatggttgcagcgtgcactttgtcaccgaggaactcgatggcgggcctctggtcgtacaggcagtggttccggtagagtcaggcgactcagcgcagacccttgcgcaacgggttcatacccaggaacacaggatttacccgctggctgttcgctggtttgccgaggggcggttgattctcggtgaccaaggtgcattattggacggtcagttactcgcggccagcggccacttgattcgaacctaggagattttatgcgtcgcgccctgctcttcgcttttgcgctgttcgctttgcctgccgtacaagcggcagaccttcacccgttctccgtcagctacaccgccgactggaaacaactgcccatgagtggttcggctgaacgcagtctggtcaagaatggcgacggcacctggaccttgaacttcaaggcctcgatgatgattgccagcctgaccgaaaccagcgtgatcctgttcgacaaggacactctgcagcccaagagctacagcttcgagcgtggcgggctgggtaaggcgaagaaggtcaacctggatttcgaccagagcgccaagaaagtcaccggctttgaaaacaaagacccggtcaatgtcaccctcgaaagtggcatgctcgacaagtccacctaccagctcgccctgcagcgcgacgtggccgccggcaagaaaagcatgagctaccgtgtggttgaaggcactgataccgacacctacgacttccgcgtgattggcccggaaaaagtccagaccaaggtaggctcgatcgatgcgatcaaggtcgagcgcgtgcgtgacccgtcgcagagcaagcgcattacccagatgtggtttgccaaagaccagggcggcatcctggtagccctgcgtcaggttgagaccgatggcaaggaatacaacatcatgctgcaggatggcactgttgatggccaggccgtcaagggcagctgattgctgatgtgctggaaaagagcctcgctgaatgcggggcttttttttgcctggaaattttgctgtgaagcttctgacgctatcgggggcaagccctctcccatatttgaggctcactggcaggctcgaacatgaaacttttgtcataaaactcatgagcctgcgaccgaatgtcacggtttacgcggcctgcaggattgttgcgtttcctgcaaagaattgttgcgcgcaaaagtcgtttacttagcaagctaacaaaacatataacaaaggcctgcgacgacttgccgcagatcaaccagagattggagcaagcagatgactgtaaaagtaactgaacgcgacgatgcacatatgtcccacgaagcactgggccatgggattcacatctgggatgtacaccaacaagatttgctggtcggcatgtttcacaacgagagcgacgctcataattataaaaacgagcttgaaactcttgaactgcaacgccaggcacaaagctcctgaaaccctgacatccgacagccaccccagccccacgcagctggagtgcctgcaaacaaaaaccccgccttttcgagcggggtttttcatatctaaaggtttaccacatcagatcatccgggatctggtaggcggcgtacggatcatcctcatccggcacctggctttcagtcaggatattgagctgcacgatacgctcaggcgcgcgctcctggatcttcaacgccgcctcccgtgggatcacctcgtagccgccaccgtggtgcacgatagccagggagccgttgctcagcttgttgcgcatcagcgtgttgaccgacaggcgcttgaccttcttgtcatccacgaagttgtagtagtcctcggtggtcagcttgggcaggcgcgaggtctcgatcagttgcttgacctgcgcagtacgggccttggcctcggctttttcctgttgctgacggttcagctcctggtcacgcttgaccttctcggcgtgggcctcggcggccaggcgtgcctgggtgtcgtcgacttcggcctggcccttgtggaccaggcgctgctgcttctgtttctctttgccgacctgcttggcctgcttttgattgaccagacctgctttgagcaactggtcgcgaagggaaaggctcatggtgcttactcacttaggcaactgctcaaccgcagctggacacattcttttcctggcgttttgcttcgccccacagggcgtccaacgcttcgagggtgcaatcttctatgggttggtgcgtatcgcgcaatgcctgttcgataaaacggaaacgtcgctcgaacttggcattggcgccgcgcaacgcagtttccgggtcgaccttgaggtgacgagccaggttgaccgcggcaaacagcagatcaccgacttcatcggcaatggcctgcggatcattatcggccatggcttgcagcacttcggccagctcttcgcgcacgttatccaccaccggcaaggcgtccggccagtcgaaaccgacctggctggcgcgtttttgcaacttggcggcccgggacaacgacggcaaggcggttggcacatcatcgagcagggaaagctgctccggagcgtcggatttttccgcgcgttcctcggccttgatctgctcccagcgttccttgacctgctcttcgctcaattgcgggatatccagcggcgcatacaggtcgccgcttgggaacacgtgaggatggcgccggatcagcttgcgcgtgatgctgtcgatcaccccggcaaattcgaagcgcccttcttcacgcgccaactggctgtaatacaccacctggaacagcaggtcgcccagctcaccttgcagatggtcgaagtcgccgcgttcaatggcgtcagccacctcgtaggcctcttccagggtgtgcggcacgatggtggcgtaggtttgcttgatgtcccacgggcagccgtattgcgggtcccgcaggcggttcatcaggtgcagcaggtcatctagtgaatacatcaatctctttccactgaagatccaatgtgggagggggcttgctcccgatagcggtgtttcagtcaccagatgtatcaactgataggcagctatcgggagcaagccccctcccacacttcaaacggcgttcacccagttactcatggggtgcggttgcgccgcgtctcgatgatgttcggcaactgggaaatcctccccagcaaccgtcccagtgcgtccaaccccggaatctcgatggtcagggacatcaacgccgtgttgtcctctttgttcgaacgggtattgaccgccagcacgttgatccgctcgttaagcaacacttgcgagacgtcccgcagcaaaccggaacggtcgtaggcacgaatgatgatgtccaccgggtaggtgagcaccggcaccgggccccaactgacctggatgatccgctccggctcgcgcccgcccagttgcagcaccgaggcgcaatcctggcggtgaatgctcacgccacggccctgggtgatgtagccgacgatggcgtcgcccggcagcggctggcagcaaccggccatttgcgtcatcaggttgcccacgccttggatctggatatcgccacgcttgcccggcttgtagccggtggccttgcgtgggatgagttccagctgttcgttgccgcgctccggctcgaccagttgctgggccaggttgaccagttgcgccaggcgcaggtcgccggcaccgagggcggcgaacatgtcttcggcgatcttcatgttggctttttcggccagcttgtcgaagtccacctggggcaggcccaggcgcgccagctcgcgttcgagcagggtcttgccggcagcgacgttctggtcgcgtgcctgcagcttgaaccagtggacgattttcgcccgcgcccgagaggtggtgatgtagcccaggttcgggttcagccagtcgcggctcggcgtgccgtgtttgctggtgatgatctcgacctgttcaccggtttgcaggctgtagttgagcggtacgatgcgcccgttgatcttggcgccgcggcagttatggccgatttcggtgtgcacgcggtaggcgaagtccagcggcgtggcgcccttgggcaagtcgatggcatggccgtcaggggtaaagatatagacccggtccggctcgatatccacgcgcagttgatcggccaggccgccgatgtcgccaagttcttcgtgccattccagcacctggcgcagccaggagattttctcttcgtattggttggacccggccttgacgtcggtgcccttgtagcgccagtgcgcgcacacgcccagctcggcctcttcgtgcatggcgtgggtacggatctgcacttccagcaccttgccctcggggccgatcaccgcggtgtgcagcgagcgatagccgttttccttggggttggcgatgtagtcgtcgaattccttggggatatgccgccacagggtgtggacgatacccagcgcggtgtagcaatcgcgcatctctggcaccagcacgcgcacggcacgcacgtcgtagatctggctgaaagccaggcccttgcgctgcattttgcgccagattgaataaatgtgcttggcgcggccgctgatgtcggcatccacgccggtggcctgcaactcggaacgcagctggcccatcacgtcgctgataaagcgttcgcggtccagacgccgctcgtgcagcagcgtggcaatctgtttgtattggtcgggttccaggtagcggaaggacaggtcctccagctcccacttgatatggccgatacccaggcggtgggccagcggtgcatagatatcgaagacttcacgggcaacgcggttgcgcttctcgtcgtcagcagtctttaccgcacggatcgcgcaggtacgctcggccagcttgatcagggcgacgcgcacgtcgtcgaccatcgccaccagcatcttgcgcaggttttccacctggccctgggtgcccagcaccatcgattggcgcgggctgaggctggcactgatggccgccatgcgcagcacgccgtcaatcagcttggccaccaccgcgccgaaacgctggccaacggttgccaacggaatatgcccttcacgcacgccgcgatagagcacggcggcaatcagcgaatcctggtccagcttgagatcggccaggatctcggcgatttccaacccggtgcgaaagcttgaagtgccttcggcccacaggttcttggccgcattgtcttgctgctcagactcacgagcgaactcgcaggctgccttcaaggcttcacggtccagtgccgggtcgacactgacggcatgatccagccatgcctcgagattgatactgccgtcggtgttgatcggctggtgtgctctcacctgtaccatcttgcttaccttccctacgacgcaccttcagtgcgccaatgaatcatcgctgaccttttgcagcaaactccctggcggatcagggccttggagaatgcaggccagtcggattaaacgggcatcctagcccgcttcaaataacgccatggcctcgacatgcgcggtctgcggaaacatgtcgaggatcccggcacgctttagccggtagccttgcttgactaactcaaccgtgtcccgcgccagcgtggccgggttgcaggacacatacaccaggcgcttggcccccagggtggcgagcttgcgcacaacctccagggcaccatcgcggggtgggtccaagagtaccgcagaaaagccctgtttggcccattccgcgtccgtcaaaggctgggacaaatccgcctgataaaactgtgcgttatgcacattgttgcttgcagcgttaagtgcggcgcggtccaccatggtctgcacgccctccaccgccaccacttcgcgtgcttggcgagccaatggcaaggcaaagttgcccaggccgcaaaacagatcgagcacccgttcgtcggactgtggcgccagccattccagggcctgggcaaccatcgcctggttgaccccggcgttgacttgcacgaagtctccaggccggtaagccaattccagatcccaggcgtcaagtcggaaacccagggcccggccgggttcgacgggctccggttgcccctcgccatgcagccacaattgggcatcatggaaggtgcagaattctttcaggatcagcaggtctgcttccgataacggcgccatatgccgtagcaatacggcgatcgacgaaccgctgaacagctccacatgccccagcgcctgcggcttgctcaaacgacgcagcatgttcggcagacgctgcatgatcggttgcaaagcctgtaccagcaccgggcactgatcgatggcgacgatgtcttggctggccacggcgcgaaaacccacttcgagttgctttgccttggcgtcccaacgcaccgccacacgggcgcgacgccgataaccgaactcaggcccgctcaatggcggcgcccattcttgcggttcgacaccggccacccgcgacagttgctctgcgagcatgcgctgtttcagggcaagctgctcatcgtgcggcaggtgctgcacgctgcagccaccacaacgaccaacatggatgcaaggtgcagggcgacgcagttcgctggccttgaacacccgctcggtgcgggcttcgaccactttgccgtgggtgcccaacacccgcgcttcaacttcttcgccggccagcgcaccattcacgaaccaggtacggccttcaaggaacacaatgccccggccatcgttggccaggcgctcgatggtcaagcgctgcttcttgcctacgggaatctgtggggcccggctgccgcccgtcggctggaagcgcaggcctctctcgtgcttggccatcagttgggttcgtcgaaaatgccggtcgacaggtagcggtcgcctcggtcacagatgatcgcgacgatcaccgcgttttccacctctttggacaagcgcaacataccggccacggcgccaccggaggacacgccacagaagatgccctcttcacgggccaggcggcgtgtggtgtcttcggcttcacgctgggccatgtcgatgatgcggtccacccgcgtggcgttgtagatcttcggcaagtactcttcgggccagcggcggatgcccgggatggccgcaccttccatcggttgcaggccaacgatctggatcgccgggttctgctccttgaggtagcgcgagttgcccatgatggtaccggtggtgcccatggagctgacgaagtgagtgatggtgccctgggtctggcgccagatttccggaccggtgctggtgtagtgcgcctcggggttatcaccgttggcgaactggtccagcactacgccacggccttcggcggccatgcgctcggcgaggtcacgggcgccttccatgccctcttcctggctcaccagaataagctgggcaccgtacgcggtcatcgctgccttgcgctcggcactgccgttgtcgggcatgatcagcaccatcttgtagcccttgatcgcggcggccatggccagggcgatcccggtgttaccggaggtggcttcaatcagggtgtcgccgggcttgatctgcccacgcagctcggcgcgggcgatcatcgacagcgccgggcggtccttgaccgagccggccgggttgttgccttcgagcttgagcaacagggtattgctggtttcacccgccatgcgttgcaagcggaccaggggcgtgttgccgacgcaatcggcgattgttgggtactgcaaggtcatggcgtattcgcaatccagactgcgggggcgaacatcataccgggaaaggccggcgggccatatcacgcaaagtgtggtgcttatggcttataggaataagcgaataaagtggcgactgttcggacgccatcgggagcaagtcgataaacctgctactcctgtcgtccgccgccatgatttctccgaaaaacctcctcccccatcgccgcaatctgcccttcaatcaatgcttcaaagggtttgagcagcggctcgaacgataccggcacttccagtacctgcagcgcttgcacgatcgcttcgagggtcgacaaggctccaggctccggcgccttgcgcaagcgataccgggagacgccgccgttggccaatgtcacccggggcaacgccgccagcaacgggttgagatgcagcagtttgcgcgccttgcgccaggtgccatcgggcaccaccagcaacagcggctggtcatcgggcgcataggcttgcaacggctgggcatcatcggcaggaaacaacagccgcacctgatacccaggcgcgctcaataacgtcgccaggtcatcaaacacctcgcccaccagcaactgcgcattattcaagcccaacgccgccaaccgtgcggtattgagcgcatggttgacctcgctcggatgctgcaacagcaacacgcgggtacggctgtcgaggtgggggatcagcgcacagagacagtgagtggtcggccgcaggcagcgcgggcattggggtctggacatgtgttttcaggcctggttgagctgggtcttgagcaagtcgcggaaagtctggatcagcggttcacggctgcgaccacggcgcatgatcatcgaaaacggtgcctggtagccaaacgtggcgggcagcaatacacgcaggtcgcccttgtcggcccacgcctgggcatagtgctcgggcaggtagccgatgtaggcgccggacagcaccaggatcagttgagcctccatactttccaccgtcgcggcactgtgcttgaagccgtgacgcgccagctcggcctggctccaatagccacggccgaccatgcgctgctgggtgatcacttgttcagggatacgccgctcattgaacagcggatgccgggtgctgcaatacagccagtgctgttcgcggtacagcggcatgtagaccagcccgctcatgcgattggaaaacgcgccgatggccaggtccagccggttgtcctgtacacccagttgcagttcataggggctcatcaccgacaggtgcaggtgcactgccgggtgctccaggctgtaggcgccgatcacctcggcgaagggcaaggccttgtcgctgacggtggagtcgagcacgccgagcttgagggtaccgcgcagctcgcctttcaacgccgcggcgtattgttcgaagccttccagttcgcccagcaggcgcagggtttcctgatgaaacagctcgcccttgctggtcaggctgaaaccaccacgaccacgatgacacagcaccaggcccaaggctgattccagctggctcatataggtgctgatggccgatgtggacaggttgagttcgtgctgggcattggcgaaaccctgatggcgcacaacgctgacgaagatgcgcagcagtttcaggtcgggcaaggcgttggccatggttggctccaggcgtggagggagaatggaagtctacctgtgcgcattagtttagaaaaatctgaactaagtatttgccccagccgattcttcctacgccaggcttttcgcagaatcggccactaataaacaaaacaatgatgaggcaatcccgtggacaagattttccaccaaccactgggcggcaacgaaatgccgcgcttcgccggcatcgccaccatgatgcgtcttcctcacctgcaaacggccaagggcctggacgccgcctttattggcgtgcccctggatatcggcacctcattgcgcgccggtacgcgattcggcccacgggagatccgtgccgagtcggtgatgatccgtccgtacaatatggccaccggcgctgcaccgttcgactcgctgtcggtggccgatatcggcgacgtggcgatcaacaccttcaacctgctcgacgccgtgcgcatcatcgaagaggcctacgatgaaatccttgagcacgatgtgatccccctgaccctgggcggcgaccacaccatcaccctgccgatcctgcgggcgatccacaagaaacacggcaaggtcgggctggtgcacatcgacgcccacgccgacgtcaacgaccatatgttcggcgagaaaatcgcccacggcaccaccttccggcgtgccgtggaagaaggcttgctcgattgcgaccgcgtggtgcagatcggcctgcgtgcccagggctacaccgccgaagacttcaactggagccgcaaacagggctttcgagtagtacaggccgaagaatgctggcaccactccctcgcgccgttgatggccgaagtacgcgagaaagtcggcggcggcccggtgtacctgagcttcgacatcgacggcatcgaccccgcctgggcgcccggcaccggcaccccggaaatcggtgggctaaccaccatccaggccatcgagatcatccgcggttgccagggcctcgacctgattggttgcgacctggtagaagtttcgccgccgtacgacaccaccggcaacacctcgctgctcggcgccaacctgctgtacgagatgctttgcgtactgcctggcgtggcgcatcgctgatgagcgcgcacgaggtatgaaaataacaagaaccgtctttacacactgacaaccaagggggtcgtagagccccctcctcgatatacctgacttttgctcgcgtgtttacggagccggctgccgcctgatcgaccataaaaaatataatcggagaatcaccgccatggctttggatttattcgtcgtactcctctacgccgccggcatgctcgtgctcggctactacggcatgcgccgtgccaagacccacgaagactacctggtggccggccgtaacctcggcccgtcgctgtacatgggcaccatggccgccacagtcctgggcggcgcgtctaccgtcggcaccgtgcgcctgggctatgtgcacggcatttcaggtttctggctgtgcgccgcgctgggtgcggggatcattgcgctgaacctgttcctggccaagccgctgttgaagttgaagatattcaccgtcacccaggtcctggaaaaacgctataaccccatggcgcgccaggccagtgcggtgatcatgctggcctacgcgctgatgatcggggtgacttcgatcctggccatcggcactgtgctgcaagtgctgttcgacctgccgttctgggtgtcggtattggtaggcggcggcgtggtggtggtgtattcgaccatcggcggcatgtggtcgctgaccctcaccgatatcgtgcaattcgtgattaagaccgtcggcctgatgttcatcctactgccgatctgtttgtaccgcgtcggcggctgggacgaactggttgccaagctgccagcgtcgaacttcagcttcaccgccatcggctgggacacgatcaccacctacttcatgatctacttcttcggcatcctgatcggccaggatatctggcagcgggtgttcactgcccgtgatgagaaggtcgcccaatacgccggcacgttcgccggtgtctactgcatcctctacggcttggcctgcgcgctgatcggcatggccgcccatgtgctgataccgaacctggacaacgtcaacaatgccttcgccgccatcgtcaaagcttcgttgccggatggcattcgtggcctggttatcgccgccgcactggccgcgatgatgtccaccgccagcgcaggcctcctcgccgcctccaccgtactgaccgaagacctgctgccacggctgcgcggtggcaagcaatcgagcttgcgcatcaaccgtttgttcaccctgctgaccggcgttgccgtattgggtatcgccctggtggtgaacgatgtgatcagcgccctgaccctggcctataacctgctggtaggcggtatgttagtgccattgattggcgcgattttctggaaacgtgcaacgacctccggggcgataacgtccatgaccctgggctttgtgaccgcgttggtgtttatgttcaaggatgggctggacgcaaacacgccgatttactacagcctggcggtcgcgctggtgagttttgtgctggtgagcttagtgtcgcgccgaccggatacagtggcggctcggacggtttgagctataaaaggatttagcgagtttcttcagcgggcgcgacgtcggaggtcgcgcccgtttttttcgccttgaacaaacaagtgcgagagcgagtaattagcggcgacgtggccgacgctgctcatcatccgttcggatcggcaccggttgcagcggtggctcgatcaagcccagcgcaacgccaaggtcatggagccagttctggattttctctttcatggttgccccctttgagggtagtgctggtcggcgtgagttctgtcgccgtttcctacagtgatagtagccctaagtcctaggtattgcttgaacgaaaccacaacgaactattactggattgatctgaatcctgacggatcgttcaagcaatcgcacgggtatctggcaaagactcggccctaccctcttgctgcaggtcgatccatgcgttgaggttagcgccgagcataccctttcgccacatcagccaggtggttgcagtggcaaaaggcccagtcagcggatgaacggacacgctgtccttgcctggcaggctgtcgagcatggattcggacatcaacgccacgccggaaccggcgatcacgcaagcgagcatgccttggtaggactcgatctcgatcgcccgccccatggcgacgcgatcatgggaaaaccaggtttccaggcgggtacggtaggcgcagctgcgtcgaaaagtgaacaccgaacggccagccacatcctgtggaccgcgcaccggcgggtgatcagcctcgcaaatcagcaccaggcgctcttcgcataagggcacgccatccaaggtggcgatagtcatcggaccgtccacaaaagctgcgtccagacgtccagtaatcaaaccttccagcagctccccgctgggtgccgactgcacctgcaggttcaccatgggataagtcttgtgataacgcgccagcagtttcggcaagtggactgccgcggtgctgtacatgctgcccaacacaaagtcaccggccggttgcccgccttgtacggcgccgtgggcttcgtcatgcagcgccagcagccgagtgctgtagtccaacagcaccttgcccgcaggagaaagctgcaaacgctggcgttcgcgaacgaacagctcgacgccgagctgttcctccatctgcttgagccgggtcgagagattcgaaggcacgcggtgcagacgctcagccgcacgggtaatggagccctcttcggccacggcctggaaaatccgcaattgactgaactccatacctttctccaaaactgaataagttactcactattattcatttttacagaaagtcaatccgtcttagcctgcaagtcattcgcttttttgcaggaaccctgaacatgtcaccgctgattcgtttactcgccagtttcatcgcactgatgatggccatgggtattggccgcttcgcccttaccccacaaatgccacatctgctcagcgaaggtcagatcgacctgaccggcgccgggctgatcgcagccgccaactacctgggctacttcgtaggcgcggtggactcgatctttgcccgcagccatcaccatgtacgcgggcgcctctacggcgggctatggctctgcgtattgttgaccctggcatcgtactgggccaacgggttctggccgcacctgctgttgcgcttcggcaccggcgtggcgagcgcctgggtattggtgatgatcaccagtttgagccaacctctggcgattgccgccggcagaccacgcctgggcgcgttgatctttgccgggccagggctggggatcttaatgacaggtttgctggcgctgggctcgaacctcagggggcaaagttctgccacgctgtggttgatttacggcgtggtggcgctgctgatgctgctggcgatcctgccgtttttaccgaagccgaccctcgcacctgcacaggccgccagcccaggtaataacggcagcatcgcgcacctgtgctggatctactttttattcggcctgggctacatcatcccggcgacctttctctcgcagatggccaacgcacagttcaaaggcgcctggcaggccgatctattctggccctgctttggcctggcggccgcactgggtgtgggggtggcaagcttgcgccgcaaggacccgcacaccacccgtcactggctgatggcaaccttgtggctgcaagcagtaggcgtgtttgcctgcctgctcggcaatagttggggcctggcgctcggtgtattactgtgcggtgcgccgttcctggcctgcatgcaattggtgatggcacgcttgcgggaagtcgcgccccacggctaccaacgcagcaccgggctgttgaccgccagctttgccatcggtcaactgagcgggccattgctggcgtcggtgagcagccacctcagtggtggcctgcaaccggcgctggtcatcgccggtgtcggtttgttattggcgggctcagtcttgatcaaccgtcgattaccgacgcagccgatgtgcacacagatggccgacggtgcagcacatcgcggttaggcaggtgccccacgccatgtccatcactgccagcccggctgaccagccttcaagcgtggcccagttgctcaggtcataagtgccataggccaccaggccaagcaaggcgcccaaacgcgcagcgcgttgccagcttgcgctgggcaagatcaccagcaccacacaaccgagcacatacaggagatagaacaataccgccggcaacagacgcggctgatcaagcatcagcgggccgagcagggatttgtaggtgggacccatcaggacgccgagccataggccgtcaaggatgagaaaggcgagcagggtgccgaggtaggcgaagagcgttctcttggacatgacacaagcctttgcaggagcgagcttgctcgcgaaaaacgtacatccgacgccacgctgcgcctggaatattttcgcgagcaagctcgctcctacaaagagccaggcacactcagcttagttcaatgcgatcggcatgaatcacaatctggccctgcttgtagagcgcaccaatagccttcttgaagttgcccttgctcacgccgaacaagttgctgatcacggccggatcgcttttatcgctgaccggcagcgtgccattgttgtcgcgcaacttggcgaggatcttggagttcaggctggaggccgcttcctggccgaccggttgcaggctcaggctgatgttgccatcggcgcggatctccttgataaaacctttttcttccttgcccgggcgcaggaacttgaacacttcgttcttgtggatcaggccccagtgcttgttgttgatgattgccttgaagcccatgtcggtggcttcggccaccagcagatcgacttcctggcccacttggtagttggctggcgtcttgtccaggtagcggtcaagacgtgcggtggcggtgatgcgcttggtgtgcttgtcgaggtagacatgcaccacgcaatactcacccgcggtcaattggcgtttttcttccgaatagggcagcagcagatcctttggcaacccccaatcgaggaatacaccgatgctgttgacctccacaactttcaaactggcaaattcgccgacttgaactttgggtttttcggtggtggcgataagtttgtcatcgctgtccagataaatgaaaacgttaagccagtcttcatcttcactgggaatatctttagggatataccgattaggcaagaggatttccccatcttgcgcaccatcgaggtacaaaccgaagttagtgtgcttgaccacttgcaagctgttgtagcgcccgactaaagccatttccaataccctcattgcgtgggcggcattctacccgagttgcgccttgcacgcgcgcaggcctgaaaaatcacaagctggcatggcgtttcactggcaacactccactcgtctgatcaatcggttgagttttgccctgtcatcaaccccggcccgcccaatggtttcgagctaaaacagcaagttagcgctttatttcatcgattaactgagattatttcggagctcagcacttattctccggggatatttgccaagcaattgtcaagtatttcctgtacgatgcctggccaagttaattttctacaggttagtggccgccatgcgcgtaaaagcatccaacagcaaagcaaagccagctcccgccgttgaaaccagcgaatcgatcaacagccagattgctgcgttcctcaagtccggtggcgaaatccagcagattgccaagggcgtgagcggccagactttcggcccgtccaagcagatcagcctgggcaagaagtaatacctgcgcactgcatctggtccctaagcgtcttgccctcaaggcgctaggactagagtttgaaacaccctcgcaccgcatccaatatcaagctaatcgacgaacgggtctcaacacctggcattcgccggtatccttgcacacgtctagcacgggcatctgctcgaacccatccgttactgctcctcgcttttcatggagtgaagcatgcttaaacgctgcattttcctggtcagtatcctggtcgccagcccattggccgaagcgcagattttccagcgcgaactgggtgacttcgacctgaaattgggcaccacccccagccggagcatggcccagggcctggtcaagccgacctcccctggtagcgactcgttccacggcggcctggacttgagccacgacagcggcctgtatttcggccagttttcaccgaacatgggcctttcctcacccaacaatctcgaagtcgactcctacctgggtttcaaacgccctttcgaccagaccctgggctatgaagtgggcttgattcactatagctaccccaaggtcagccccctcgacagccaggaggtctacggcggcctgaatctgttgggcaaccgctttggcgtgtctttcagcaatgacccagaccgccaggacagcaccctgtttgccgacctcggcggcacccagcctttcggtatcggcgtcagcatgaagtacaccacccaccaattgggcacaccggtctcggtggaaaacggcgccatcagcagtttcagcgattggtcggtgcaattttcccgggcgtggaaaggcattgacctagacctgatctacagcgattccagcctcagcggcggtgactgctcggcctactccggacacaattcgcaatgtgacggtctgttgaccttgaaggctgtccggccgttttattgatgggctgaactgtcgcaccccgcgcaggttcacatgcattaaccccatccgtgcaaggactcgcccatgttgcgccggctcaaactcctgatggtactgttgaccctgagcctggtgctcgccggctgcaatcgcgtgggcctggcctaccgtaatctcgacgtgatcatcccctggaccctcaacgactacctggacatgaacgccgggcaaaagagctggttcaacgataccctcaaggaacacctggcctggcattgcaccacacaattgccgggttatctggactggctggaccgcctgcagcaaatggtcgacagcaaccaaatcactgacgccgcgctgcaaacccgaaccgtcgaagccaagcaggcgattgccgagatcgcacgggaaatcaccccgtccgctgtgcagttgctgcaaggtctcgatgatcagcaggtcaaggacatgagcgaggcccttgccaaggacctgcgcaaacgccaggacgaatacctcaagccaccgctggcccagcaggtcaaggagcgcgccgagcgcatgagcaagcgcctggacgcctggatcggcccgctgagcgccagccagcaaaaccgcgtaacggcctggtccatcgccctgggtgaacagaaccaggcgtggatcggcaaccgcgcccattggcaggcgcagtttatcgaggccgtcgagcaccgccacgacgccgacttcccgcagaagatgcaacgtttgctggtggacagggagagcttatggacgcctgaataccgtgctgcatatgctcagaccgaagcggcagcgcgcagcctgatcgtggacctgatggctgagagcacggtgcaacagcggcagaagctgaagcaaaaaatcgacggcgtacggagcgatttcaaagcactcaaatgcctcaaggccggcgcaaatcaatagggaagggagcagggctcccacccacattggattcgggggttagatagcgccaccggcaatcgcagctttggaagagacttgatcgaaggtcgcctcctccagcgcgtcctcctgctcgtccataacgtgccggggatgctcattgccaggaatcgaactgtcgatcaacgccagcaggcttgcgccccgcggggtcaagatgaagttctcaccgttgccgccctcctcttcgggacgcgactcaatgaacccgcgcttgaacagcagcgcctcgtagtccgcagcagtctttttcagcgcatccagattcccggtgtcctcgccagccgtcgctttatcagcagcttcctgttcggcgtatttacgcggggcaaagctaccctcgccgttctgcacttcatgcagcagacgttcgatcagatcccagttgtaagtcgtcatcctgattcctcctgcaggccgatggaaaattagcccgtcataggtagtgacacgtgctagcactggccgttcacccggatagacgggcgtcatttctctgaactttccagacgttcgccgcctcaactgcctataccgccaaagaggtccgaccatgaaaaccctgagaaacctggccatcgccgccacgttgcttgccgccctgcccgcctgggcttgtacgctcgacgaggccacggccaagcgcgaagaactggccaaggaagtgaccaggctcaccgagcagaacccaaccaaggccaaggagatgaatgaccagttgcagaaaatggatctggataccgaaagtgccgagtttccggacaagtgccagttgattgatgcccggcttaaggaattgaaggaagcggccgccaaaacagaaaactgatggcgaaaaaaaaccggacatcgtccggtttttttatgcccagctgcttattcggcagccggtgcttctggcttgcggcgcttgagcggcgccatgccgtccttgctgaccagcgacaggttgtcggtcttcggccggttggcgatcttgcgcttggtcggcgatttggcgccggcctttttcttgtcacccttggcgtcggtctttttcttcttcacgcccacggccttgcccgacgccttgaccttcttcggcccggtgtaggtgcctttgacttccttgatgatgcggcgctcgaacgactgcttgaggtagcgctcgatgctcgacatcaggttccagtcgccgtggcagatcagcgagatggccaggccatcgttgccggcacgtccggtacggccaatacggtgtacgtattcgtcgccgctgcgaggcatgtcgaagttgatcaccatgtccaggccgtccacgtccaggccgcgggcggcgacgtcggtggccaccaggatcttcacgccgccagccttgaggcggtcgatggccagcttgcggtccttctggtctttctcgccgtgcagcacgaacgccttgtagtcctgcgccaccaggcgaccgtagatgcggtcagccgcggcccgggtgttggtaaacacgatggccttctggtaggtctcgttggccaacagccagttgaggatctgctctttgtgcacgttgtggtcggcggtgacgatctgctggcgcgtggtcgcgttgagatcgctgacgttgttgacctgcaggtgctctgggttgttcaggaccttggcgaccatgtcgcgtagggtcgaaccgccagtggtggcggagaacagcatggtctgctggcgattgacgcactcggccaccaggcgctgcacgtcatcggcgaagcccatgtcgagcatgcggtcggcttcgtcgagcaccagcacttcgacttccttgagatcaaggttaccggcattgagttgctcgatcatgcgccccggagtgccgatcaggatgtccggcaccttgcgcaacatggcggcctggaccttgaagtcttcgccgccggtgatcaggccggacttgatgaaggtgaactgcgagaagcgctccacttccttcaaggtctgctgggccagctcgcgggtcggcagcaggatcaaggtcttgatgctcacacggactttggccgggccgatcaggcggtgcaggatcggcaagacaaaagcagcggtcttgccgctgccggtttgagccgtcacccgtaggtcacgcccctggagcgcgagcgggatggccgctgcttgcacaggcgtaggctcgacaaatttaagctcggccacggctttgagcaggcgttcgtgcagggcgaattgggaaaacacgggtgctacctcgaagaaatacaaaatatcagcggcataggttaccggtttcgcgcgtccaaaccgagtttctttacgcgaacagggctaatcagctgcttttttgtcagcgtatttgtctagaacgtcaactttgttgcacttaaatgctctaatccccccgtctcgccttacagaagaatcggtttcattcatggatatcaaacagctctggctcaacgcccaggacctctggggcaccctcgatgaacatccgctgctgcacgccggcctcggcttgctggtgttgctggtggtggccctgctactcggacgggtagcacgctacctcattattcacgccatcaaattgcttggccggcaaccggccctgcactggctcaacgacctgcagcacaacaaagtcttccatcgcctggcgcagatgaccccgtccctggtgatccagttcggcctgtacctggtgccgggcctgagcaagaccgccatcctgtttatcggcaatgtggccctggcgatcaccattctgttcctggtgctggccatgagcgcgctgctcaatgccctgctggacatctacgcccgtaccgaacacgcgcgcacccgctcgatcaagggctatgtgcaactggcgaagatggtgttgttcgtgtttggcgcgatcatcattgtcgctacgctgatcgaccgttcgccgctgctgttgctgtcggggctgggtgccatgtcagcggtgatcctgttggtgtacaaggacaccctgctgtcattcgtcgccagcgtgcagctgaccagcaacgacatgctgcgggtcggcgactggatcgaaatgccccaggtcggcgccgacggtgatgtggtggatatcaccctgcacacggtcaaggtgcagaacttcgacaagaccatcgtctccatccccacctggcgcctgatgtccgagtcgttcaagaactggcgcggcatgcaggcttccggtgggcggcgcatcaagcgcagcctgtatatcgacgccagcggcgtccgttttttgcgcgatgacgaagaagtgcgcatgacccaggtgcacctgctcaccggctacatcggtcgcaagcaggccgaactcaaggcctggaacgaagcccagggccacagcgcgcaactatcggccaaccgccggcgcatgaccaacctcggcacgttccgcgcctacgcactggcgtacctgcaaagccacccggacatccagccgaacatgacctgcatggtgcgccagatgcagaccaccgcccagggcgtgccgctggagatctactgctttacccgcaccacggcgtggggcgattacgagcggatccagggggatatctttgattacctgttggcggtgttgccggagttcgggttgagcctgtatcagcaaccgagcggcaatgacctgcgcgccggcgtattgcctgccttggtcggagccacccaggtgtccaacgtcgaaacggtgtgatgtgacccaaacgggattacggcagtgatgccgtaatctctttgcggcacacctcaagcacttcatgggcgagggcggaatcatccggacacgcccgcgacagcataatggcgccgatggcgtgggccatcctgttgagcattttcgcgcgcacgtcttcctgtggttcgtcctgcgccgcgttgtactttgcctgcagggcctgcagcgtgttttccaacccgttggcgaaggtctccttgagcgtgtccgattgacgcgcagcatctgcacacaacgccgccaaggtgcatccgccgccgcggtggtcgcggtgctgcctggacaggtacacctcgaaaaactgctccacctccaggtgtgcgctgtcggcaagcgactgcgccaggctgttggcggccgcttctgccatcaaatccgccttggagccgaaatgcttgtagaagccgccctgggtgaaaccggcggcagccatcagttcggccacacccacaccatcgaaaccgcgttcacgaaacagctcggaagccgtcgcgacgatatgcgctcgattgctttgtgattgtgtcttggtgatcttcattttttgcgctcctgctgccctgcgattgccctgcaatataggcatcttactatgatgttgatcgtaatcaaaaccgttgacagttttgattatgatcgacatcataaaacctcatcgcatccacagagcatcacaccatgagcacttccactaccgttctcatcactggcgcctcgaccggcattggcgccgcctacgccgagcgttttgcccagcgcggccacaatcttgtattggtcgcccgtgatacccagcgcctggaagcgctcgccgcccgcctgcgtgaacagcacgccatcagcattgatatcctccccgccgacctgactcaaagcgctgacctggcagcggttgaagcgcgcctgcgcgaggacgccagcattggcacgctggtgaataatgccggggccgcgcagtccggcagctttatcgaacagtccagcgacagcgtcgctcagttggttgcgctcaacaccacggcgttggtgcgacttgccagcgccattgccccgcgcctggcggcagcaggtgacggcgctatcatcaacataggctcggtagtgggcctggcgccggagttcggcatgacggtgtatggcgccaccaaggcgttcgtactgttcctgtcccagggtatgagccttgagctggctcccaaaggcgtctatgtgcaggccgtgctgccggcggccacgcgtaccgagatctgggagcgggctggcattgacatcaataccctcacggacgtgatggaagtgggtgacctggtcgatgcggcgctgatcggctttgaccgtcgcgagcccgtgacgatcccgccgttgcaggacggcgctcgctgggatgccttgcaggcagcgcgacaaggcttgctggcgcagatcaagcagtccaaggtggctgaccgctacctggtcaaagcctgatcaacccttttgcaggcgtgctgtgctactgcgatgcataggcgcctgcccttccgtcgaagcgatgagcgttgaaccatgaaggcattttcaatcgagcgttatggcaagcacacaggccgcatcaccgaagccccgacaccggtggtgggtgaacatgacgtgctggttcaaatacatgccagcagcatcaatgtgctggatgcaaaaatcgccaaaggcgaattcaaactgatcctgccgtatgcgttgccgttgacactgggcaatgacttggccggtgtggtgctcagcgtggggtcggcggtacgacgcttcaagccgggtgacgaagtctatgctcgccctcccaagcagcgcatcggcacgttcgccgagctgattgcggtacgcgaagacgcagtggcacgcaaacctgcaaacatcacaatggagcaagccgcctccctacccctggtcgcgctgaccgcgtggcaggtgctggttgaaacggcgaggctgaaaaaaggccagaaggtcttcattcacgccggctccggtggtgtcggcagtatcgccatccagctcgctaggcatttgggcgcttttgtcgctacgaccaccagtaccgccaacgtcgagtgggtcaaggcgctgggcgcggatgtggtgatcgactacaagcagcaagagttcgaaaccgtgctcaacgactacgacgtggtcatgaacagcctcggcccggatgcgctggcaaagtcactcgacattctcaagccgggcggccagctcatctccatctcagggccaccgacgccggcattcgctcgcgagcaaaacctgtcgtggggattgggcttggtcatgggtgtcttgagcagtggcattcgccgcaaagcgcgcagaaaaaacgtccgttatgacttcgtcttcatgcgcgccagtggtgcccaactggatgaactcaccgcgctggttgagtccggcattatcaagccggtgatcgaccgtaccttccctttcgagtcgacggccgaggccttgagttatgtcgaacaaggccgggccaaaggcaaagtcgtgatcacgataaaggagacgataccgcctgacgcacacccagccggctgatccacaccgccgccagaatcaccaggccgcccaaggccaaacgccccagcggctcgtgctggttccagatcagcaggttcagcagcagccccaccggcacatgcaagttgttcatcaccgccagggtgccgccattgaccaggcaggcgcccttgttccaccagtacatgcccagcgcggtgctgaccactcccaggaacaccagcacgccccattgcagcggcgcttgcggcaggaaatcagccttgccgaacagcaggaatgcgggcaacaccaccagcagggcgcccaggtagaaataaccgaaacgccggaaatgcggttggtcactcggataacgcgccaccaggtgcttgtacatgacttgcccggccgcgtaggtgaagttggccagctgcaacagcaagaaccccatcaggaagtggggcgtgatctgatcaaaacgaatcactgccgcaccgctcaccgccaccaaggctgcgaccagcgcccaagggttgaaacggcgattaagcgcgtcttcgatcagggtcacgtgcaacggcgtgaggatggtgaacagcagcacttccggcaccgtcagcacccgaaagctcaggtacaggcacacataggtcacaccgaactgcaatgcaccgatcagcagcatgccgcgcatgaacgcaggctccaccgagcgccagcgggtcagcgggataaaaatcagccccgccagcaccacgcgcaccagcaccgcaaagtagctgtcgacgtgaccggcgaggtattcgccgatcaagctgaaggaaaatgcctgaatcagggtgacaaccagtagatagcccatgcgcgcctcatgtcgaatggtcgcgacattaaagcttttcgcggtttgaagaaactcgacgcaaaaaaaacccgacctcgctcaagcggcagtcgggcaggagcactcaggagctacaagtgcaaagggaggttcgatacgcgtacttgaagggtttgcgtggcgctatataaacagcgcgggattatctggcgattaacgcttcacgccacctgcgccagcagtgctttagcctgattgacgcctttctcctggaagcccgcccccaggttcaccccttcggcgtgaatgaaggtcacgtcgtggatgccgataaaagccatgacctggcgcaggtacggttcctggtgatccgaggtggcgccggcgtgaatgccgccacgagcagtgagtacgatggcacgcttgccagtcaacaaaccctgtggcccggtggcggtgtacttgaaagtcacaccggcccgcaacacgtgatccagccaggctttaagggtgctggggatggaaaagttgtacatcggcgcagccatcaccaatacatcggcagccagcagttcgtcagtcaattcattggaacggtccagggacacctgttcatcgtcgttgcgctgctcggcgggtttcatccacccacccagcaggttggcgtccaagtggggaacgggattgcgcgccacgtcacgcagggtgatgcggtcggccggatgggctgcttgccattgactgatgaactgtttggtgagctggcgggagatcgaatcctgctggcgcgcactgctttcgatgatcaggacattggacatggcttggtaggctccatcggtaattgctgtaagtcgatggagcgaaggttaaccagggcctattcgataaaaaagcgcaaaaaactgctacaacccatctagaaatttgttgttaagcggagtattcctgtctggcatgctccgctgctttattttggagcgcagtccaaagcaatacgcattttgataatcgcgcggttgaacttggccgtggtgttagtgcttttgccggcgggtacggtcacggtgcgacggcgcggcgattccgggccgttggtgaagattaccgaacacagcgcatcgttggtgccgtagttactcaactggatcgaactgatgtcggcgtccacatcggatgcggtgtagtccacgcttacgccgttgatctttttagtcacgtcgatggggtaggcaaacgcgctcatcggcagcagcgccagcaacacacaacagaattttctcattcggcagtctccaataaggaccgccagcttaggacaagaggagctcatcttgaaagcgccccgcgttaccctcgatcaatggcgcacattgcaagccgtggtcgaccacggcggcttcgcccaggccgcagaagcgctgcaccgttcacagtcctcggtgagctacaccgtggcccgtatgcaggaccaactgggtgtgccgctgctgcgcatcgatgggcgcaaggcggtgcttaccgaagccggtgaagtgctattgcgccgttcccgccagttggtgaagaacgccagtcaattggaagacctcgcccaccatatggaacagggctgggaagctgaagtgcgcctggtggtggacgctgcctaccccaacgcgcgcctggtgcgcgccctcaccgcgtttatgccccaaagccgcggctgccgcgtgcgcctgcgcgaagaagtgctgtcgggggtcgaggagctgctcatggaaggcgtggccgacttggcgatttgcggcttcagtatccccggttacctgggcacggaaatgagcgcggtggaattcattgccgtcgcccatcccgagcacgccttgcaccgcatgggccgcgaactcagtttccaggacctggaaagccagatgcaggtggtgatccgcgactccggccgccagcaaccgcgggatgtcggctggctcggcgccgaacagcgctggaccgtcggcagcctggccaccgccgcagccttcgtcagcagcggcctgggttttgcctggctgccccggcacatggtcgagcgcgaactgaacgaaggggtgctcaagcaactgcctttggcacagggcggcagccgccacccgacgttctacctgtattcaaacaaagataaacccctggggccggcgacgcagatcctcgtggaactgctgcgcacctttgacaccgctcccctggacgcgccctttgccgcgcccctgcaagcctgaaacggagttcatccatggcctggttcgagcatgaaggctgcagcctgcattacgaggaatacggccacggcaacccgctgatcctgatccatggcctgggctcaagcagccaggattgggagctgcaagtgccggtactcgcccggcactatcgcctgatcgtggtcgacgtgcgcggccatggccgctccgacagaccccgcgagcgctacagcatccaggggttcaccttcgatctgattgccctgatcgaccacctggacctgcctgcggcccatgtagtggggttatccatgggcggcatgattgccttccaactggccgtagatgaacccgcacgggtcaagagcctgtgcatcgtcaacagcgcgcccgaggtcaaggtgcgcagcgctggtgactattggcagtgggccaagcgcaggaccctggcccgcgtgctcagcctgagcaccctcggcaaggccctgggcgaacggctgttccccaaaccagcgcaggccgacctgcggcgcaagatggccgaacgctgggcaaagaacgacaaacgtgcttatctcgccagcttcgacgcgattgtgggctggggcgtgcaggaacaactttcgaagattacctgtccaaccctggtcatcagcgccgaccacgactacacccccgtggcgcagaaagaaatctatgtaaaactgctgcccgatgcgcggctggtcgttattgaagattcccgccatgccacgcccttggatcaacccgaagtctttaacgcgaccttgctcgattttctaaagaccgtcgaaaccactacccaggatcactgacccatgctgaaaaaaatcgccttctttgccggttccgttctgttcgctgccaacctgatggcggccgaacctgccaaggcgccccacgtattgatctccaccaccaacggtgacatcgaaatcgaactggacccggtcaaggcacccatcagcaccaagaacttccttgcctatgtcgacaagggtttctataccaatacgatcttccaccgcgtgatcccgggtttcatggtccagggcggcggctttacccaacagatgtcgcaaaaaccgaccgaagcgccgatcaagaacgaagccagtaacggcctgcataacgtgcgtgggaccttgtcgatggcgcgcaccaatgacccgaactcggccaccagccaattcttcatcaacgtcgccgacaatgccttcctcgacccgggtcgtgatgccggttatgccgtgttcgccaaggttgtcaaaggcatggacgtggtcgacatcatcgtcaactcccagaccaccaccaagcaaggcatgcagaacgtgccaatcgatcctgtcctgatcaagtcggccaagcgcatcgactgaggtcagcagcaagcttcgcgcgcagcccacaaggcagcgcgcgcatttgaaaggagagcccgcacggcgggcgtcaagcctaatgctctatcgtcgttttgaacaactgatcgatattttccgcgacgcgcccagcgccgcacctcccgataaagtcctgcccttctatctctactacctgcgccaggtgtggccgcatttcgccgccctgctggtggtgggcctgattggggcgctgatcgaagtcgcgttgttcagctatttgagccgcatcatcgacctggcccagggcacgccgcccgccgatttcttccagatccacagcaccgagctgatctggatggccgtggtcgccctgctcttgcgcccgattttcggcgccctgcacgacctgctggtacatcagaccatcagccccggcatgaccagcctgattcgctggcagaaccacagctacgtgctcaagcagagcctgaatttcttccagaacgacttcgccgggcgcattgcccagcgcatcatgcaaaccggtaactcactgcgcgattccgccgtggcggcggtggatgcgatctggcacgtggcgatctacgccatcagcgccctggtgctgttcgccgaggccgactggcgcctgatgatcccgctggtgagctggatcatctgctacagcctggcactgcgttacttcgtgccgcgtgtgaaggaacgctcggtgatttcctccgaagcacgctccaaattgatgggccgcattgtcgacggctacaccaacatcaccaccttgaaactgttcgcccatacccaatacgagcagcagtacgccaaggaagcaatcattgaacagaccgaaaaaacccagttggccagccgcgtggtgaccagcatggacatcgcgattaccaccatgaacggcctgctgatcgtcaccaccaccggcctggcactgtggttgtggacccactcgctgatctcggtgggcgcgattgccctggccaccggcctggtgatccgtatcgtcaacatgtccggctggatcatgtgggtggtcaacggcatcttcgagaacatcggcatggtgcaggacggcctgaaaaccattgcccagccgctggccgtgatcgaccgcgacaacgccccacgcctgagcgtgccccagggtgaagtgcgcttcgaacaggtagatttccactacggcaagaagagcggaatcattggtggcctgaacctggagatcaaggccggggagaagatcggcctgatcggcccgtccggagcgggcaaatcgaccctggtcaacctgctgctgcgcctctacgacctgcagggcggacgcatcctgatcgacggccagaatatcgccgaagtcgcccaggaaagcctgcgcgaacagatcggcatgatcacccaggacacttcgctgctgcaccgctcgatccgcgacaacctgctgtacggcaagcccgacgccacggacgaagagctctgggccgcggtgcacaaggcccgcgccgatgagttcatcccactgctgtcggactccgaaggccgcaccgggctggacgcccatgtgggtgagcgcggggtgaaactctccggcggtcagcgccaacgtatcgccatcgcccgcgtgctgctcaaggacgcgccgatcctgatcatggacgaagccacctcggcgctggactcggaagtggaagcggcgatccaggaaagcctggaaaccctgatgcagggcaagacggtgattgccatcgcgcaccggttgtcgaccattgcgcgcatggatcgcctggtcgtgctggagaaaggccagatcgccgagagcggcagccattccgaattgctggcacatggcggactttattcgcggttatggcagcatcaaaccggagggtttgtcggtatagactgattttattgggtaaaccgccgttcaattccgaacaattctgacagctttctccatctggctggtcgtgcgacacaatcctgctgtactgcaatcaggccccaggagggccctgatttaaggcggcagggaagccacacagaccgttaatcagatagagcaatctaaggaagtgttcatgtcactgttcaaacgttccgtaacggaaggactgggtacgttttggctggtgttaggtggctgcgggagtgcggtgttggccgcagcgttccccaacgtcggcatcggcctgctcggcgtgtccctggcctttgggctcacagtgctgaccatggcatttgccatcgggcatatcagcggttgccaccttaacccggccgtctcggtggggctggtggtgggcggcagattcccggccaaggaattgccagcctatatagtgtcccaagtgatcggtggcgccatcgccgccgcactgctgtacttcatcgccagtggcaaacccgggttcgaactggcctccgggctggcaagcaatggttatggcgagcattcacccggtggttattcaatggcggcaggctttgtctgcgagctggtgatgacagcgatgttcgtgctgatcatccttggcgccaccgaccgccgtgccccggcgggcctcgcgcctattgccattggcctggcgctgacgctgatccacttgatctcgatcccggtcaccaacacgtcggtcaacccagcccgcagcacggggcctgcgttgattgtcggcggttgggcagtccagcagctatggttgttctggctcgcaccgatcctcggcgcggtgatcggcggcgtgacctatcgatggctgggcaaggatgaaggggcctaaggcaaacggatcagccctgccgataaggcagggctgaattcaattcaatgttgctcaaccctgatgggcctgcatgtattgacgcaacagttgattgatacgtgtctggtatccagtaccttgccccttgaaccactcgagaacgtcggcatccagtcgaatagtcaccgcctgcttcaccgggacacgaagctcggcacgccggaaaaattcggcgtccagctcggggatatcactggtatcgatttcttcttcattcatcttggccaagcgcttccaatcagttttcgatgtttgcgtcatagtatttggcctccttcttggttgcttttcgggcccagatgatacggatcacatcaccacgccgctcggtatatacgaccacacccattaacaatttgatctagccaatactgatccaacgctcttcgccataatccgcccgatcatcgcgctaggccagcattgggtgtctaaaaatatcagggacgtggttaaaatcgatgccgtgcttagaaatattggctttgttcttggcttcatcccactcaaaatgcatggcacatcctgtatgtacttttgtacatacagaatagcgatttgaccgttcacctgcagtactgccagaccgatgctttagccctgccgataaggcagggctgacctcgcctcttcggcatacgccagaatccccacccgttcacgctcaagaaaatcctccacagcactcttcaaccccggatggcgcaggtagtgccaggaccgtgtaatcaccggctcaaacccgcgaatcaatttgtgctcgccctgggcaccggcgtcgaagcgttgcaggccgtgggcgatggcgtagtccatgccctggtaaaaacaggtttcgaagtgcagtcggtcgaattccgccaggcagccccagtagcggccgtagaagctgtcgccaccgatcaggctgaaagccatggctaccgggcgcgagccttgcttggccagcaccacgcggatggcctcgggcatgcgttcggccagcaggctgaaaaacgcacgggtcaggtagggcgattggcggcggactgcataggtgttggcgtagcaggcatagacaaaatcccattgagcttcgctcagttcatggccttgcagccactcgaactcaatgccctgccccgccacttgttcgcgctccttgcgcatctgtttacgcttgcgtgaactcaaggcatcgagaaaatcctggaagtcgcggtagccgcggttctgccaatgaaactggcagcccaggcgttgcatccagcccggctgcagggccaaggcctcatcggccaaggcgtcagtgaaattgatatgggcactggagagcccttcgatctccaggtagcccggcagactcttgagcaactcgaagccgtcctcggcattggcggccaaaatacgtgggccgctgacgggactgaacggcaccgccgtcagcagcttgggatagtagtcaataccggcgcgctcacaggcatcggcccagccatggtcgaacacatactcgccgtaggaatgccatttgcgatagctcggcagtgccgccaccaggcgctgcccttcccagtgcagcagatgctccggctgccagcccgattgcggcctcaggctggcgctgtcctccagcgcgctcaagaacccatgccgtacaaacggctgggcctgcggcaccagggcgtcccagacctctggggcgatttcggacaggctgtccaggcgttgcaacggcatcggcatcctcactgattcttggcgttaaagcctggcgagtatcgcttatcgcaacccagtgcacaccttgaaaacacgctgacagacttggaaataaatagttccaacctcagcccatttgtcatctagatgaaatcacttagccactactccgtcataaacggtcgcgatactgacgccagtttttagagcgcctgggtctaccgggtgacattttttccgtccgtcattggtcggttgtgtcctggatggtttgccatccctcctcactttcggagattgatatgcgtcttgcttccactaaaactgcggcggtcctgtgtggcggcctgttgctggccctgagcctaccggccagcgctgcagtcgacgctaaattgctcgacatgctcaaggccaacggccagatcactgcggcgcagtacagcgaactgcaagcagagctggccagggaccaaaaagaacagcagatcgcacggcaagctcaacaagagaccaacgagcagatcgcggccaccgcgaaaaaaaccaacgagctgagcagcttcgaccagaagctggcctgggccgccaaaacccagttcaaaggtgacgtacgcttccgccaggaaaccatcaagatcgatggcgagcccaacaacggcgggcgtgacaaggaccgtcaacgtatccgtgcccgcctgggtgcctacaccgagatcaacccacaggtggacaccggcatccgcatcgccaccggtggcggcgacgatgctcgttccaccaaccaggatcaggatggctacttcgataaaaaatcgatctggctggacctgggctacatcgactaccacccggaccagatcaagaacctgcacgtgatcggcggcaagatgctccagccatgggtgagcatgggcgacgtgatctgggatagcgatatcaacccggaaggcctggccgttacctacaaatacccactgggcagcagcgccgaactgttcggcagccttggcaactacaacctcaaggacaatgtcgacggagacggcgtgcagttccgccacgacctgcgcctgacatccggccagctgggtacgcgtttctcggtcaccgacaacctgaaaatgaccttgggcggcagcgtctacgcctacaaaaatgacgaggacagccgctgcacaaccaccaccacgccttgcgcgttggcggtcaacggcaactcggccaacaacgaattccgcctgtatgaaggttttgcccaggcagatatcggcggcctggcagtgcccctggcgttctacggccagtacgtgaagaacaacgatgctgtgaccgaccaggacaccgcgtggttgctgggtgccaagtccaaggtgttcggtttcaacctggactacaactaccgcgacgttcaacgtaatgccgtcgtaggcgccttcaccgattcggacttcgccaacggtaccaccggttcgcgcggccataagatgaaggtcagctacgacatcgacaagaactttgccctcggcgccacgtacttcctgaccaaggctgactacgccagccgcacgcagcgtgatgccaataccaacaccttgcagttggatgctgaagccaagttctaacccccccccccgttgtaggagcgggcttgctcgctcctacaaatctttcagccgttcggctgccaatcgttcagccagcgcatcgacatcctttaccggctcctgcggcaggatcttcagcgtcgcctgcatcaggcgcatctgacggataaagcgtcggcagttcgggcagaacatcaagtgatgacgcacgagcagacgctcgcgaaaggtcaattgcccatcgagataatcactggagcgagcgacttgttccttacaggtcaacattctcccgtttcctcaaaatgctccaccgtggcgaagactttaagccgcgctcgatgcaacagcacacgtacattggaaagtgaaaggctcagaagattacagatttcttccaactccaatccctggcgttcacgtagcaccagcacactgccctgcaattgggacaagctcagaatcgtgtgctccaggcattcgcgcaattcatcctcggtcagcagcgcttccggggtgtcctggtgccaggcatacggcgcgactgcccagtggccgtcatccgggctgaatcgctcatcaccaatggtgccatggggcgaaggcaaatcgtcgagcagcacttcccggcgattctgtttataacgccctttggcggagttggcggtgatggtcagcagccaggtcttgagactggagcgtccttcgaacctggccaggttgcgcaccaccgagagccaggcgtcttgcaccacctcgtcggcgtggcgctggccgacaatggcataggccaccgcgcgcattgcgctctggtaagtgctgaccaattccttgtaggcccgctgctctcccttgagcaagcgttcaagcaggtgcgcgtcgtccgctgcagccattcaaacctcgatcttgctgaaaatacggccagttcttacagatcagcgcttgcgcaggatcacgctgccaatcgaatacccggcgccgaacgagctaagcaccgccacggtgcccttgggcaagtcgtcctgataggtgtgaaacgcaatcaccgaaccggcggagctggtattggcatacgtatcgaggatcaccggcgcttcttccaccgacgcgtcgcgccccagcagctttttcacgatcaggtggttcatgctcaggttggcctggtgcagccagaagcgcttcacatcggtgacgtccagctggttttccgccaggtgtgcaccaatcaactcggccaccatcgggcagacatcgcggaagaccttgcggccttcctgcacgaacagcttgtcaggggcgccgatgccctcttccgcggtgcggttgaggaagccgaaattgttgcggatgttgttggagaacttggtcagcagcttggtgctcaccacctcgaactggtgctcggacgtcgccaggtcagcgcgctccaggatcaccgcggtggcggcatcaccaaatatgaagtgactgtcgcggtcacggaagttcaggtggccggtgcagacttccgggttgaccatcaggatcgcccgggcctggcccaactggatgctgttggttgcattctggatgccgaaggtggccgaggagcacgccacgttcatgtcgaaaccgaagccctggatacctaaggcttcctggacttcgatagcaatcgccgggtaggcgcgctgcaggttggagcaggcgacgatcacgccgtcgatatccgcggcagtcttgccggcgcgttgcagggcctgttcggcagcgccgacggccatctggcagagcaccgaccattcgtcgttgctgcgctcgggcaagcgtggggccatgcgctgagggtcgaggatgccgtccttgtccatcacaaaacggctcttgataccggacgctttctcgatgaatgccgcgctcgactccgtcagcgcttgcacatcgccacgctcgatggcggcagcgttgtcagcattgaactgttgtacgtaggcattgaaagactgcaccagctcttcgttggagatgctgttggccggggtatacaggccggtgccgctgatgacgacgttatgcacggtcgttcctctaaatctgtcaggcagaagatattggtaccgtcgtaccaaactgtaagtcgtttgagtccatcaggcgggcatcaaactggcaattcgttattcaatcttgtgaccgcgaagtttgccacaatgccggggatttggcgccataggccacacaaacaccttgaatgtgggacctgcccagttcaggaaaccgggaaggttcagggctctacctggctccactgcttgctcaagcgtttatcggaaatcggcaccttggtgcccaactgctgggcaaacaacgacacacggtattcttccagccaccagcggtacagctccaactgcgggtcgcgcttgccttcctgggtgtgtttgttcaggcggttctggtattgcgcccacaggccgcccaattcggtactccacacccggtccttctgcacctggctcggcagtttctccaggcgcagctcgatggccttgaggaaacgcggcagttccttgaaccattgcgccggggtttcccgtacaaaacccgggtacaccaggttgcccagttgctgcttgatatcgttcaaggctaccgcctgggccaggtcgatcttgcctttgaagcgcttttgcaggccgtgccacagcttcagcacgtccagggtcaggcgcgccaggcgttcggcgtgttcggtccagctgccgcgcttgcgttccgccaaagccgccaggccggcgccatcacgaggcaggctggcttcgccctccagtacgcaggtgtcgaggctggccagcaggatgtcttccaccagcgcgtcgatacgccccagctcgcggtacatcaaacccaactcggtcaggcccggcaatttgccgcgcaggaatttcgccggctcggccaattgctgcatcagcagacgctgcaacgcgcggcgatgctggaactcagcctcggcggcggtagagaaccggccttccttgaccgtaccattttcttccaccagcgccgggtacaccgtcatcgacaggccggcgatgttttgctgggtcttttcggcaaccgccgcgaacaccttggcttccaccggctgctggcttttcgcggtctgcggcacggccaatgcggcctggctggcttctgcaaaacgtgcggtcagttcggccaggtcgcggccttcgccaaggaacttgccttggccgtcgaccacttccaggttcatcttcaggtggctttctacctgctgcgccgcttcggcccaggcttcatcgctgacccgcgcaccggtcatgcgcagcaactcgcgccccagcgcctggggcagcgagccctggccgaattcgatgcgttgcagcgccgccttgacgaagtccggcaccggcacgaagttcttgcgcagcgctttgggcaagttacgcaccagggcgatgcacttggcttcgatcacgcctggcaccagccactccaggcgctcggcgggcaaggccggcagcaatggcgccggcacgcgcagggtgacgccgtcgcgggggtgattgggttcgaagtggtaactcaaggccagggccaggtcgcccaggtgcaaggtgtccggataatgcgcggcggtgacttcactggcctcacgggccagcacgtcttcttcgcgcatgatcagcaattgcgggtctttctggctgttgaccttgtaccagctgtcaaaagtggccgtctggtgaatctccgccggcaagcgtgcgtcgtagaaggcgtagagggtttcttcgtcggcgaggatatcgcgacgacgggccttggcttccagttcgtcgagttgctccagcaggcgctggttagctgtcaggcacttggcgcgggactgaatctcaccgcgtaccaggccttcccggataaacaactcgcgggacaccaccgggtcaatcggcccgtaatgcaccggccgacgtccgactatgatcaacccgaacagagtgatctgctcaaacgccaccacctggccgcgcttcttctcccaatggggctcgaagtgatttttcttgatcaggtgcccggccagcggctcgatccagtcggcgtcaatcttcgccaccatgcgcgcatagagcttggtggtttccaccagctcggcagtcatcagccattgcgggcgcttcttgccgatgccggacgaggggtggatccagaaacgccgctgccgcgcaccgaggtaatcgccgtcttcggttttctggccgatctggctgagcaggccggacaacactgccttgtgcagcttggggaaatccgccggctctttattgacgctcagctgcatgtcgcggcagatcaggctcaactggcgatgggagtcgcgccactcgcgcaggcgcaagtagttgaggaagttcttgcgacaccagttgcgcagcgggctggcggtcagttcctggcgctgctcttcaaagccacgccacagattgaccagcccggcgaagtccgaatccggatccttccactgagcgtgggcctggtcggcggcctgttgacgctccggtgggcgctcgcgcgggtcctggatcgacatggcgctcgcgacgatcagtacttcctgcaagctgcccagcttggccgcttcgagcaacatgcggcccatgcgcgggtccaccggcaggcgtgcaagctggcgccccaagggggtgagctggctgttacggtccaccgccgagagttcctgcagcaggttgaaaccgtcgctgatcgccttgccatccggcggttcgataaacgggaaatcggtgatctcgcccaggcgcaggtgcagcatctgcaggatcacggcggccaggttggtgcgcaggatttccgggtcggtaaattccgggcggccgataaaatcctcttcgctgtacaagcgaatgcaaatgcccggctcgacccggccgcaacggcctttacgctggttagcgctggcctgggaaatcgcctcgatcggcaggcgctgcaccttggcgcggtagctgtagcggctgatgcgcgcggtgccgctgtcgatcacataacgaatgcccggtacggtcagcgaggtttccgcgacgttggtcgccagcaccacgcgccgacccgggtgggattggaaaatgcgctgctgctcggccggcgacaggcgcgcatacagcggcaggatctcagtgtgcttgagctgggccttgcgcagcatgtcggcggcgtcgcggatctcacgctcgcccggcaaaaacaccagcacatcgccggggctgcggcgttcgctgcgctcgtaagcggcgatttcatcgagggtggcgaggatcgcctgatcgacagtcaagtcgtcctcgacgcggttgccctcttcgtcctgttccagggtcagcgggcgataccaggtgtccaccgggaaggtgcggcccgacacctcgacaatcggcgcgtcgtcgaagtgcttggaaaagcgctccaggtcgatggtcgccgaggtgatgatgactttcaggtcggggcgacgcggcagcagggtcttgaggtagccgagcaggaagtcgatgttcaggctgcgttcgtgggcttcgtcgacgatgatcgtgtcgtagcgttccaggtaacgatcattctgggtttcggccaagaggatgccgtcggtcatcagcttgatcagggtgttggaatcgctctggtcctcgaagcgcacctgatagccgaccaacgcgcccaatggcgtggccaactcttctgccacacggctggcgacactgcgcgctgcaatccggcgcggttgggtgtggccgatcaggccgtattggccgcggccgatttccaggcagatcttcggcaactgggtggtcttgcccgagccggtctcgccagcaatgatcaatacctggtgcttgagcagcgcgtccttgatctcatcgcgcttggcggcaatcggcaggctgtcgtcatagcgaatcaccggcaggctggcgcgccgtgccgtgacctgggcacaggacgcttgcatgcgcgccacccactgcgccagcttgtcctcatcgggcttcttacgcagctcgagcaactgccggcgcaagcggtggcggtcggcgagcatggcgtgatcgagggttttgagcagttggtcgatggtgggtgcttggtcagtcatcagctacttcgacggtcatctatgttatgcgcggccggcaagtgtggcagaaaagcgactcatctggcaggtcaaacatgtgggagggggcttgctccctcccacaccgggatgcgttatagcgggtcctttctgcgataggggaacacatcgatgacctttccggcgcgaatcgcatcttgcaggcccttccagtagtcggcgttgtacagctcgccatgcagctcgtcgaacagcttgcgctggccggcgtcggcaaacaggaacggcgggaattcctcggggaacacatccagcgggccgatggagtaccagggctcggaggccatttcatcctcgggggtgcgcggtgcggggatatgccggaagttggcttcggtaaggaaacagatctcgtcatagtcgtagaacaccacgcggccgtgacgggtgacgccgaagtttttcagtagcatgtcgccgggaaagatattcgccgctgccagttgcttgatcgccaggccgtagtcttccagggcttcgcgtacctgggcggggttggcgttgtcgaggtagaggttgagcggggtcatgcgccgttcggtccagcagtggcggataaggaccgtgtcgccttcgacctggaccgtgccggcagcgacttccagcagctcggccaggcactctggctcgaacttgcccagggggaagcgaaagtcggcgaactcctgggtatcggccatgcgcccgacccggtcgacactcttaaccaggcgatacttctcgataaccgtggcgcggttgacgtttttcgacggcgaaaagcggtccttgatgatcttgaatacggtgttgaagcccggcagcgtaaacacgctcatgaccatgccgcgcacgccgggggccatgatgaactggtcatcggtggtggccaggtggttgatcagcgcacggtagaactcggatttgccgtgtttgtagaagccgatcgaagtgtatagctcggcaatgtgcttgcccggcaggatgcgcttgagaaagccgatgaattcggcgggcaccggtacatcgaccatgaaataggaacgggtgaacgagaaaatgatcgacacgtcggcttcgtcggtaatcagcgcatcgatctggatgccacggccttcgcggtgcagcagcggaatgaccaggggccattgttcgtcacgtgtgtagatgcgccctaccaggtaggcacctttgttgcggtagagcaccgaggaaaacaactcgacgttgaggtccgggtctttgcatacccaatccggcaggttttcccgcagttgggcttcgaggcgttgcaggtctgccggcaggtcggcgtagggctcgctgaaactgtagtcagcaaacacctgcgcgagcatctgcgcaatattaccggttggcgtgtagatccgggtttgcgccgcccttgcacggcgctggcttggtcgagtggtgtggatgaacatgcagcggtcactgatcaggtcatgactgaacaggccgcagaagatcgagttgtaccaggtctcggacagttcatcgtcaaagcgcaggtcgatcaggtcgatataggcgcttttcacctgtggccacaggtcgatgtccagcagcgcgaccgcttcgcagctggctcgcaggcgcgcggtgacctcggcgactttctcttcatagaggttgatacgcgccgccgaggcggcctgcccctgctgccactgcgccttctcgaatcgttcgcgggcgccatctgtgatcaggcgaaagtgctcacggtaatcatcaaaaccgtcgaggatcatccgggcgatagcgagggcgggctgcgacatgcgggaaacctcgagcgggtagctggaagcccagagcttagccagtgaacggtggcaggagaaggaagatttttcacgggccgcggtacttagagattgtgtcgaccaggacgctgggcaacactcccccgcctgattggcttaggagttttccgtgagacctgttgataccctctacttgctgggactggcggccatctggggcgcgagtttcctgttcatgcgcatcatcgcgccggaaatcggcaccgtgccgactgcgtttttccgcgtgtcgattgccgccgcggggttgttggtgatcctggcgatgatgcgcgtgagctgggatttccagggcaagttcaagacggtactgctgctgggcgtaatcaactcagggatccctgcgaccatgtactcggtggcggcccaggtattgccggcgggttattcggcgatcttcaatgcaaccacgccgttgatgggtgtgctgattggcgggctgttcttcagcgaacgcctgacaccgtcgaaagtcgcgggggtagccctggggctgcttggcgtagccgtgctcacgcgtgcggggccggtggcctttgatctgcaattgttgatgggcgcactggcgtgcctgctggcgaccacctgctatggctttgccggtttcctggcgcggcgctggctggatcagcgcggcgggttggacagtcgcctgtcggctctgggcagcatgctgggcgctacattgttcttgctgccgttttttgcctacagcgccatcagccagccaccggcgagctggggcggctggcaggtatgggcgtcgttgctggggttggggctggtgtgcacggcattcgcctacatcctgtacttccgcttgctatcgtccattggcccggtcaagtcgatgaccgtgacctttatgatcccgccgttcggcgtgctatggggggcattactgctcgatgaaccgctgtccatggctcacctgtatggcggggtgttgattgccggggcattgtggttggtgctgcgcccggccaaataaccacctcactgtaggagcgagcttgctcgcgaaaaacccgagagcacctcattgattcaggatgccctcgttatcgttgacgttcttcgcgagcaagctcgctcctacaggggtgggtttcagtttttacggaacacaaacaccaggccgacgatgatcaaccccatccccaacaggctcaacacggccagccggttgccgaagatcaggtaatccatcaccgccgtcaccgccggcaccagatagaacaggctggtgacattcaccaggttgccgcgggcgatcagacgatacaacagcagcgttgccaacactgacaccaccaaccccatccacagcaccggcaggtaaaagctcgcattgtgctcgaaatggaagggctggaacggcacgaacaccgcgcacaacaacagcccggccaggtattgcagcggcaacgtgcccaacggattgtcggtgatgcgcttttgcatgatcgagcccaacgtcatgctcgccagcgccagcagcccgaacagcatcccggccagagacatgccggccagcccgatgccttggtacaccaccataattaacccggccaggcccaatcccaggccgaataaccgtcgccaggagcgctggcgttccatcagcaccacggtgaggatcggctgtacgcccatgatggtggccatcaccccaggggggactttgaggtccagggccagcagataaaaaatctgataggcccccagcagcaccagccccgtcgacaccgcatacagcatgggcttgccgggacgtggcagctgcaacttgaggattggcaccagcaccaccagcccggccagggcgatggcaaaccggatcagcagaaaggcaaagggtgaagcatgagccaggcccagcttggagaaaatcgccccgctgctccacagcagcacaaacaggctcgtcgaggccgccgcggccacggattgtttcgaaagaacagacatgagttaccacctgtgatcaggcaaacaagccgactcggtaaataccgaatttcagtaggtttttttcaggtaggcacagggctacagcgaacagctgatcagcccgaaatgccaacacccggcggtgatacgactgcgtacaccggcgtgctactgacaggtggcgggtagtgactgatctgcgcaggctgcttggcgccgcacggcacgaccacagcgttgaccgctgaatcgactaccgctatgcgctgggaagctggcatgtgctgatctttttgaagggataaagacgcgtcgactataaccagccgcaaacttacttggcaatcctttccctacaagcctttttgcgtggaggagttttcatgccgccgaaccaggccgctcgctataatgccgcccagtttttttagaaggatttcacatgattgccctgccctggctgtacctcacgctgctttccattggctatgtcgtggccctgctctatggccaactgggcctgctggctgcggtgtccgtggcgctgctgctggtggccggttacgccgtacgccagcaacgcaacccctgggcccgctacctgggccacgggttgttcatcgtcctggccctgggcctggcgatgcactggctgccgggtttctacaacggccggggcatcgcaccccagcgttttacccctgacgccgtgcccttctcgatgtacctgaaccaggacaaaccactgatcggcttctggctgctattggcctgcccatggattgtggcgcgacggtcattgcgcctgtcgatctgcgtcactgcgctggccctgaccctgaccgccatcgccgccctgggtggcgctgccctgatgggcatgatcagttgggcgccgaaatggcctgaccaggcgtggctgtgggtattgaataacctgctgctggtgacgctggttgaagaggcgctgttccgtggctatatccagggcggcctgagccaacgcttcaaacacctgccctatggcgagaacctcgcgctgctgctggcctcgttgttattcgggctggtacacctgggcgcaggttggcagtgggtgctgctggcgagtattgccggcgtcggctacggcctggcgtatcgcttcggcgggttgggggcggcgattgccacgcactttggcttgaatctgcttcacttcgggctgttcacctatccgatgctggccggctgagctctaacccgctcgtccggattgttgcaaaaataagttaaataaatgcccgccatggccgataacccctgaaagccttgcggattgaacaatcatgcgtaataaccaacccgttacccagcgcgaacgtaccttccccgctcagcaacggttgatctccaccacagatgccaagggtgtcattacctactgcaacgacgcgtttgtcgaaatcagtgggttcacccgcgacgaactgacccgggctccgcacaacctggtgcgtcacccggatgtgccgccggcggtgttcgcgcatatgtggtcaacgctcaaacaaggcttgccatggatgggcattgtcaagaatcgctgcaagaccggtgaccactactgggttaacgcctacgtgacaccggtcttcgacggcaaccaggtggtcggctacgaatcggtgcgcatcaagcccaccgccgagcagatccgccgggccgaagcgctctatcaacgtatcaaccaaggcaagtcggccattccccagcgggacaagtggctgccggtgctgcaggactggctgccatttatcctggtcagccaattgagcttcatgatcggcgccacccttacgtcccaatggggcttcgccttggcggcggcgctgtcggtgccgctgggcctgctgggcctgagctggcaacagcgcggcctcaagcgtttgctgcgcctggccgagcagaccacctctgacccgttgatcgcgcagatgtacaccgacagccgtggcgcccaggcgcgcctggagatgtcgatcctcagccaggaagcgcgtctgaagacctgtcttacacgcttgcaggacaccgccgaacacctcaacgaccaggcggcacgctccaacaccctggcgcacaacagctccagtggcctggaacgccagcgtgtggagaccgaacaggtagccactgcggtcaaccagatggcagcgaccacccaggaagttgccagccacgtgcagcgcaccgctgatgctacccaggaagccaaccgcctgaccggtcgcggtcgcgatatcgccggggaaacccgcgaggcgatccagcggctttcggtggccgtgggcgagaccggcgtaaccgtcacccaattggccaaggacagcgatgaaatcggcggcgtggtcgatgtgatcaaaggcatcgccgaccagaccaacctgctggccctcaacgccgccatcgaagcggcgcgtgccggtgagatgggccgtggctttgccgtggtggctgacgaagtgcgccagttggcccagcggactgcggagtccaccgggcagatccataccctgatcgccaagctgcaacacaccgcggctgcggccgtgcaaaccatggacgccgggcatcgccaggctgaagaaggcgtggcgcgggtgatggaagcggaccaggcgttggtgggtatcagtgaagcggtggcgaatatcaccgacatgaccacccagattgctgcggctaccgaagagcaaagctcagtggccgaagagatcagccgtaatatcagcaccattgcgctgttggcggatcagacttcggaacaagcgatgagctcggcgcagttgagtgaagagctgactcatacggcgaatacgcagtattcactggtggagcgatttaatcgctgaatatggctaccaagaaaaaatcctcgataagcatcggggattttttttgcctccggcatcaaggccaacatttgccaaatcaaaaaagggccgatgtctactgtcatttttgacagtagatgaagtctggttcggggtgtagttttcaacaaacaaacttgacccccaatgggtctttatcgtttgactgagaaggagttcatcatgagcatatatgacatctacatcccaccagccactcatcgccagagctctgagtattattttaagtggaaaattggcaacaatcctgagacggaggcggagcgcttggaatttggcttgagcagagatacaccaacccaccgctggctattgtcgggaataaccggaagaaccgatgaacaaaactattattctttttcatttcggattccttatataaatgaagatccgatagatcggacttacacacttgcaaacggcttgttgttttcccatgctcacagcatccctccggtcgatggctgggacggtgttcgcgtcattcaagccgagtgggccgaggtccatatcaagcttgatccccgtgccggtacgactgaaggaaccttctccgcacgtttcatagcagacggccttcctcttgaacccgaaggaagcttcaatatgatcagagatgatgtaccaaaccagctctgaagttatcaacctactggatcaatcctgttggctaggtaaaaccgtagaagcagagtaacagcagcaaacagcttttattgcacaggtgctcgccgagcgatgtaactcagcgagcaccgccaaacttaccccacctgaaaatcaacgccgcagatactcaacaaccttgagtgccgcagcctccagatgctgctcatgactgaactccgatgccttcaacggcttcaagtcatgatcccccgccaccagccacatcacctcaatgcccggcgacaagtcataaccctccaccgccgccctattgcccagcgcatcgcgctcgccctgcacaatcaatgtcggtgtcttcaacccggtcagatgctcaacccgtggcttctgcggtttacccactgcatagaacggataacccaggcacaccaagccatcggcccccaactcgtcggcgaccaaactcgccatgcgcccgcccatggacttgccgccaatcgccagcttcccagcgacatgacgtcgcacctcgccatacacctcgcgccagcactccagcagtttcggcgccgggttcggcgggcgcttgccaccatccacacggcgctgggccatgtacgggaactcgaagcgcaatacgttcaccccatgcccggcaaggcgtgcagccatgtcgctcatgaacgccgagtccatcggcgcgccggcgccatgggccaggatcaacgtgaccggctcgcccgaagccgtgcccgtggcgacatcccacagccagccgcgttcgcacacacactgcgcccattgatccccgtcaatactggccttgtgctctttgcccatgcttgcctcgctttttagtctgcctataactccagcccaagtgccgcatctgcttgggttgaaccgtggatggggaaccatgaacactactttaagtaccgcctataactacaaggtggtccgccaattcgccattatgacggtggtgtggggcatcgtcggcatggggctcggggtttttctcgccgcccaattggtttggcctgcgctcaatttcgatttaccttggaccagctttggaagactgcgcccgttgcacaccaacgcggtgatctttgcctttgggggctgcgcgctgtttgccagctcgttctactcggtgcagcgcacctgccagacccagctgttcgcgccgaaactggcagcgttctgcttctggggctggcagctggtgatcctgctggccgcgatcagcttgccgctgggctacaccagctccaaagaatacgccgagctggaatggccgatcgacatcctcatcaccatcgtctgggtcgcctacgccattgtgttcttcggcaccgtggccaagcgcaacaccaagcatatctatgtgggtaactggttcttcggcgggtttatcctcaccgtggcgatcctgcacatcgtcaacaacctggaaatcccggtcagcctgaccaagtcctactcgctgtacggcggtgcgacggatgccatggtgcagtggtggtatgggcataacgctgtgggctttttcctgaccgcgggctttctggggatgatgtactacttcgtgcccaagcaggccgaacgtccggtgtattcctatcgcttgtccatcgtgcacttctgggcgctgatcaccctgtacatctgggcaggtccccaccacttgcactacaccgcgttgccggattgggcacagtccctgggcatggtgatgtcgctggtgctgctggccccgagctggggcggcatgatcaacggcatgatgaccctctcgggcgcctggcataagctgcgcagcgacccgatcctgcgcttcctggtggtgtccctggcgttctacggcatgtcgacgtttgaaggcccgatgatggcgatcaagaccgtcaacgccctctcccactacaccgactggaccatcggccacgtacacgccggtgcactgggctgggtagcgatgatctccatcggcgcgctgtaccacatgatcccgaaagtcttcggacgcgagcagatgtacagcctcggcctgatcaacgcgcacttctggctggccaccatcggcaccgtgctctacatcgcctcgatgtgggtcaacggcatcgcccagggcctgatgtggcgtgcagtcaacgaagacggcaccttgacctactccttcgtcgaaaccctggtggccagccacccaggcttcatcgtgcggctggtgggtggtgcgatcttcctcaccggcatgttgctgatggcttacaacacgtggcgcaccgtgcgttcggcgcaaccggccgaagtcaccgccgcagcgcagatggcctgaggagtcgatgatgaaacacgaaacgattgaaaagaacgtcggcctgctgatgctgctgatggtgctcgccgtgagcatcggcggcctgacccagatcgtcccgctgttcttccaggacgtgaccaacaaaccggtggaaggcatgaagccctacaccgcattgcaattggaaggccgcgacatctacatccgcgaaggctgcgtgcagtgccactcgcagatgatccgcccgttccgcgccgagaccgaacgctacggtcactactcggtggcaggcgaaagcgtgtgggaccacccgttcctgtggggctccaagcgcaccgggccagacctggcccgcgtcggcgcgcgctactcggacgactggcaccgcgcgcacttgtacaacccgcgcaacgtggtaccggagtcgaagatgccggcctatccatggctggtcaccgccgccgtcgacagcagccacaccgagaccaagttgaaggtgatgcgcaccctcggcgtgccctacaccgacgacgacatcaatggcgcggtcgccagcctcaagggcaagaccgagatggacgcgctggtttcctacctgcaagtgctcggcactgccatcaagagcaagaggtgagccatgggatttgaattcgatgcaggcaccatccgcggcctaggcacgctggtggtcgctatcgcctttatcggcctgtcgctgtgggtgttcagcccacggcgcaagtcggagtttgacgatgcgaccatgctgccgtttgccgatgaaccctccccaaccgacgctcaagcagagccagcaacaaggagcactcggccatgactactttttggagtacatggatctgcgtattgaccctgggaagcctgatcggcctgacctggctcttggtcggcacccgcaagggcgaaaccaagggcagcgtcgaccagaccatgggccacgccttcgacggtatcgaggaatacgacaacccgctgccccagtggtggttcatgctgttcgccggcaccctggtgtttgccgtcggctacctgatcctctacccgggcctgggcaactggaaaggcgtgctgccgggttatgaggacggctggacccagaccaaggagtgggacaaggaaatggccaaggccgacgccaagttcgggccgatcttcgccaaattcgcggcgatgcccgtggaggaggtcgccagggacccgcaagcgttgaagatgggcggccgcctgttcgcctccaactgcgcagtgtgccatggctcggatgccaagggcgcctacggcttccccaacctggcagacagcaactggcgctggggcggttcggccgaagcgatcaaggccaccatcatggccggtcgccacgcagccatgccggcctggggtgaagtgctgggtgaggatggggtgaagaacgtcgccgcttatgtgcgccacgacctggccaagctgcccttgccagcggacaacaccgctgacctggccgccggccaagccgcattcagcaccacctgcgtggcctgtcacggcccgcaaggccatggcgtggaagccatgggcgcgccgaacctgaccgaaccaagcgggtttatctacggcaccagcctggcgcagttgcagcagaccatccgccatggtcgccagggccagatgccggcccaggaagtgctgcagggcaatgacaaggtgcatctgctggcggcgtacgtgtatagcctgtcccataacgctgatggtgcaacgccagacagcccgaccaagtaaccgctccgctttactgtaggagcgagcttgctcgcgaagaacctgaggacaccgcatttatccggaataaacgcggcgctttggatttcttcgcgagcaagctcgctcctacagtgatccaatgtcgtcttcatttgcgcgaccaagtgtcgcaccctcgcaacacccaacttcccccccctcatattcgggtctacgcttgttcccacagtggagcaattctggcgtaggcgacggtattcgtcgcgccctctaaaattcctgtccacttgatcagctttcgatttcggatttaatccttacgccaaacatggaaagggcgcagaatctggcgtggaacgcattgatacaggtcagccattgcgttgcaatggcccctcgctttctacatacttgcgaccgattttacctataaaaaaacctaaaccgtggaaccttagaatgagcacagcaatcagtccgactgcttataactataaggtagtccgccagttcgccatcatgacggtggtctgggggatccttggcatggggctcggggtgttcatcgcctcgcaactggtctggccgcaattgaatttcgacctgccatggacgaccttcggtcgcctgcgcccgctgcacaccaacctggtgatctttgccttcggtggatgtgcgttgtttgccacttcctactatgtcgtgcagcgtacctgccagacccgcctgatctccgacagcctggctgccttcaccttctggggctggcaggcggtcatcatcggcgccatcatcagcctgcccctgggctacaccaccaccaaggaatacgccgagctggaatggccgattgcgattttgctcgcgattgtctgggtgacctacgcagtggtgttcttcggcaccatcgtcaagcgcaagaccaagcacatttacgtgggcaactggttctacggggcattcatcctggtcacggcgatgctgcacatcgtcaaccacgcgtccttgccggtcagcctgttcaagtcctactcggcctactcgggagcgacggatgcgatgatccaatggtggtacggccacaacgccgtaggcttcttcctcaccaccggcttcctcggcatgatgtactacttcgtaccgaaacaggccgagcgcccgatctactcctatcgcctgtccatcgtgcacttctgggcgctgatcaccctgtatatctgggcaggtcctcaccacctgcactacaccgcgctgccggactgggcacaatcgttgggcatggcgatgtcgatcatcctgctggccccaagctggggcggcatgatcaacggcatgatgaccctctcgggcgcctggcataagctgcgcaccgacccgatcctgcgtttcctggtggtgtccctagcgttctacggcatgtcgaccttcgaagggccgatgatggccatcaagacggtcaactcgctgtcccactacaccgactggaccatcggccacgtgcacgctggcgctctgggctgggtggcgatgatttccatcggcgcgctgtaccacatgatccccaaactgttcggccgcgtgcagatgcacagcgtcgggctgatcaatgcgcacttctggctggccaccatcggtaccgtgctctacatcgcctcgatgtgggtcaacggcatcacccagggcctgatgtggcgtgcgatcaacgatgacggcaccctcacctactccttcgtcgaagcgctgcaggccagccacccgggctttatcgtgcgggccctgggcggagcgttctttgccagcggcatgctgttgatggcctacaacgtctggcgcaccgtgcgtgcctctgaccctgtagaagccgaagccgccgccaagatcgccgttgtgggagcccactgatgaagcatgaagtagtcgagaagaatatcggcctgctggccttcttcatggtcctcgccgtgagcattggcggcctgacccagatcgtgccgctgtttttccaggacgtgaccaacaagccggtcgaaggcatgaagccgcgcaccgcccttgaactggaaggccgcgacgtctacatcgccaacgggtgcgtaggatgccactcgcagatgatccgcccgttccgtgccgaaaccgaacgctacggccactactcggtagcaggcgaaagcgtgtgggaccacccgttcctgtggggctccaagcgcaccgggccggacctggcccgtgtcggcgggcgttactccgatgactggcagcgtgcgcacctgtacaacccgcgcaacgtggtgccggagtcgaaaatgccggcgtacccgttcctcgtggaaaacaagctcgacggcaaggacaccgcgaagaagatggaagtcttgcgcaccctgggcgtgccctacaccgacgaagatatcgccggtgcagccgccgccgtgaagggcaagaccgaaatggacgcattggtggcctacctgcaaggccttggcaccatcatcaaaagcaaacggtgacctacatggatatcgggatgattcgtggcctgggcaccgttgtggtgatggtggcctttgtcggcctggcgttgtgggtgttcagcccgcggcgcaagtcggagtttgacgacgcgaccatgctgccctttgcggatgaccccgaagccatcaagcacgtcgagcaagcttctaggagtaacaaagaatgactacgttctggagtctgtacgtcacagtcctcagtctgggtaccatcttcgccctgacctggctgctgctgtcgacccgcaagggccagcgcaccgagcaaacggacgagaccgtcggccactcgttcgatggcatcgaggagtacgacaacccactgcccaaatggtggttcatgctgtttgtcggcaccatcgtctttgctcttggctacctggtgctgtaccccggcctgggcaactggaagggcttgctgccgggttacaactacctcgataacgacaagcaaaccgctttcgccaacggccagaccggctggaccggtgtgcatgagtgggaaaaagaaatggccaggtcggacgccaagttcgggccgatctttgccaaatttgcctcgatgcccattgaagaagttgccaaggacccgcaagccttgaagatgggcggccgcctgttcgcctccaactgctcagtgtgccacggctccgacgccaagggcgcgtacggcttccccaacctgaccgacgccgactggcgctggggcggcgagccggagaccatcaagcaaaccatcatgcaaggccgccacgcggtgatgccaggctgggccgaagtcatcggcgagcaaggggtggctgacgtcgcgggctttgtggtgaccaacctcgacggccgcaagcttccggaaggcgccaaggccgacgtagccaacggtgagaaactcttcgccgccaactgcgtggcctgccacggcccggccggtaaaggcacgcctgcaatgggcgcgccggacctgactcatccgggggcgtttatctacggttcgagctttgcccagctgcagcagaccattcgctatggtcgccaaggccagatgccggcgcaggagcaactgcaagggaacgataaggtgcatttgctggcggcttatgtgtacagcttgtcccatggggataagaaggccgaagaacagtaaaacctcgaaaacaacaaagccccgcgcagtgaaaactggcggggcttttttgtagatggctgttacaactacctgttaatgctaagcagcggcctttatcgagcgtccgggccggcagttctttcctcatgttcagtgaacagcgcatcctggtaattatggatatcctgccgatcaaacttgcggttactctcacctttttcgtccaagtccagggaagccgcgaagccagcgcggttgaggacctcaaggacgaggacctggtccgccagggtgaactggttaccagccaagcccaaggctatgtactgcaaataatccagcgtcaaaaaacccggggcttcagggtccacaaaccgctcgaagttatcacccaaggtcctggctagctcataccggtccaggccggcgtaaagattggacatttcacgcaacgttgcacgtgtctcgctggcaggcaggggcgcagggcctggaacgttataagtcgcaggattcggaacgataatcacgtggtcaccttactggtatgtaatcccactcccaccatgggcattgggtgataaatgagtgttcattttcgtcgttccagttccagcccatgcgtacaagcctacagggtgctaaaaggcgacccctgcctgttctatcaaaatactactgttctaaaaaacgcccgccgtgcgttacgcaatggcgcatgatagatatccaactgctctaaagtgcgcctatcaatgatgccattcaaattctccaaatcgactttattaaaaacattcatgctatcaagcttactcaaaagaccgggcattataaaaatcattttggccagttcaatgttgtcggctgagatgccagatttacgcccgctgacaatatccatcagcgtacccaccgtaatagttcccggggagctgggctcttcaaacacattgaaattacgcaatagcctttccactacctcgccctctatcaccttggaatcctgaggtaccagattccccccaaacgatggctgagtgcgaaaactttctagcgtattcgcgtaatgtggcacaccatgatcgggagccggcagccccaacggcaagtcggccaacccagttaaattagctgacagccgagcagcgtcatcaataatcatttaacacctcaactaaaataatttagcccatcgcactcgatggacagtgaattagttaaaacccccaccaaacagttccgccagaaaaacgagaacctgtaagcgtgtttgtatccattaaaccgataacgtccgtggtggacgaagttcaaacacaggtacaagttaattaaaagcatcaaccgcaaccagtgcgcattgtaagtgctggaaatttcgctgatgaactgcatacatattgaatgtgtcaggccaaaccgacgaacgtgatgcgctgaccgccgccgaagcgctgcttcgtgggcatcacacgcaacgtcaacgacctcggcttcagggggataccgattaatccacagacgaatgacctgcctgcctgcaaaaagcgtccatactttacaagtcaattgatccagatcacgtacaccatcaattgatttctcccaacgcgaccaaaggtcgcaccccttacataccctcgggggcgtatcatcaggccactgcaacaccccccaatttgaccccggctggcacgtactggccgaggcaaatctccaccgccgtgggatgcaatgatgagcaaccagataccggtacatgacgttaccccgcctgccaaaaacgcgagcaacagcgtcgacctctacgcctcgcgagagaaaatctacacccgcgccttcaccgggctgttccgtaatttgcgcatgctcggtggcgccggcttgttcctgctctacttcggcacggtgtggctgaattggggcggccaccaggctgtgtggtggaacctgccggagcgtaagttcttcatttttggcgcgacattctggccccaggatttcatcctgctctcgggcatcctgatcgttgcggccttcgggctgttctttatcaccgtgtacgccgggcgtgtgtggtgtggctatacctgcccgcaaagcgtgtggacctggatcttcatgtggtgcgaaaaggtcaccgaaggcgaccgcaaccagcgcatcaagctggacaaggcgcccatgggcgccaacaagttcctgcgcaagttcagcaagcacacgctgtggctgttgatcggctttgccactggcatgaccttcgtcggctatttttcgccgatccgcgagctggtgttcgacttcttcactggccaggccgacggctggtcgtatttctgggtgggcttcttcaccctcgccacctacggcaacgcgggctggctgcgcgaacaggtgtgcatctacatgtgcccgtatgcgcgcttccagagcgtgatgttcgacaaagacaccttgatcgtttcctacgacccacgccgtggcgaagtacgcggcccgcgcaaaaaaggcgtcgactacaaggctcagggcctgggcgattgcatcgactgcaccatgtgcgtacaggtgtgcccgaccggtattgatatccgcgacggcctgcaaatcgagtgcattggttgcgctgcctgtatcgatgcctgcgacaccatcatggacaagatggaatacccccgcgggttgatcagctacaccaccgagcacaacctgtccgggcagaagacgaataagctgcgcccacggttgatcggctacgcgctggtgctgctggcaatgatcagcctgctggtcggcgcatttttcatgcgctcgctggtcggcttcgatgtcagcaaggaccgcgtgctgtaccgcgaaaacgccgaagggcgcatcgagaacgtctacagcctgaagatcatgaacaaggaccagcgcgaccacacctacgtgctcgacgccgccggcctgccggacctcaagctgcaaggccgacgcgaaatcaaggtagctgccggcgatatcgtcagcatgccggtagagctgtcgagtgcgccggagcagttgccgtcgagcaccaacgaggtgacgttcatcctcaaggacgccgatgacaccagcgttcatattgaagccaagagccgattcatcggcccacaagtccgttaacagggaatagaaccaatgtcctcagccactgccgcaagcccttggtacaagcacctctggccctggatcatcattgcgatcctggcctgctcggtgaccctgaccttgtccatggtgaccatcgcggtgaacaacccggacaacctggtcaacgacaactactacgaagccggcaaaggcatcaaccgctccctggaccgcgaacgactggcgcagaccctgcaattgcgcgccaggctgcacctggatgaactgaccggcgaagtcgaactgcaactgaccggcaacagcggcccggcgaccctggaactgaacctgatttccccaacccagccggagaaggatcgcaagatcgtcctggcccgtagtgacactgggcagggccgctatatcggccaggtcgccgacaaggtcgaaggccggcgcttcgtggaattgctcggcgtcgaaggtgaccagacctggcggatgttcgaagaggaagaggtcagccatgacaaggacttgctgctgggtgacgagccgttgcagggtgctgaagacctgaagcagtaaaaaaagccgcgttacgcgcatcgcgggcaagcccgctcccacaggagaacgcaaccgaatgtgggagccgggcttgcccgcgatgaggccctcccagccaccaaagaccttgaaccatgaccaccccctgctaccactgcgccctgcccgtccccgccggcagccggtttaccgcccaaatcctcggcgagcgccgcgaactgtgctgcccgggctgccaggcggtcgccgaagccatcgttgccggtgggttggaaagctattaccagcaccgcagcgaagcctcggccaaccctgaggcattaccggtgcaactggtggatgagctggcgctgtacgaccgcgccgatgtgcaaaaaccctttgtgcgccacgaaggcgaccttgccgaagccaccctgttgatggaaggcatcagctgcgccgcctgcggctggctgatcgagaagcacctgcgcagcctgcccgccgtagccgaggcccggctgaacctgtccaaccaccgcctgcaggtacgctgggccgatgggcaattgccgttgagccaactgctcagcgaactgcgccatatcggctacgccgcccacccttaccacgccgaccgcgccgccgagcaattggccagcgagaaccgcctggccctgcgccaactgggcgtcgccggcttgctgtggttccaggcgatgatggcaaccatggccacctggccggagttcaatatcgacctgagcccggagctgcatgtgatcctgcgctgggtcgcgatgtttctgaccacgcccattgtgttctacagctgcgcaccgttcttcaagggcgccctgcgcgacttgcgcacgcgccacctgaccatggacgtgtcggtgtccctggcgattggcggcgcctacatggcgggcatctggacggcgatcaccggtgtgggcgaattgtatttcgatgcggtgggcatgtttgcgctgttcctgctggctgggcgttaccttgagcgtcgcgcccgggagcgcaccgcagcggccaccgctcagttggtcaacctgttgcctgcctcctgcctgcgcctgaaaaatgacggccagagcgaacgcatcctgctcagtgagttggcgctgggtgatcgcgtgttggtgcaccccggtgcggtgctgccggcggatggcgtgattctcgacggccaatccagcatcgatgaatccctgctgaccggcgagtacctgccacaaccccgggggattggtgacagcgtcaccgctggcactctgaatgtcgaaggcgcgctgagcgtcgaagtgcgcgccctgggccatgacacacggttgtccgccatcgtgcgcctgctggagcgcgcccaggctgagaagccccgcctggcgcagatcgccgaccgcgccgcgcagtggttcctgctgtgctcgttgatcgccgccgcgctgatcggcctgctgtggtgggagctggacccatcccgggcgttctggattgtattggcgatgctggtggccacgtgcccgtgcgcgctgtccctcgccacgccgaccgccctcactgctgccaccggcaccttgcacactcttgggttgctattgactcgtggccatgtgcttgagggcctgaaccagatcgatacggtgattttcgacaagaccggcaccctcaccgaagggcgcctggcgttgcgcgccatccggcccctgggcgcgctggacagcgaccaatgcctgagcctcgcggccgccctggagaaccgctcggaacacccgatcgcccgcgcctttgggcgtgcgccgctggccgccgacgaagtgctcagttcccccggcctaggcttggaaggtcgcgtgggtgagcggcacttgcgtatcggccaaccggcgtttgtctgcgcgctcagtggttgcgcgatgccggcggcgccggatgaagccgggcaatggctgctgctgggcgatcgtaacggcgcactcgcctggttcgtgctggacgaccgcctgcgcagcgatgcaccggccttgttggccgcctgcaaggcgcgcggctggcgtacgctgctgctctcgggggacagttcgccgatggtcgccagtgtcgcccttgagctgggcatcgacgaagcccacggtggcctgcgccctgacgacaagctgcgggtgctacagaatctgcacaaggaaggtcgcaaagtgctgatgctcggcgatggcgtcaacgatgtgccggtgctggccgccgctgatatcagcgtagccatgggctcggccacggacttggcgaaaaccagtgccgacgcggtgctgttgtccaaccgcctggatgccttggtgcaggccttcagcctggcgcgacgcactcgtcgggtaatcattgagaacctgctgtgggccgggctgtacaatggccttatgctgccgtttgccgccctgggctggatcaccccgatctgggcggcgatcggcatgtccctcagctcattgaccgtggtgctcaacgccttgcgcctgactcgcctgccgagcgcgccagccaccggcaccaccttgataacccgcccgctgccggcctgagccgcgtgggcatggagtgcagatgccagctctatacgtgatgattccggcggcgctgctgttagtgggtgtggcgatctacatcttcttctgggccgtggacagtggccagtacgaggacctcgatggcccggcccacagcgtgttgttcgacgatcaggatccgaatcacctggccgccgtcgacgaagccaacggccccgagcaaccgcccaaagccccacccaatgcttgagctggcgcccctgctggtctcggcgctgatccttgggctgctcggcggcgggcattgcctgggcatgtgcggcgggctgatgggcgcgctgaccctggcgatccccaaggcgcaacgcagccgccgctttcgcttgctgctggcgtacaacctgggacgcatcctcagctatgcaacggcggggttactgattggcctggccggctgggcagtggccaacagcccggcggcgatgttcatgcgcgtgctcgccgggctgctgctgatctgcatgggcctgtacctggccggctggtggagcggcctgacccgtatcgaaagcctcgggcgtggcctgtggcggcatatacagcctgttgccaaccgtctgctgccggtatccagcctgccgcgcgccttgctgctgggcgcgttgtggggctggttgccgtgcgggttggtctacagcaccctgctctgggcggcgagccagggcaatgcgctggacagtgcattactgatgctggccttcgggctgggcacctggccggtgctgctcgccaccgggttggcggccgaacgcgtgaccgcgttattgcgcaagcgcagcgtgcgtgtcgccgggggcgtgctggtaatgatcttcggtatctggacgctgccgggcccgcatcagcactggctaatggggcattaaaggccatgtggcatagcgccgctccccgttgatgcaaatcaagatgcctgcccagccctgcccctagactcggtccactagccattcccggggaccgcccgcatgctcgacgccattcgttgggacacagatctgattcaccgctacgacttggcggggccgcgctacacgtcctaccccaccgccgtacaatttgacagccaggtcggcacctttgacctgctccacgcgctgcgtgacagccgcaaggccgtgcggcccttgtcgctatatgtgcacgtgccgttctgcgccaacatttgctactactgcgcctgcaacaaggtcatcaccaaggaccgcggccgcgcccaggcctacctgcaacgcctggagcaggaaatccagctggtggcctgtcacctcgaccccaagcaaacggttgagcagctgcatctgggcggcggtacgcccacttttctcagtcacgacgaacttcgccaggtgatggcctgcctgcgccaacatttcaatttgctggatgacgattcaggcgactacggtattgaaatcgatccacgcgaagccgactgggccaccatgggcctgctgcgcgagctgggcttcaaccgcgtaagcatcggcctgcaagacctcgatcccgacgtacaacgggcggtcaatcgcctgcaaagcctggaagaaacccgcgcggtgatcgacgcggcacgcaccctgcaatttcgctcgatcaatatcgacctgatctacggcttgcccaagcagtctccgctgaattttgcgcgcaccgtggaggaagtcatccgtttgcagccggaccgcctgtccgtattcaactacgcgcacctgccagaacgcttcatgccgcaacggcggatcaacatcgacgacctgccctcgccggctgagaaactgctgatgctgcaaaccacaatcgagcaattgacccaggccggctaccgctatatcggcatggaccactttgccttgccagacgacgaattggccattgcccaggaagaaggcaggttgcagcgtaacttccagggttacaccacccacgggcattgcgacttgattgggcttggagtgtcggcgatcagccaggtcggcgacctgtactgtcaaaacagcagtgatctgaaccagtaccagaatgccttggcgggcgcgcagctggcgaccagccgtggactggtctgtaccacggacgatcgtctgcgccgggacgtgatccagcagttgatctgcaatttcagcctggtattcgaagggatcgaacagacctacaacatcgattttcgcggttatttcaccgagctatggccgcaactggagacgatggcgaccgatggcttgatcgagctggatgccctgggcattcgtgtgctgccggccgggcgcttgttggtgcgctcggtgtgcatggtgttcgatgcctatctggagcaccagaacaggcagcgattttcgcgggtcatctgacggtggttacttcatcgccagcccggcagtcttgatcgcatcggcgccgctcatgtctttcatggctttggccagcgacgcctgagcgctggtcaacccggcctgcagtgcgctcaacgccgattgcaggcccgaaagccgggcacgtgcctgttccggcgagaggtttttatcagccatcaccgccgccatctcagcctgtttctcggcaatctgtttcttgatctcgcgaatcatcttcagcaggttcttgacgttgtccgccaggccactgtcatcgatatcactgtttgaggttttctccgccgctgcagctttcatcgcggcaccagaaatggtcactgaaacggcaggcttggctgcatccgtcgtcgggatcgcggcaacatcggagtctaccgccttcttggcttcgggcagtgcctggacctgggtgcgcgaggcgagttgagtactgagggataacatggtttgagccacccgcgttcatattcgatggcagtgctatcggccgcctcgggcaaatctttatattccgccaggttttttgtacatgctggcttcggtgccccccagtgcgttacccttacgtcttatgtgtgttttcccacaaggatttaagaaatgtctgagccagccaaactgcgcgctcacagccaggttcactgcaaggattgcagcctggctcccctctgcctgccactttcgctgaatctggaagacatggatgcgctggacgacatcgtgaaacgcgggcgcccgctaaaaaaaggcgagttcctgtttcgccagggcgacaagttcgattcggtctatgcagtacgttcgggcgcgttgaagacattcagcctaagcgatggcggtgaagaacaaatcactggcttccacttgcccagcgagttggtcgggctgtcggggatggacaccgaggttcacccggtgtcggcccaagcgctggagacgacctcggtgtgcgaaatccctttcgaacgcctcgatgaattggccctgcaattgccgcagttgcgtcgccagctgatgcgcgtgatgagccgcgagattcgtgacgaccagcaaatgatgctgctgctgtcgaagaaaaccgccgacgagcgcatcgctacattcctggtcaacctgtcggcgcgcttccgtgcccgtggtttctcggccaaccagttccgcctgagcatgtcgcgcaatgaaatcggcaattacctggggctggccgtagagaccgtgtcccgcgtatttacccgcttccagcagaaccagctgattgccgccgagggcaaggaagtgcatatccttgatccgatccagctgtgcgcactggccggcggttcactggaggtctgatccagactgcggccgcgccaatcggcgaggccgcaggtatacttcgagtccgttttccgcccaggactctgcgacgatgactttcgattcgttcgacatcaaatccctgattcgccccgtcatcgacttccccaagcctggggttatctttcgtgacatcactcccctgttccaatcgccccgcgccctgcgcctggtcgccgacagctttgcacagcgttacgtcgaggccgacttcagccatattggcgcaatggatgcgcgtggtttcctgattggttcgatcatcgcctatcagctcaacaagccgctgatcctgtttcgcaagcagggcaagctgccggcggacgtgcttgccgagggttaccagaccgaatacggcgaagccttcctggaagtgcacgccgacagcctgtgcgaaggggattcggtgctgatgttcgatgacctgatcgccaccggaggtaccttgatcgctgcggctaacctggtgcggcgcatgggcgcgaagatctttgaagccgcggcgattattgatttgcctgagctgggtgggtcgcagcggttggaagacatggggattccgacgttttgcctgacgcagtttgggttgactgaaagatagtctttgtcaggactggcctcatcggcagcaagccccctcccacattttgacttgtgaacacaatcaagaatgtgggagggggcttgctcccgatggggcccgaaagaacaccgccggtcaaagccccatctgcttgctgatgatttcgttcatcacctcccgcgtccccccaccaatcgacagaatccgattatcccgatacagccgctccaccaggctgccacgcatatacccctgcccacccaatatctgcactgcgtcataggtcacccgatcagccgtgtcagtggccaggttcttggccatggaaatctccttgatcacgctcttgccagcggccatcctggcggcctggcgataggtgaactcccgggagacttccacggcggtggccatttccgccagccgatgcttgagcacctggaatttgccgatgggcttgccgaatgcttcgcgctgggcggcccacttgaggctctcctccagggccagttgcgcggtcatgttagccatcaaggccagggccaggcgctcgctctggaaattgcccatgatgcaggcaaagcccatattttcagcgccgataaggttgccggcgggtacgcggcaatcgtcgaagaacagttcggcggtgtccgacgcccaccagcccatctttttcagcggctggccgacagtgaacccgggcgtgtctttctcaatcatcagcaggctgatgccgccaaagcccgggccgccggtgcgcaccgccacggtataaaaatcagcacggatgccactggtgataaaggtcttggtgccgctcacacggtaatcttcgccctcgcgtacggcacgggtctgcaggttggccacatccgagccgccgctgggttcggtgacggccagcgcgatgatcttctcgccgctcaacacctggggcgccacgcgctcacgcacctcgggcctggcccatttgacgatggggggcaggccgatatccagggagcccagccccgccaccacaccaccggaaccacagcgcatcaattcttcgctggcggccaccttggcgaacagatcaccttcgtggctgccgcctagcgattccggataaccaatccccagaatgcccgccgcgcccgccttgagatagagctcgcggggaaagctctcagcctcctcccattgctcaatacccggcaacatttcgcgctcgacaaaacgacgcacgctgtcgcggaccaattggtggctgggatcgaagtattcctgataggcagacatcggcaagctccatggcgagatggagcgaacttaccaagcgcttgcttggttatcaagccatacacagttatcactgacaccacaaaactactgtgggagggggcttgctcccgatagcggtggatcagccaataactctgtcgactgacacacagcaatcgggagcaagccccctcccacatttgatcctgctgcggatgttagagcgcgatcggcttacgacccgcgaacgagtgggccaaggtgccaccatcgaccagctccaactcgccacccaacggtacaccatgggcaatacgcgaggtgatcaagcctttattggtcaacaactgggcaatgtaatgcgccgtggcttcaccttccacggtcgggttggtcgccaggatcacttcggtaaaagtgccctgcgcttcaattcgtgcgaccagttgcggaataccgatagcctccggccccagcccgtccagcggcgaaagatggcccttgagcacgaagtagcgtccgcgataaccggtctgctccaccgcatacacatccatcggcccttccaccacgcacagcaaggtgtcgtcacggcgtgggtcggcgcattgcgggcagagctcttcttcggtgagggtgcggcattggcggcagtggcccacgccttccatggcctggctcagggcctgggccaggcgggtgccgccgctgcgatcacgctccagcagttgcagggccatgcgctgggcagttttctggccgacaccgggcagcgtgcgcaaggcgtcgatcagttggcgaatcagggggctgaagctcatgggcgaagggtccgacaaaacaacgagacgcggtttatacccgcgccccggattagcgtcaaatactcaatcctgcgcgacgcgcaccaccaacttgccgaagttgcgcccctcgagcaagccgataaaggcttcgggcgcctgctccaggccatcgaccacgtcctcgcggaacttgatcttgccatcgcgcacccacggcgccatggcgctgaggaactccggctggcggtcgccatagtcgtcgaacacgataaaaccctggatacgcacgcgcttggtcagcaaggtacgctgcagcgccggcaggcgatcagggccgctgggcgcttcgtgggcgttgtaaccggcaatcaacccgcacagcggcacgcgcgccttggggttgagcagaggcagcaccgcatcgaagactttaccgccgacattttcaaagtagatgtccacgcctttgaaacaggccagcgccagttcctgggcaaagtccgcgctcttgtggtcgatacaggcatcaaagcccagctcatccaccacatagcggcacttgtccgcaccaccggcgatgcccaccacaagcaagcccttgagcttggccacctggcccaccaccgagcccaccgcgccggacgcagcggccaccaccagggtttccccggccttgggctggccgatgtccatcaggcccatgtaggcggtcatgcccggcatacccagcacacccaacgccatcgacggactcgccaggcccttgggcactggcatgaggttgctcccatcgcaaatgcagtggctctgccagccggttgcgcccaccaccaggtcgcctacctcaaatttcgggtgacgcgattgctcgacacggctgacagcaccaccggtcattacctcgtcgatttccacgggcgcggcgtaggacggtgcgtcgctcatgcgcccacgcatataggggtccagcgacagatacagcgtcttcaacaacacctgaccgtctgccagctccggcaggctcacacgttcaaggcgaaagttctccggcgtgggtgcgccttgagggcgtgagaccaggacgatgcgttggttgagcgtcatttcttgaggcatcagcggggctcctgttatcaatgagaattcaacggtataaggtgcagaccatgggtaacgggttggggttcgatgtttcgtcggcccaaaaaaatgccaggcgcaatgcccggcatttgaatctagccaaagtctgtatcagaacggcagcttcatgcccggtggcaattgcatgccagcggtcacgccggacattttgtcctggctgttggcttcgatcttgcgcacggcgtcgttgacggccgcggcgaacaagtcttcgagcacttcgcggtcgtcgtcgctgacgccttccagcaggctcgggtcgatgctcacgcgcttgatgtcgtgacgaccggtcatcaccacgctgaccatatcgccaccggctttaccggtgacttcggcgttggccagttcttcctgcatcttggccatcttttcctgcatctgctgcgcctgcttcatcaggccggccatgccacctttcatcatgggaatcacctcaaaagtacgtggatcaagttagtagcccggagtcatgacgcctgggacaccggggcttcgacaggttcaatagtatcgtgacggacgaccgcaccgaactgttgcatcatttgttggatcagcggatcagcgtggatcgaatcctcggcctcgcgttgacggttaaggcgccgacgagtcgccgcctgggccggagtttcctgctcgggcttgatcagctcgatggcgatggtcagcgtgcgcccatggtactggttgagcgcatcgttgagccgacgctgctgggtggcattgaacaaggcgctatgggccgggtccaggtgcaacagccagtggtcgccctcgatggaaatcagggtgcagttggcggcgatactgccggtcatgccggagatcggcaatttcggaaacaattccagccattgcagggccaagccggtggccggggccgcagccggttctgcctcgggctcgggcgctggctcggcggtatgctcactggccaattcgtccaggtagctgtaggccgagtccatgtccggctcgatgtagtcttcatccagcggcggttcatcgtccaggtcaatgcctggggttgcagcctcgacctgggcgaccgtcggctcggggaccggtgccgacacccattcaggggcatccggcacgacgctgtccggggtcggcgccggcatcggcgtcagctcgggctgctcgccggcggtttccagcacgggctccacggcgggttgttgctcaggctctggctcggcttcggcttcgaccgggtcattccagggcaggtcgaccacaggctctggctcgacaaccggcgcaggttcaaccacaggcgctgctgcaaccggctcaggctcaggcgtcggcgcaaccggtacgggtgcagcgactactgacgcgacagctgccgcgccagccactggtttggcggaatcaactgtggcctggctgatccccactggctttagcggctgtctcggtgcgtctgccgaatccgccggccggaacgccagcatacgcagcagcaccatttcaaagccgccgcgcgggtccggcgccaggggcaggtcccggcggccaatcaggcccatctggtagtagaactgcacatcctcggccggcaaggcctgggccagggccaatacgcgatcgcggtcgccatggccgttgtcgacgccttccggcagggcctgggcgatggcgacgcggtgcagcacattgaggatctccgagagcacgccgttccaatccgggccttgctccgagaggtggcgcaccgcttcgagcagcgccttggcgtcgccttcaatcagcgcatgaagcacatcaaatacctggccgtggtccagggtgccgagcatggcgcgcacatcggcagccatgaccttgccttcgccgaacgcgatggcctggtcggtgaggctcatggcgtcacgcatcgaaccgtcggcggcgcggcccaacaaccacagcgcgtcgtcttcgaacggtacgttctcgacgcccagcacgtgggtcaaatgctcgaccacgcgctcgggggtcatgtttttcagggagaactgcaggcaccgcgacaaaatcgttgcaggaagtttctgcgggtcggtggtggccaggatgaacttaacgtagggcggcggctcttccagggttttcaacagggcgttgaaagagtggctggacagcatgtgcacttcgtcgatcaggtagaccttgaagcggccacggctcggtgcgtactgcacgttgtcgagcagctcgcgggtgtcttcgaccttggtgcggctcgcggcgtcgatctcgatcaggtcgacaaaacgcccctcgtcgatctcgcggcataccgaacaggtgccgcaaggcgttgaagtgataccggtttcacaattcaggcacttggcgatgatgcgcgcaatcgtggtcttgcccaccccgcgggtaccggtgaacaggtaggcgtggtgcagccgttggctgtccaaggcattgatcagagccttgagcacatgggtctggccgaccatttcgcggaacgagcgcgggcgccatttacgtgcaagaacctgataactcatcgaaaaccgtcgcaactgggaagcggaagccggtaatgctagcggagcaagggggaaattgcatccggcacgctcgtctaatctgacgaaggtcgcccgattggccccacagcgggcttttgcacacgtcctgcatgaacgattgaacgccagtggcgctccaggctaatggcggccacgctggccagcacgatcaccgcgcccagcaccacctgcagggccacatgctcgccgagcagcattgcggccatcaccatggccaccggtgggatcaggtacatcgccaccgaagcacggctgacctcgacatgcttcaacacatacccccaggccaggtaggccaaggcgctggggaaaatgcccagcaccagcaccgcgaagttctccggtaacggtgcctgtacgatggcggcgggcaggcccggcaggttcacgcaaagcatcaaggtgccggaccacaccatgtagcacgccagggtcagcgggctgtagcgatgggcgtaatgccgcgcgatggcgaaatacacactccacgagcacgccgccagcaggatcagcaagccccgagggtcgatgtcgcccacgccgtggtcgccccagatcaccaccagcacgccggccaggcccaatagcacacaggcccagcgccaggcactgacccgttccttcaagcagaaaaacgcgatcaacacactgaacaacggcgccgactgtgccaacacgctggacgccgccgccgtcacccattgctgaccgctattgatgctggtgtggtgcaggaacaccccaaagaaacccaagaccagcagccagggaagatcgcgcacctgcgggcggccgataccgaccaccaccgccacgccccccatgaataccgatgcaatcaggaaccgcagcaacgccaattgaccggggctgtagctgtgcagccccatgtgcacgccaatcggcgaataggcccaacagaggatgacgctggcaatgactagcgtaagctttagaggtgacggggtattcatcgacggcatccacgcattgagaaggcatgccgtcagtcttggcccaggccgggcctaggacaattaagtgtttctgacttctgaaatcacgggaactgagcaatggaactggcccaactgaaaatggtgcgcgccgtggcacaaaccggcagcgtggcccaggctgccttgcagttgcactgtgtgccgtccaacatcaccacgcgcatcaagcagctggaaaacgagttgggcacgccactgtttatccgcgccggccgcgggttggcgatcagtgctgcgggtgagatcttcctggattactgtgaacgcatcctggcgctggtggatgagtccaaacgtgcggtggatgccaacgccattccccgtggcaccttgcgcatcggtgcggtggaatccagcgccagcggccgcctgccaccgctgctggcggaatatcaccgacgttaccccgaggtcagcctggaattggtcaccggcgcctgggcgcaattgctcgacgacctgcaacaccatcgcctggacgtggccctggtggccgccggtggcaaacgtacgaagctggaacagagcgtggtctacagcgagcgcctggtgttgattgccagcgcctccagtgcacctatcaatagcgccgaggacctggccggccgcacgctgctggtatggccgccaggctgcccctatcgcgccgccctggaaaactggctcaagccccatgacttcaagccagcgattgccagctacgccagttggggcacgatcatcggctgcgtcagcgcggggattggcgtggcgctagcgcccgagggcattctggcgcgctatgagcaggccaatcagctggcgtcctatcggttcgacgaactggcggcggtggacaacctgctgttttggcacaaggacacccagcgacacctggcacgggatgcattcgccgggctactgcgcgagacctttggctgacacattcctaaatgtgggagggggcttgctcccgatagcggtgtgtcaatcaatataggtgctagctgacccttcctcatcgggagcaagccccctcccacatttcagagcttctcagagcttcggcgcaaccaaccgtgcgtactggccctggctgatccaccccgtgaacgaacggtcgtcagcattgataaactccacctgcgcccagccatccttgaacgccagcacacccaccacatcatccttgacgatgtagggacgcttggcggccttcgcacccggggttttcaacaggtaagccttgtcggcggatacggtcaccaggccgatccactttttgctggcggtctgggtcaggtccaggccggtggcgatttccggcatcagcacgttgatacagccggggtgttgacggccctgctccaccgtcaggatcacgccgtcggacgccacagccacactgccagggtaggcggcgtccagccaggtggtcagcgcctcaggcttgccttgcaggtagaagctgcaacggcggctcacgccctcgcccatcgcctcggcgtagaaaccctcgacctgatgcccaggcgttaccgccagcatcaacccttcgtacttgcccgaatgcaaggttggcgagccagccagtgccgacgccaccgtgcataacgacaacacgcccatcgccagaaaacgaatcatcttatttcttcccttcaaaggcttcgtaggcttgtttcatcagcacgtcatagttgccgtagtcatcgccgttatagttgcgggccatggctgtgaaatccttgtttttcatcgcactcatcaacgccgtgctcttgctgcaaaagctgatgtaggccttgagttgattaccggcgttcactttcaacgctgcgactaactcaaacaccgtcttgaaaccgcaggatgcgaagttgaatcccatgacctgaaacatgccccaggacgccgacatcaatgccgcctcctggtccagggcgaatgcggtagccatggtttcccaggccttgacctggtccttgttattggtctgccactgcggcccggcttttttcttgtagacatacgacagcagcgggtgcgactggtcgtagatgtgattggtgtacttgcgaaagtggtgcccttcgaaggcgatgatcggtaactttgccggcccgaaacccaccttcccgcccgactccacggtcgcaaaagccttgaccacatttgtcgaaatgccgttgcccagttgcttggcggcattctggaaatccgtatcgctgagcgttgtgccgccgtcacaggtggcctggagcattaactggcggttgcgccgctcggcctcgatcactgcacgcacctggctcaggtagacgttgaccgtggcttgcaccgcatcgacgttgttattgcccaatgcgttgagaaagctcggaatgcgcatggccgggaaggccctcacgggcaccttcaccgcttcttcgatcaagctgttgaacgtgcgccccgtggggtcgatcacaccatcgggatgggcgtatttgagatggcggaactgatactggctgatgcattgcaccaactggccgtcgcacttgccgttttcctgcaaggcaaagcccatcttgggaatgatcaagttaaataggtactggatgcactgaacatcagcgggcaagttgcgggctttaccgggagcgcctactgaagcactgataagacgaggcaacccttgcaggctcttcatgacagacatccttgtgagtgaaagaagtgatagcacttcaatatcaaatccgtgcccttgtcatactctgaaacaagtggctggcgcaagctagcaaggcggtatgcgaattgtccagagggcgttttgaaagttgtgaaatggctcggttaaatccgtcagtaaccgtgcaactctcgggttttctgatacttgtgatagtcgatccattcaaccacatcgtagggcagatacaattgctgagtcgctcgggaaatcgcgatatacaccgcacacagtcgctggtcgaacgcataggcgtcttggaacttcacattggtcaacaactcgggggtaagcagcacccgttcgaactccagcccgcccgcatcttgcgccagcatcagcaggcagcgctcgtgcggatggccgcttagccggttcaaacgtgtaacgtcagccaggttaaagcctttttccaactcggcctcaacccaaagaaacgcctcatcgaactgacatgcctcgcgcacttgctgccaatcggccatatcgctgaaaaaaggatgagggccactgtcattgaactcgttgctatagaaatctggcttgaacaacgcgatgaccgtgtccatgaaatacttgagtgactgctgcgcctctttactcgccaggccgaatgcacaacgggcgtcacttagttgcatggcccacttcatggtgtcccaataggacgcggtcagcaccacgcaaccttgcggcggcacgaaaccctgcggataaaactcaataccgacgtcggcgtcccgcgcgccctcaaagagcactttgcttttatccgaatgctggctgatcaaagggttgaccaggcgctcgacgttgcgtccggaacgcacggagtagcaaatgtccgtgtggcgaacctcacgggcacgtttgaccaccccaccactggcctgctggtactcgtcgcccagggtgaccagcacctggcggccgcgctcgatcatctgcagcagcggcgccggaatgtcctggctctcgtcgatgagcacgtgggtatagcgctcgggcaccacacagccggcaaggctggcgcgcttgatcatcaacaaggcttcaaatccggtctggctgccccaggccggattcgcctcaaggtagctccacaaccggctggcgtattcgagcagtgcccgcgagtcgacgacggacagcggctgcttgaaatgcggcaaatgcttcgccgacaggctgtattcccaggagcggcagtaggcttccagcactttgagacagacatccaccaccgcttgcccctccaaacgccggaaaccgaagatattcagctcctgggccagtgcctgcttgctcagcgcccttgcttgggtatccagtggtttgggccttgggccatgcaacaaggtatgcgcaaaggcgtagaaggtctggccggcctttcgctcgcgtacgcccaccatgcgcgcgcgcagggtttccagttttgccggggtacgcgccagcaacaaggttttttccggacgcaggtgctccatcaaggccaccagcagatgactcttaccgatgcccgcgtagccttggacatgcaggtcttcgttcaagttggcgcggaaggtcctgaccagcttgtcttgctcggcgctcaaccagcgttcgcggtgccgaggcgtgaccatctgtttgctgaacgggtcatttgccttgaggtggcgcactttatattcgacgtcccacttgccgctgggcagcaggtagtctcgcgcctgtacctcctccgccagcagaaagcgcagcttgaggcttttgaccacattaagaccgaagtacagcttcctttggtcgaacagccgctgtgcttccgacaacagagacacgctcgtcgaatggctggcctctaccgcccagtcaatgagcttggccaagactttttcagcgccactggcgctcaggtcgctttccggcacctgcgccagattctggataaccagcacggccgccagctccggctcactcagggcgacgagcgcccctgcaccgtcgccagccaacaaacccgcacaggtttcatcggtgatcggcaagaacacagggctggataaatcaaaatgttccgagtgcatatagcctcgtagccaggggaaagagacgcttgggagtatgccactggtcgagagatgaccgtcatgcgctgtgcaaccggcgtcacagatgactggcagggcagcaaatatgaattggaatcgaagaagggaccgcaggagggagcgttatggaggcaaccccaccagccacaccccggcacacaatgttcccgctgtggctgctgccttccggctctgaccaggttcacgggtaatcgttgcggggggaccgatggggtcaccataacgacgctggcctctcggcaagccgcgccattgtaccgttctcatcggaagttacaaccgtaaaaaatgagaagcttcaagtacttgccatggcgttcaacaattgcgctatccaatgtgggggcttgccccctccccacaggggttaatcattgtgcatgcaggaccgcatcggccctgccgccctcttcctggatgaccaggtgaataaagtgcaacttggcaatcaccgccgacggcagcacgaaggggtagaaatccggctggcccatggcacgggacagttcgttgagcatgccggccagttcgatccaggcgttgacgaacgagaggaatgccgggccgcctgggtgttctggatcgtacagcgtcgtcagggcaaacggctggtaatccaggtccatctcgcgggcgctcataccaaagcccagggcagtgtccaccgcatccatcatgtgcaggtagtgggcccaggtttcggcccagtcttcccatggatgcatggtggcataggcactgacgcagttttgttgccagtcagggcgcgggccgttctggtagtgctggtcgagggcgtcggcgtaactggcgcgctcgtcgccgaacaaggctcggaacggttcaagccagtggctgtcggcgatcaggcgatcccagtagtagtggccgacttcatggcgaaaatggccaagcaaggtgcggtacggctcgtgcatctgtacgcggactttttcgcggtgggcatcgtcggcttccttgatgtccagggtgatcaggccgttggcatgaccagtggtgggcgcgttgccttgcaggtcgatgccgatgaagtcgaaggccaggccagtgttttcgtcgacactcttgggcaccacttgcaggcccaggctaatcagctgtgccaccaaccggcgcttggcggtttcgaccttgcgccagcgttcggggttttgcgcaatcgacaggtcgggaatggtgcggttcaggctgcaggccaagcacagcgtcgcggtactgtgggccgggaccagccagttgcaggcggccggggtgtcaaggttggcgcagcgtcgaaaagcaccggcgtcgagatgatcgtccgccagccaagtgccaaccacagggccgggttgcagggaggacaggcggctttgctgcggcaggtaacccaacaccgcctggcaggccaggcactggctgttgcggaagaacagcgactggccgcagcggcattgccacaccttgctgttgcgcgagggttgggccatgaacggcgcggcgatgcgcgaactgagttgctcgaagtagcgaaacatcgcgggttctccctggggtgacagagactagatcatttctcgctcgggatcgttcaacacgcaagggatgacaccactgctctttgtaggagcgagcttgctcgcgaagatcgttaacgataacgcggggggcctgattcacagcggggcactccggttcttcgcgagcaagctcgttcctacagggggcaaaagcgtttcagacgctgatgttgtgcccggccaggaaggccacgaaagcttcttcgtccagcactttgatgcccagctcactggccttggccaatttcgatccagcgcccggcccggccaccacgcagtgggttttcgccgagacggaaccggccaccttggcgcctaggctttcgagcttgtccttggccacatcgcggctcatcagctccagggagccggtgagtacccaggtgtgcccggcttccggcaagccttcgaccaccttcttctcgctctgccagtgcatgccgaagtccttgagctgttgctcgatggccagggcacgatgggcgttgtcggcattatcgaaaaagtcgcgcacggccttggcctgcttctcgggcagcgcctggcgcatgtagagccagtcggccttgattacgccttcaagcgtgccgaacttgtccgcgagtttctgcgcggcgcccggccctacggaaggcacgtgcagcttgtcgagcaagccgcccaaggtggtgctggcagcgaattcggcgctcaggtcgccctggtcctgcaattgcaggccgcattcgtccgctgccaacagcgcaccgatcacttcctggttgtggtcgtcttcaaagaaactatggatctcatgggccacttccaaccccacatccggcaagtacgtcagcacttccggcaaagccttctgcacacgctccagcgaagccagggagcgcgccagcaccttggcggtctcctcgcccacatcgggaatgccgagggcatagataaagcgcgccagggttggcgccttgctgttttcgatggcgctgatcagcttcttgctggagatgtcggcgaagccttccaagtcaatgatctgttcatacttgagcttgtagagatccgccggcgagccgatgagtttttcatccaccagttgctcgatagtcttgtcacccaggccgtcgatatccatggcacgacgcgagacgaaatggatgatcgcctgcttgagctgcgcgccacaggccagccgcccgacacaacggtacaccgcgccttcactgacggtttccttgcccttgctgcgcttgaccaactgcgtgcgctcgacatgggagccgcacaccgggcagctctcggggatctgcaccgcacgggcgtgttccgggcgacgctcggtgactaccgagaccacttgcgggatcacatcaccagcgcggcggatgatcaccgtgtcaccgatcatcagtcccaggcgcgccacttcgtccatgttgtgcaaggtagcgttggccacggtcacaccggccactttgaccggtttcaagcgcgccactggagtcacggcgccggtacggccgacctggaattccacgtcgagcaactcggtcaactcttccatcgccgggaatttatgcgcgatggcccagcgcggttcacgggcgcggaagcccagctcacgctgggcggcgatgctgttgaccttgaacaccaccccgtcgatctcatagcccagcgcattacgccgctcgccaatatcgcggtagtagtccaggcattcctggatgcccttggccagcttcagctcgtggctgatcggcatgccccacttctgcaactgcttgaggttaccaatatgggtgtcactgatatctgcggtcacctggccgatgccatagcagcagaattccagtggacggctggcggtgatcttcgaatccagctggcgcagactgccggccgcagcattgcgcgggttggcgaaggtcttgccgccgacttccagctgcgaggcgttcaggcgctcgaaaccggccttggacataaacacttcgccacgcacttccagggtggccggccagccgctgccgtgcagcttcaaaggaatattgcgcacggtgcgcacattgacgctgatgtcttcccccgtggtgccatcgccacgggtagcaccgcgcaccagttcgccatcctggtacagcaggctgaccgccaggccatccagcttcggctcgcagctgtactccaccgccgcgccagcgccgaacagatcgcccaccggcaggtcgaggccctcggtgacccggcgatcaaattcgagcatggtggcttcatcgaaggcgttgcccaggctgagcatcgggatctcgtgcttgacctgggtgaacgccgacagcgccgcactgccgacccgctgcgtcggagaatcgcgcgtcaccagttccgggtgctcggcttccagggccttgagctcgtggaacaagcggtcgtactcagcgtccggaatgctcggctcgtcgagcacatggtagcgatagttgtgctgatccagttcagcgcgcagttcgagaatgcgggtatgggcggcggtcatgggtgttctctcataaagcaaaagagcagccgaagctgctcaatatgttagtgcatggattctacagacaacgcttatgatcgaacctcagcgtttctgtgtcagggcgcgacgctcgaactcgacgatgcgctgacggtagtgttcgatggtctgggcggtcaggacgctgcgttggtcgtccttgagctcgccgttgagttcctgggacagcttgcgggccgccgccaccatcacgtcgaacgcttgtttggggtgacgcgggcccggcaggccgaggaagaaactcaccgccggggtgctgaacaggtcgatatcgtccagatcgaaggtgcccggcttgaccgcgttggccatggagaacagcacttcgccattgccggccatgctttcgtgacggtggaaaatatccatttcaccaaaacgcaggccgctttcaaggatgttctgcaacagtgccgggcctttgaaaccaccggcatcgcggcagatcacgctgatgaccagcacttcttcggcagccggctgatcgtttaccgattggcgcgccgcgttcttggtcggggtctcgtcggggaaatcgttgtcacggctgctgaagcttgggccatcatcgacgtcgaggttcaggtcgccctggtgcggttcggctaccgctgcactgccacgcttgccgcgcttggacgacggctcgcgagcttcacgcaccggcgcgctcatcgacggcaagtcgtgctcgtccagttgcggctctttatgggtatccagcacacggggcggccccagcagctcggcgctgccgtcgtcgtcgggcaggttggacaggtttcggtccaagcggaacttgagcttacccttgccaccgcgcatacggcgccagccatcaaaaagaataccggcaatgacaataatgccgatgacgatcagccactcgcgcagaccgatttccatgtaatcccgtgcctctataaaaaatgctgaaaaataaggggtttagcaccgtgcaaaccgctttaaaacgtggcgccaactctatgttctggctgacgttttgcccacgcacacgaaaaattgacattaaactagcacgaccaaagacaactttacaccgtctgtcaaaatgccttgaacaaatatgtccatttgccactttcgttagaccggtaaaccgccctacatcgtgctgaaaattctctctgctggcgtggctcaggattccaccatcgccatcgcttcttccacatccaccgccaccaatcgcgaacaacccggctcgtgcatcgtgacccccatcaactgatcggccatttccatggcgatcttgttgtgggtgatatagatgaactgcacggtctgggacatctcttggaccaaccgagcgtagcgtcccacgttagcgtcatccagcggtgcgtcaacttcgtcgagcatgcagaacggcgccgggttcaacttgaagatggcaaataccagggccaatgcggtcagggccttttcgccgccggacaacaaatggatggtgctgttcttcttgcccggaggccgcgccatgatcgttacccctgtatcgagtagatcttcgcccgtcagttccaagtaagcgctgccaccaccgaaaacttttgggaataacgcctgtaaaccgccattaatctgatcaaaggtatctttgaagcggttgcgggtttccttgtcgatcttgcggatcacgttttccagggtatccagggcttccaccagatcggcgtcctgggcatccagataacgtttgcgctcggactgctgctggtactcatcaatggccgcgaggttgatcgcgcccaggcgttgaatgcgtgcggcaatccgttcaagttcttcttcggcgtctttctcgttggcctgagcggtcagggtgttgagcacgccgtgcaggtcatagccgtcttcaagcaactggtcttgcaaggtcttgcgtcgcacagtcaaggcttgccattccatgcgttgctgttcgagctggccgcggatcaactgggattgctgctcggccatagtgcggcgtttttcagcatcgcgcagttcgcggtcggcatcctcgagggcgatctgcgcggtcttgagttcttcgtcgacggtcatgcgcttatcgagcaactcttcgagcttgaggcgcagctcttccagtggcgcctcgccctcctccaggttcaggctcagttgctcgcgtttttcggtcaggcgttcggactgcatctccaggcgctcgagggcctgacgcgtggagtcgtgctgggcgcgcaacgagccgaggcgcaccgctagctggtgggcatgatccttgtgctggcgcgcttcctggcgcacgcggtcgaggcgttcgcgcaggctgtcgcgctgggccagcatcaactcgcgctgctcggtgtccagggccatgctgtcgagggcttcctgcaattgcaggcgtgcttcgccgatctgctcgtgttccagggcgcgctgctcgcccatttcggccacttcttcatcgaggcgggtgcggcgcagggtcagttgttcgaccttggccttgctcgccgacagttgggctttcaattcgccctgctggcgcgcttcgtcctgcaacagccggcgcaggtgttcgcgaccggtctcctgctggcgctgggtggcgcgcagggtttgcagttcggtttccaggctttcgagggtggcttcacgctcttcacgctcggcggtcaaattgacgatttcctggccacgggccaatacgccgctttcggcttcactggcacgccgtacccgcaggaagtggcgcccgacccaatagccatcacgactgatcaggctctcaccggcccccagttgaacacgctgggccaaggcctgctcaagcgactccaccggcttgacctggcccagccacggcgacaagtcaatcgccgcttcaaccttgtccagcagactgcccggcacccgcgtgccatcggcggcggggctgagcaggcgcaagtcgccctgggcaaagccggccaggtcgaagccgccaaaatcgtccaccagcacggcttgcaaatcggcgcccaaaacggtttccaccgccagctcccaaccggcttctaccttcaagccttcggccaggcgcgggcgctcggccaaatgctggtcgcgcagccattcggcggtaccggtgccagggtccaacgccgcttgctggagcgcttcaagggatgccaagcgaccattgagacgctgcaaatccccctgggcctgctgctgcgcctgggttgccgtgtgcaattgctgacgcagttgctccaagcgctccacttgctgttcttcgctggcctccagctcctcgagggtcatttcgctttcggccagttgctcgctcaactgcatgatcgccgcgtcttccgggtcggcggcgagcaatacgcgctcttcctgcaaacggcgctggcgctcggccaggcgttccatgctggtttccagctgctggatgcgtgactgctgcacctcagcctggcggcgtggctcggcggaacgcaggttgaaggtgtcccactgttcctgccaggcgtgcatggtggtttcggcttcttccaaggcggcggcggcttcttcggcggcagcgttggtgatttcctgctcgggggtgagcatgtccagctcttcgccgagggtcagcagcaaggtgcggtcatggcccagatgcgattcggtttccaggcgcgcgcgttcggcttccttcaggtcatcctgcaactggcgcaggcgctgctgaccgtgctgaatgctctgctcgacccgggcgatatcgccgcccactgaatagaaacggccctgcaccagattgaagcgttcggagagttcatggtggccgtcacgcaagcgttcgatgctggcatcggcattacgctgctcggccaccagcgcttcaaagctgatttcctgggtaccaatgatcgcttcgcgctggcccacctggtcattcagcgcctgccagcgcagggccgagagttgcgccttgagctggcgttcttcgcccttgtattcctgatacttctcggcggcctgggcctggcggtgcaggcgctccaactggcgctccagctcttcgcgcaggtcggtcaggcgggcgaggttttcatgggtgcggcggatgcgattttcggtctcgcgacgacgctccttgtacttggagatacccgccgcttcttcgataaagttacgcaggtcttcgggcttggcttcgatcagcttggagatcatgccctgttcgatgatcgaataactgcgcgggccaagcccggtgccgaggaagatgtcggtgatgtcgcgacgacggcacttggtgccattgaggaagtagctgttctggctgtcgcgggtgactttgcggcgaatcgagatttccgcataggccgcgtactcaccgaccagagtgccgtcggagttatcgaacaccagctcgatgctggcctggctcaccggcttgcggctggtagagccattgaagatgacgtcggtcatcgactcgccgcgcaggttttttgccgagctctcgcccatcacccagcgtacggcgtcgatgatattcgacttgccgcagccattgggccccaccactgccgccatgttgctggggaagttcaccgtggtggggtcgacgaaggatttgaaccccgccaatttgatgcacttgagccgcacgtctaggcgtccgccaacgcagcgatgaccagcgagctgctgcgctggcagtaagccgacagcaccaggcgaatttgcaccagttcacgggccagtacggcggccagtaattgctcgaacaacgccaggtattcgctcatggacgccttgcgttggtccagggccaggtaataagcgcggttcatcgccggttgcaggttctcgacggtttcctgcagatacggattgttggcgaaggggtaggcggcgcgcatcacattgaagctttcttcgacgaaggcgcggatatcctcacgctcgtaactggcttgcaggcgttgctggatctgcaggaacggcgccatgtcggcctgggtctgccagccttcggctaccgcattgccgagcaggatgtacatctcgcccatcaaggtgcacaggctctgcaccttgtgcgcggtgagctcggtgacatgggcaccccgacgcggcaggatcgcgatcaggtggcggcgctcgaggatcagcaaggcttcacgcacggaaccacggctgacgttgagcgccagcgtgaccttctgttcctggatccgctccccaggcttgagatcgccgcgaatgatacgttcggcgaggtggtgagcaatttgctcggcgagactgtccggcgccttgaacgtcatgttttcccttcaaaatcttctatcggtacaagcgcggcagtgtagcgcattggcccgctgatggcgctacgcccaccgtggcgaatttggcatgaaataagcaacgatgaaagcctgtacgccgcccaaaacgctggttccagaagactggaccataattgaaagtgttgcgatcgcattttcttgacccttaagtcagaaaaccattgaccgaaaagtcagacatgactagattcggcgcaaagcggttaacaacaataatgagtctgcgaggccttccgtgatccagtttttacttaaccaggaactccgtagcgagcacgccctggacccaaacctgacagtgctcaattatctgcgtgagcatgtgggcaagcccggtaccaaggaaggctgcgccagcggcgactgcggtgcgtgcaccgtggtggtcggcgaattgcacaccaacgatctgggtgccgagcagattcgttatcgcagcctcaactcctgcctgacctttgtctcgtcgttgcacggcaagcaactgatcagcgtcgaagatctcaagcaccagggccagctgcacagcgttcaacaggccatggtcgagtgccacggctcgcagtgcggcttttgcaccccgggtttcgtgatgtcgctgtttgccctgcaaaagaacagcgatgcccccgacagccacaaagcccatgaagccctggccggcaacctatgtcgctgcaccggttatcgcccgatcctcgccgccgccgaacaagcctgctgcaacaagccccaggaccagtttgacagtcgccaggccgacactatcgcccgtctcaaaagcatcgcaccgacccagaccggcgaactcaacagtggcgacaaacgctgcctggtgccgctgaccgtcgccgacctggcggacctctacgatgcctacccccaagcccgcctgctggccggaggtaccgacctggcactggaagtcacccagttccatcgcaccctgccggtgatgatctacgttggcaatattgaagaaatgaagcgcatcgaggacttcgacgaccgcctggaaatcggcgcggccactgccctctcagactgctacgccgcgctgcaccacgaatacccggactttggcgaactgttgcaccgcttcgcttccctgcagatccgcaaccagggcaccctgggcggcaatatcggcaacgcctcgccgattggtgattcgccaccgctgctgattgccctgggtgcgcagatcgtcctgtgcaaaggcaacacccgtcgcaccctggcactggaagactatttcatcgattaccgcgtcaccgcccgccaggacagcgagttcatcgagaagatcatcgtgcccaagggccatgcactgtttcgtgcctataaggtgtccaagcgcctggacgatgatatttccgcagtctgcgccgccttcaacttgaagatcgacaatggggtaatcagcgaagcccgtgttgccttcggcggcatggccgccacgccaaaacgcgcaaaaagctgcgaggccgtgttggtgggcgctacctggaatagcgccaccgtggaaaaagcctgcgtcgccctggccgaagatttcacgccgctgtcggacttccgcgccagcaaggaataccgcctgctcagcgcgcagaacctgctgcgcaaatacttcatcgagctgcaaacgccgcacatcgagactcgggtgaccgcatatgtctaaccatcacgccgtcgtaaaaacccaggccgaacttgccgagctgtttgcccgggacttgacctccggggtcggccgcagcgtcaagcatgacagcgccgccaagcacgtcagcggcgaagcgcagtacatcgatgaccgcctggaatttcccaaccagttgcacctgtatgcgcgcctgtccgaccgcgcccacgcccgcatcctcagcatcgacactgcgccctgctacgcctttgacggcgtgcgcatcgtcatcacccacgaagacataccgggcctgaaagacatcggcccattgatgcccggcgacccgttgctggccatcgacaccgtgcagttcgtaggtcaagtggtgctggccgtggcggcccgcgacctggagactgcgcgcaaggcggcgatggcggcagtgattgaatatgaagacctggagccggtgctggatgtagtcgaggcctttcgcaacaagcatttcgtgctcgacagccacacccaccaacgcggcgattcggccgcggcgctggcgagcgccaagcaccgtatccagggcaccctgcatatcggcggccaggaacacttctacctggaaacccagatctcctcggtgatgcccaccgaagacggcggcatgatcgtctactgttccacgcaaaaccctaccgaagtgcagaagctggtggccgaagtactcgacgtgtcgatgaacaagatcgtggtcgacatgcgccgcatgggcggtggttttggcggcaaggaaacccaggccgccagcccggcctgcctgtgcgcggtggtggcgcgcctcactggccagccgaccaagatgcgcttgcctcgggtcgaagacatgctgatgaccggcaagcgccaccctttctatatcgaatacgacgtgggcttcgacgaaagcggtcgcctgcacggcatcaacctggaactggcgggtaactgcggctgctcgccggacctgtccaactcgattgtcgaccgcgccatgttccacgccgacaactcgtattacctgggcgatgccacggtcaatggccatcgttgcaagaccaacaccgcgtccaacaccgcctaccgcggcttcggcggcccccagggcatggtcgcgatcgaggaggtgatggacgccatcgcgcgccacctggcgctggacccattggcagtacgcaaggccaattactacggcaagaccgagcgcaacgtcacccattattaccagaccgtcgagcacaacatgctcgaagagatgaccgccgagcttgaagccagcagccaatacgccgagcgccgtgaagcgatccgcctgtacaacgcccacagcccgatcctgaaaaagggcctggcgctgaccccggtgaaattcggtatttcctttaccgccagcttccttaaccaggctggtgcgttgatccacatctacaccgacggcagcatccacctgaaccacggcggcaccgagatgggccagggcttaaataccaaggttgcccaggtggtggctgaagtgttccaggtggacatcgaccgcgtacagatcactgccaccaacaccgacaaggtgcccaacacctcgcccactgccgcctccagcggtgcggacctcaacggcaaggccgcgcagaatgccgccgagaccatcaagcagcgcctggtggagttcgccgcgcgcaagtacgacgtcagcgaagcggacgtgcagttccgcaacggccatgtgcgtgttcgcgaacaaatcctgacgttcgaaacgttgatccagcaggcgtatttcgcccaggtctcgctgtcgagcaccggcttctacaagaccccgaaaatcttctacgaccgcagccaggcgcgtggtcggccgttctactacttcgccttcggcgccgcctgctgcgaagtgatcgtcgacaccctgaccggcgaatacaagatgctgcgcaccgacatcctccacgacgtgggcgcctcgctgaacccggccatcgacatcggccaggtcgaaggcggctttatccagggcatgggctggctgaccatggaagagctggtgtggaacgacaagggcaagctcatgaccaacggcccggccagctacaagatccccgccgtagcggacatgccgcttgacctgcgagtcaagctggtggaaaaccgcaagaacccggaagacacggtgttccattccaaggccgtgggtgagccgccgttcatgctcgggattgcttcgtggtgtgcgatcaaggacgcggtggcgagcttggctgactatcgccagcagcccaagatcgatgcgccggcgacgccggagcgggtgttgtgggggtgtgagcagatgcggcaggttcaggcggtgaaggccattgaggctgaaactgagatggcttcgctctagaccgcggcgctgccatcgggagcaagccccatcccacatttgctctgtgaataccttcaaatgtgggaggggcggtgcgacgattcgacttgctcccgatgacgaccgaactgacaacagtaatgttgaggtgaacatgaacaactggatcagcgccctcgccaccctgcaagaccagggcgaaccctgcgtcctggtgaccatcatcgaagagctcggctccacgccgcgcaatgccggttcaaagatggtaatcagcgccgcccataccttcgacaccatcggcggtgggcacctggaatacaaggcgatgcagatcgcccgcgacatgctcgcccgcggccagcagaacacccatctggagcgcttcagcctcggtgccagcctcggccagtgctgtggtggcgtgaccgtgctgctgttcgaacccatgggccaggtgcaggcgcagatcgcggtgtttggcgccggccatgtggggcgtgcgctggtgccgttgctggcgagcctgccgtgccgggtgcgctggatcgactcccgcgatcaggaattcccagagaatgtcccccaaggcgtgcgtaaaatcatcagcgaagagccggtcgatgaaattgccgacctgccagcgggtagttattgcatcgtcatgacccacaatcacacgctggacctggaactgaccgccgccctgctcaagcgcaatgacttcgcctacttcggcctgatcggttcgaagaccaagcgcgtgaaattcgaacaccgcctgcgtgaccgcggcttcgacaccgcgcagttgcaacgcatgcgctgccccatgggcctcaccgaggtaaagggcaagttgcccgtggagatcgccatttccatcgccggcgaaatcatcgccacctataacgccaatttcggccagcacactgtcggcgccgaacccattgccaaattgctgccggcttcgcgccgcagccaagctatctaaattgagataaccatgcctttgactcgcaaagcctaccgtgccgccatcctgcacagcatcgacgaccctgccgtcgttggcatcgaagcctcctacgagtatttcgaagatggcctgctggtgatcgataacggtcagatcagcgcgctcggtcacgccagcgatctgctgccgagcctgcctgccgatatcgacatcacccactaccaggacgcgctgatcacccccggcctgatcgacacccatatccacctgccgcagaccggcatggtcggcgcctatggcgaacagttgctggactggctcaacacctacaccttcccgtgtgaaagccagttcgccgataaggcccacgccgaggaagtcgcggatatcttcatcaaggaactgctgcgcaacggcaccaccaccgcgctggtgttcggcagcgtgcacccgcaatcggtgaatgcattctttgaagcggccgagaagctcgacctgcgcatgatcgctggcaaggtgatgatggaccgcaatgcgccggactatctgactgacacgcccgaatccggctatcaggaaagcaaggcgctgatcgagcgctggcacggcaaaggccgcctgcattacgcggtgacgccacgctttgcccccaccagcacaccagagcaattgacgctggccgggaaactgctgggggaatacccggacctgtacatgcagacccacatcagtgagaacaagcaggaagtcgagtgggtgaaggaactgttcccggagcgtagcggctatctggatgtgtacgaccattacaaactgctgggcgagcgctcggtatttgcccatggcgtgcacctgtgtgatgacgagtgcgcacgcttggcaaaggccggctcggcagtcgcattctgcccgacgtcgaatctctttctcggcagtggtttgttcaacctgccgatggcggagaaacacaaactgaacgtgggcctgggcaccgacgtgggtggcggtaccagcttctcgctcctgcaaacattgaatgaagcctacaaggtcatgcagttgcagggggcacggttgagcccgttcaaatcgctgtacctggcgaccctgggcggtgcgcgggcgttgcgtctggaagacaggatcggcacgttgcagcctggcacggatgcggactttttggtgctggactacaacgccacgccgctgctgagctatcgcttgaaacaggccaataacattgccgagacgctgtttgtattgatgacgctgggggatgatcgggcggtgttgcagacctatgcggctgggcagttggtgcatcaacgctgaacccagccacaacacaataccaatgtgggagggggcttgctcccgatagcggtgtgtcagtcagcctatctgctactgacactctgctatcgggagcaagccccctcccacatttttatcccccagtgaatcagggagattacagttttaccgaggagcgccctggcttcctggtctgtaaaaggtgcgagaacaccgcatgcaaatcatccgacgcgctttcctcatcgaggttgagcttgctgtcgatatggtccatgtgatgcatcatcaagttcaccgccagcaccgcatcgcgggcttcgatcgcgtcgatcaactgggtgtgttcatcatacgaacagtgcgagcggttgccgctttcgtactgggcgatgatcaatgaggtctgggacaccaggctgcgctgaaagctgatcagcggcgcgttttttgctgcctcagccagtttcaggtggaattcgcccgaaaggcggatacccgcaccgcgatcgccacgggaaaagctgtcgcgctcgtcgttgaccatctggcgcaactcggccaactgctcggcggtggcgtgctgcaccgccaattcagtgattgcccgctccaccaggcgccgggccatgaacacctggcgcgcttcttccacgcttgggctggcaaccaccgcgccgcgattgggcctcagcagcaccacaccctcatgggccagacgcgacagcgcacggcggatgatggtgcggctcacgccgaagatttcgcccagtgcctcttcactcaatttggttccgggcgccaggcgttgttcgaggatcgcctcgaagatatgcgcgtagacaatatcgtcctgggttccgctgcgaccggtcttgccggctcgcggttgtttcttgagaggttgcaactgttcgttcatgggcactcgggtttggagaacggcggcgaaataacggtaatacggcaacgacgctacgctggcaagtatcacctaaaaacagggcacattgtacacaacccgatgcgccaacacactgtacggctgtttgcggccccggctgtattgcaatgactcgttacgtttgagtttaggcttgattccacgatttcccataaacgatatcgcactgtaggagcgagcttgctcgcgaaaaccccgatagcgcagcaatcctccagaaaccgcgcgtcatcgttggcgtttttcgcgagcaagctcgctcctacactgtgcgtagtcaggtaaaaggaatacccctccatgaccgatgccacccaagcgcccttgcgcccgctggccgacacttctgcgtcggccgtcgtcgccggctttatcgccatgatgaccggctacaccagctccctggtgctgatgttccaggctggccaggccgccggcttgaccacggcgcagatttcctcgtggatctgggcgatttccatcggcatggcggtgtgcagcattggcctgtcgttgcgctatcgcacgcctatcaccatcgcctggtccacaccgggcgccgcgctgttgatcacaagcttaggcggcgtgagttatggcgaggccattggcgcctacatcacctgcgcggtgctggtagcgatttgcggattgaccggcagctttgaaaagctggtcaagcggatcccggcgtcgctggcggcggcgctgctggcggggatcctgttcaagatcggcagcgagatttttgtcgccgcgcagcatcgtaccggactggtgctggggatgtttttcacctatctggtcatcaagcgtctgtccccgcgttatgccgtgctcgccgcgctgctgattggcaccgcgctgtctgggctgatggggctgttggatttcagcggcttccacctggaagtggcgacgccggtgtggaccacgccgcacttctcactggcggcgaccatcagcatcggcatcccgctgttcgtggtggccatgacctcgcagaacatgcccggcgttgccgtgctgcgggccgacggctacaacgtcccagcgtcgccgctgatcaccaccactggcctggcctcgctggtgctggctccgttcggctcccacggcatcaacctggcggccatcagcgcggcaatctgcaccgggccccatgcccatgaagaccgcaacaagcgctacaccgcagcggtgtggtgcggggtgttctacgggattgccggagtattcggcgcaacgctggcggcactgttcgcggcgctgcccaaggagttggtattgtcgattgcagccctggcgctgtttggctcgatcatcaatggcctgagcatcgccatgaatgagccgaaagagcgggaagcggcgctgatcacctttatggtcacggcgtcaggcttgacgttgttttccatcgggtcagcgttctgggggattgtggcgggggtgttgacgttgctgattctgaattggcgcaaggcataaaaaaacggcgaccctcaggtcgccgttttatttagtatcacttggccgcgttgatcggcttttccggataccacacgtccaacagcgggctgacttcagccttggtcagctcggaacgggttttcagccaggcttcaacagcagcgcgctgctcttcggaaaccgagccacgcttctgcaggcaaaccagaccgtagtcgtcgccgccgacatagcccagaccgttggcttccatggcttctttgatgaatgcttcgaggaaagcgtcgatagcttcttcactcaggccttcgttgaagtccaggttcagttcgaaacccagctcttgaaattcatcaacgcacagttttttgcgcagacgctgggaacggttagtcgccattggaacaatcctcataagtaataacgggcagcactttagcagtttaaggcggcaattgcccgactctctgggacgggcgggcaaaagccgacaaaaaaaccacaattagcagctatcgttgagctacaagtggttccagcttggggcataatgccgacactttcgtgaccattgagggattttctttcatacccctcaccttttcaccctcctcagcagtagggttttacctcttatgatcaaatctttacgttcagtgttattcgccggtttcctcttgccactggccttctgtgccactgctgctcctattaataccaccctgccgcccagcgttgcccaggccctgcagaaagccaagctgcaaaacaccgcgctgtccctggtaatgctgccgctgaacggccccggcacccccactgtgttcaatgccgatgtttcagtgaacccggcctccactatgaagctggtcaccacctacgcggctctggaaatgctcggccccaaccaccagtggaagaccgagttctacaccgacggtaccctcagcggcggcgtgttgcgcggcaacctgtacctcaagggcggtggcgaccccaagctgaacatggaaaaactctggttgctgatgcgcgacctgcgcgccaatggcgtgcagcaagtcactggcgacctggtactggaccgcaacttcttcaatcagccgcaattgcctgagttcaatgacgacggcaacgacgaaaacaagccgttcctggtcaagcccgacgccttgctggtcaacctcaaggccctgcgcttcgtgacccgcaatgattctggaagggtgatagtgtcagtcgagccgccgattgccagcattcgcatcgacaaccaagtgaaggtcaccaacgccaagcagtgcaccggtgacgtgcgctacagccccgtgactgccgccgacggcagtgtgaccgtgactgtcagcggccaactggcggatggctgcagctcgcagacctacctgtcactgcttgaccacgccacctacaccgccggtgccgtgcgtgcaatctggaaggaattgggcggcaccatccagggccgtgatatccaggcgccagtgcccaaggatgccaaggtactggcccgcgcgttctcgccggacctggcggaaatcatccgcgacatcaacaagtacagtaacaacaccatggcccaacagttgttcctgagcctgggcgcgcagtttcgcaacgatgccgatggggacgatgccaaggccgcgcaacgcgtcgtgcgccagtggctggcgaagaaaggcattaccgcgccgcacctggtgatggagaacggctctggcctgtcccgcgccgaacgggtcagcgcccgcgagatggcggccatgctgcaagcggcctggagaagcccctatgcggcggagtacatcagctcgatgccaatcgccggcaccgatggcaccatgcgtaaacgtttgaagaccaccgccatgcgcggcgaagcccatgtgaagaccggcacattgaataccgtgcgtgccatcgccgggttcagccgcgacaacaacggcaacacctgggcggtggtggcgatcctcaatgacaacaaaccatggggtgcatcgtcggtgctggaccaggtgttgctggacctgtatcgccagccgaaggcggtggcggccgcgccggttctctaaaccctgtaggagcgagcttgctcgcgaaaatcgtcaacgttaacgcgtgtttcctgaataaacgcggcgtctatggctttttcgcgagcaagcccgctcctacaggcattagggcttgcccactcccacacgcctcgacccggtccctgcccgcctgcttggccacatacaccgccgaatccgcacgcagcagcaacccatctatatcctcatcggcccgccaactggccacgccaaagctggcggtgacgatacccaccggttccatcgacgtattgcgcaacgactgccacaactgcgtcgccaggctgtaagcctgggcgccatcggtgccggggcacagcaccgcgaactcttcgccgcctacccggcagaagacatcggtacgccgcaaacgctggccaatgcgcttgcacaactcctgcaatacgcggtcacccatggcgtggccgtgctggtcgttgatccgcttgaagtgatcgatatcgagcatgatcaacgacagagtaccggcgctgcggttaaggcggagcatctcgaccttgaggcgatcctggaaataacggcgattataaatgcccgtcaatgaatcggtgatggacagcgcacgcagttcttcctcgacccgcttgagatcggagatatccgatacataaccgtgccaaagcgtaccgcctcccggtaattcttctggtgtcgcctcgccgcgaatccagcgcaggcctcgctgcggcaattgcacgcggtactcttcgcgccagtggctcaattgcagggccgacaaacgaatcgacgcccgcacccgctcggcgtccaacgggtgaatgcgctcgaacaccgtgcgcgcatcctgttgcaacacgccgagttcaatttcatagatatcgcgcatgccttggctggcgtagatgaaacgccagttgtcctggggttccagggtgaactggaagattccgccaggcacgtgactgctgagctttttcagcaagcggtcccgcgcggcaagagcttcgtaggcgcccttctgcgcggtgatgtccaggtaaatcgccaaatgcccgacccataggccgtagtcgtccagcagtaccgttaccagcatgttgacagtcagctggctgccgtccttgcgtaccaacgtccactcccgggcttcatgttggctgtcagggctctccaccagcatcgcctggctcggcgggatgcgcttgcccaacgccgcgctcaacggcacagcgcgtgcttcaagttccgaggccaggtgcaggctttccaatttcaggcggcccagcacctcttcgctcttgaaccccagcatgcgttcggcgccagcgttgaaggtgttgatcacaccacgcaagtcggtagcgatgatcgccacctgggtcgccgcgttcagcacactgcgcagctgaccatgagccccacgtaactcctgctctcgcaagcgcaactgcacggtacgctgctccaccagtttcaacgcgcgctggcgctggctgaccaacacgtagagcaaggcactgagcaaggcactgagcagcacgcccatggccaggacggtgttcatggacgagtgattcgccatgtcgaacacctggctcgcacgcacgctcagggcgtagacatggtcaccgagggcaagacggcgcgtagacgacaggtcactgttgcccagtgcattgctcgacgcatataactcccgctgctggctgtcggaagtatcgacgatctgcatcaccaggttgtcgcggttcggtttgggtaaaccgtcggtcaccagctggcgcatgctgatcaccgccatgacaaaaccgtagggctcggtatcgccagctttgctgaccggcgctaccagcaatactccggctgcataggcaggctcgacgcccaccaattgcatgggttgtgacaccgcaggcttgccgctttgttgtgcacgttccagggctgagcggcgcaaaggctgggccagcaggtcaaaacccaagggggcgcccagcaggctttgcgtctggctgtagagtaccgggacgtattcatcgcgctcggtggccggcgccaactcgcccaaggcattcagttcacggatcgcaaaaggtacgccgcgctggcgtgagatttgttgttcaaactggctgcgctgctcgcgaaatacccgcggcgcccaggaataggcgcgagcatgcagcagcagcggctgggcaaaaccgtcgaactcgctacgggacacatcagcggaattggcgaagaaacgctgcaagctacccaggcgttgttcctgatcttcgaaacgttcctggatacgagtgaagcgttcgttgaccaacaattggaaacgctggtgcacctgttgctgatacaggtcggccgccgcccacgcgacaaccaccgtcaacgcgctaccgaccgacagtacgaccaacgccaccagccaagccgacgcctgctcactgataaaaccaaggattttcgggcgaccggcttgcatcggcatgggcaacactcgcaacgccagcgtgcgggggcgtcactatggctaggctttcagttatagccattggcccagggtttgaccagcgtaaaaactgcgggcgcttgatgttggagagggtttgctcccgatagaggtgtatcagtcaatacatcgggtgactgacactttgctatcgggagcaagccccctcccacactggatactcaacgcattcagaacttctgatgtttaatcagcgtgcggtgattttccaggcccggtggatcttcgcattgcgcgtaaaatccggatcgatggtcttgtcgctgatctcctcgaccgcatagcgttcactgaggttggcttccagctggaacttgcggaagttgttggagaagtacaacactccacccggtgccaggcgggccatggccaggtcgagcaactgcacgtggtcgcgctgcacatcgaagatgccttccatgcgcttggagttggagaaggtcggcgggtcgatgaaaatcatatcgaactcatcgcggctggcctccagccatgccatgacgtcaccctgctccagccggtttttgtcggagaaaccgttgagcgagaagttgcgacgcgcccagtccaggtaggtcttggacaggtcgacgctggtggtgctgcgcgcaccgcccttggcggcgtgcacactggcggtggcggtgtagcagtacaggttgaggaagcgcttgcccgccgcttccttctggatacgcatgcgcatcgggcggtgatcgaggaacaggccggtatccaggtagtcggtgaggttgaccagcaacttcacgccgccttcactgacttcggtgaacttgccctgggcgctctggcgttcgtattgcttggtaccgctctggcgctcacgacgcttgaccaccacgcggctcttgtcgacgttgagtgcctggggaatcgctgccagggcatcgaacatgcgggccgaggctttttccgggtcgatggatttcggcgcggcatactcctgcacgtgcacccaatcgtggtacaggtcgatagccatggagtattcaggcatgtcagcgtcatacacacggtagcaatccacgccttcacgcttggcccatttgcccaagagcttgaggttcttttgcaggcggttggcaaacatctgcccgccttcactcaagcgcgcctgctctaccacgggcgccggggccggcttgatcgggttgccgttcttgttgtactggcgctctaccggctcggtcggggcctggtcgtaagccgcttgctcacgctcggcctggcgctgttccggggtacggcgttcgccggtgacgaactgatccgggttgaccttgatcagcagcaatttgcacggcaatgcgccgttccagaaggaatactgcttgtgactgcggatgcccatgcgcttgcccaggtccggcgcgccggtgaacacagccgcttcccagcccatgcaggcctggcgcaggcgctcgccgaggttctggtagaggtacaacaggctggcttcgtcacccaggcgctcgccgtagggcgggttgcagatcaccaggcctttctggttctggtccgggcgcggctcgaaggtgccgacttcgccctggtacaccttgatccaatggctcaggccagcgcgctcgatgttgttgcgtgccggctggatcaggcgtgggtcagcttcgtagcctcgtacccacaacggcggtttgttcatgccgatggccgcgcgttcggtggcctcgctgtgcagcttcttccacagcgccgggacgtggcccagccaggtggtgaagccccacagttcgcggttgaggttgggggccatgtcggcggcgatcatcgcgccttcgaccaggaaggtgcctacgccgcacatcgggtcagtcagcgcgccgccttcggcggcgatgcgtggccagccggcgcggatcaaaatcgctgccgccaggttctccttcaacggtgccgcgccctgctgcaggcggtagccgcgctggtgcaggctgtggccggacaggtccagggacaggatcgcttcgccacggtccaggcgcaggtgaatgcgcaggtcagggttgattttgtcgatggacggacgttcgccggtcggggtgcgcagcttgtcgacgatcgcatccttgaccttcagcgcgccgaagtgggtgttgtcgatgcccgagccatgaccgctgaactccaccgccaggctgccatcgggcaccatgtggtcggcccattcgatatccagcacaccatggtagaggtcttcggcgtccttcatcgggaagcgcttgagcaccagcagcacacggttggccaggcgcgaccacaggcacaggcggtacgcggtttccatgtcggccatgccgcgcacagccgaggtgtgctcgcgggcttcctcaaggccaagcccgacggcttcctcgatcagcaggccttcaaggcccttggggcaagtgaggaagagttcaaaacggtccgacatggggcattccaggcttttcagcaatcaatgaacgggcgacgcatcgccggctcggttttcaatcaagcacttttcttgaagagtgctcgcgtggcacgaatgtgccgttccaccccgtctgacgggccctcgggcctttattgacggggcagagagaactttttagcgattacatccgcaacaaaacgaaatattctgacccttcgtcgaataataaccgactgcaacaggcggaaattctcactaaaggattaaaccctttctctttgcagggcacatcatagctggctttgcccaataaaagggacgaaaagccatcccagcttatggctatagcatcgttatcgttacgtgcttatgacaaaacgatcattgaatccatgtgacctattggttagaactcaacacaggttggcgccgtaacgacgccgacacatcggctcgccacgccggcagcgagcccaccaacggcagaaaaactctgcccggccttggacaaggccgaaggatatctagacagtcaacaagtgagggaaacaccctatgagaagacttaagcgtgatccgttggaaagagcatttttacgcggatatcaatatggtgttcatggaaaatcccgtgagctttgcccatttactctaccgtcggtacgccaagcctggatcaatggctggcgagaaggacgcggcgacaactgggacggtatgactggcactgcgggcatacacagactcaacgaacttcacgccgtcggctaatcagggcacttaaattccgacacacacctctgaatatgtaacgacttaaccacgcgcgccccatccgggcggcgggcttcggcccaggggctcctttatggagccctttttattacctgccgattagcgtttacatcagcgcaaggcagcgatggcatccaccgactggcgtatcagcgccggtcccttgtagataaaccctgaatacaactgcaccaggctcgcgccagccgcgatcttttcggcagcgtgcttgccttcggtgataccgcccaccgcgatgatcggcaaacgcccagccaactcggccgccagcaccttgacgatatgggtgctcttgtcccgcaccggcgcgcccgacaggccgcccgcctcgtcaccatgggccaggccttcgacgcccacgcggctgagggtagtgttggttgcaatcactgcgtccatccccgactccaccagggcctgggccaccagcacggtttcttcatcgctcatgtccggcgcgatcttgatcgccaatggcacgcgcttgccatggcgcacggccagatcttcctggcgttggcgcaaggcttcgagcagttgcttgagggagtcaccaaactgcaggctgcgcaggcccggcgtattgggcgagctgacgttgacggtgacatagctggcgtgcgcatagaccttgtccaggcagatcaggtagtcatccaccgcgcgctcaaccggggtatcgaagttcttgccgatgttgataccaaggatgcctgtgtacttcgccgcctggacccgcgccagcagatggtcgacgcccagattgttgaaacccatgcgattgatgatcgcctcggcttccggcaagcggaaaatgcgtggtttgggattgcccggttgtggccgcggggtcacggtgccgatttcgacaaagccgaaccccagctgcgcgaacccatcgatggccgcgccgttcttgtccaggccggctgccaggccgaccgggttagggaaatccagccccatcaccgacaccggcattttcgccggggccttgcataccaggccattgagtcccaggcggccaccggcaccgatcaggtccagggacagatcgtgggaggtttccggggagagtttgaacaacagctggcgggccaaggtatacatgggcgggctagactcggatggcggcaaaaggtggcgccgattatagccggggtggcgggccgcatgcgaggcgcgccgcgctgatctcattgacgctgcgaaaccagcgcttcataacgcacccagatcctttccgcgtaccgcaggcgtagtgcctcacgttgcgggcctggccccggcccgacgttgtaggcacccaccgccgtccagttatatccgaaacgctggataaactcagccaggatcgaggcaccgacctccactgacaggcaaggctcgttcagcagacgctcttcggtaatgccctgcttgagcaaacgcggcaggtggatgctgttgatctgcatcaggccgatatcacgcgtgccgttgcggttggtgtagttcattgcctgggagcggtaacccgactctactgcagcgatggcctgcaacaactcaggttccagatcgtatcgccgggccatttcgtcccagcaataggccagtgcctggttgctgcccatcagcaagccgagcagcaggctcctgctcccccccttaagcattgctggcctgaccgcagaatgagcacacgtgcacaacgtgccttgatgggtcgctaaccacccgcaccgggcaggtaaagcgataccccttgccgtagatcgtcttgataaatcctttgtcagcacccaggtgcttgcgcagggagtaaatgcatcgcgtcagtgactcatcggccacctcgccccgggaccaggccagttccaacaaacggtccttggtcatcaacgtgccaccggaggccagcagcagacgcagaacctgcccctccttgggtggcaactgaatatccgcgtgcccgcccgtcaaccggccatcgccatgcaaagtccagcgagcaaagaccagggaagtcgcaggttcagcagtcacgacgaccatacacacctctgcattcgactactgccattcaaaatccttatttcctgtgccagctcgcgccaatgtcataactatagaaatcggcacttcggcccgcgctaggacaaaacccattcagccgacttttttttgcaccctccggtaggacaattcgctacccgctcttattgagagatccactcctgataggtctcctgcaactccacccccagccggtcctccagttgcaccagctcacccaatgccatcagttgcccattgacccgcacctccacacatcgggttacccctggatccaagggcagcaccttccccggtgcgaacgcagccagacgcttgcggctgatcagttgttcctgcaacagtatttccaggtgcatggacaaaggcctttttcagggggaaaactcaggatctgtttgcaggaacgcacgttgcacaggctcaagttgcgcggtggtcaactgcgccagcacggtcgtgggcggcaatggggcacggctgaaggtgtgcaagccctcagcccgtgccaggtacgcctcgcaccaggcagctcgactgctcagcaacaacacgccacagatcagcccgaggtacagccagcggtatttgatcgttacagatgaatcagcgtgcaccgtagatattcccgggctgtatggcttgaagaagcggccatactgcgaggcgcacgaggttcaatcatgatggaaagctgacggcagaacccaccctccagcccatggcatgtgccttgctatgcactctgtaacaggcccgcgccaaagactcggcgagcctacgtacataggcgtggttaccctgcaatggcctgcaccgcaggccccagggaatcacggctctcctggaaaaaggcaggtgttgatgaacgatccactggcttgggtaaacggcagtgacgccccggaaaaaagcagcctcgatctgggcttcatggcattgaccgattgcgcctcgctggtagttgccgccacccagggctttgcccaaccctatggcctcacgctgaatctcaagcgccagtcgtcctgggccaacctgcgtgacaagctggtcagcggcgaactggacgccgcccacagtctctacgggctgatctatgccgtgcatctgggcatcggcggtgtcgcaccctgccccatggcggtgctgatggggctgaaccagaatggccagagcatcaacctgtcccgcggcctgcaaacccagggtgtggtcactcctgaggcactggaacgccatgtgcaccaaagccggacgaaactgaccttcgcccagacatttcccaccggcacccacgccatgtggttgtattactggctggccagccaaggcattcatccgttgcgggatgtgaacagcgtagtggtgccgccaccgcagatggttgcgcacctgcaagccggacgcatcgaggggttttgtgtcggcgaaccctggagcgccagcgcagtgaaggaaaatcaaggctttaccctggcgaccagccaggcgatctggcccgatcatccggaaaaagtcctgggctgcacccaggccttcgtcgacgagtatcccaataccgcccgcgtgctggtgatggcgatcctcgaggccagccggtttatcgaacagggcagcgaaaaccgccgctccactgcgcaactgctcagtgcccctgagtatctggacgccccactggactgtatcgagccgcgcctgctgggcaactatgacgatggcctgggcaaccagtggcaagatccccacgcattgcgttttttcgccggtggcgaagtgaacctgccctacctcagcgacggtatgtggttcatgacccagttccgacgctggggcttgttgcgtgaagaccctgactacctgggcgtcgcccggcaggtgcagcaactggcgctgtatcgccaggcggccgagacgctgggcattgccgccagcgactcagagatgcgcagcagccagttgatcgacggcaagacctgggacggctccgaccctgccggctacgcccgcagcttccgcctgcatgccctggccgatgacgccagccgccaagcgctgcgctgaaaggggtaagacaatgctgcgaatcctgttgatcaatgacactgcgcgcaaggtcgggcgcctcaaggctgcgctgaccgaggctggtttcgaagtgatcgatgagtcggggctgaccatcgacctgcccgcacgcgtcgaaacggtgcgcccggacgtgatcttgatcgataccgagtcacccggtcgcgatgtgatggagcaagtggtgctggtcagccgcgaccaaccccggcccatcgtgatgtttaccgatgagcacgacccgcacgtgatgcgtcaggcaatcagggccggggtcagtgcctatattatcgaaggcatccaggcccagcgcctgcaaccgatccttgatgtggccatggcccgcttcgagagcgaccaggccctgcgcgcccagcttcacgcccgcgaccagcagttggccgagcgcaagcgcatcgagttggccaagggcctgttgatgaaaatgaaggactgcaatgaagaagaggcctacaccctgatgcgccgccaggccatgagtcgccaacagaaactgatccaggtggcggagcagattattgccatgagcgagttgctcggctgatctggctcagctcttgctaaacaatcctgacaggtagccaacggcggttgcccctccacgacaaagacgtcgcccatccggtttgcccctcgcgaacctggtggcggcgttttttgcgttttggtcccctagcccccaaccgttgaggtgcatgatgaaatcaagcttttggaaatccgggcataccccgaccctgttcgccgcgttcctgtatttcgacctgagcttcatggtctggtacctgctgggcccgctggcggtgcagattgccgccgacttgcagctgaccactcaacagcgtggcctggtggtggcgacaccgatcctggcgggcgcgctgctgcgctttctgatgggcatgctggccgataagctatcgcccaagaccgcaggtttgattggtcaggtgattgtgatcgtggcgctgttctgtgcctggaaactggggatccacagctacgagcaagccttgctgctgggcctgttcctgggcatggctggtgcctcctttgcggtcgccctgcccttggcgtcccaatggtacccggcggaacaccagggcaaggccatgggcatcgccggcgccggtaactccgggaccgtgttcgccgcattgctggcaccggtgctggcggccgcgttcggctggagcaacgtgttcggctttgcgctgattccgctggtgctgacgctgatcgtgttcgcctggctcgcacgcaatgccccagagcggccgaaagccaaatccatggccgactacttcaaggccctgggcgaccgcgacagctggtggttcatgtttttctacagcgtgaccttcggcggttttatcggcctggccagcgccctgcccggctacttcaacgaccagtacggcctgagcccggtgactgccggctactacaccgccgcctgcgtgttcggcggcagcctgatgcggcccttgggcggcgccctcgcggatcgattcggcgggattcgcaccctgctcggcatgtacggcgtggcggtggtgtgcatcgctgcagtaggtttcaacctgccgagttcttacgcggcattggcgctgttcgtctgcaccatgctcggcctcggcgccggtaatggcgcggtgttccaactggtgccccagcgttttcggcgcgaaatcggcgtgatgaccggactgatcggcatggccggcggtatcggtggctttgccctcgcggcgggcatgggtgcgatcaagcagagtaccggcagttatcaactggccctgtggttgttcgccagcctcggtgtgctggcctggttcggcctgcatggcgtgaaacggcgctggagaaccacctgggggtcggccgccgtgaccgccgcacgcgtttgatgagcctgcaactgagcgttgcccaggccagtgccatcggcccgcgcagcgaaaaccaggatgcgctgcgcgtggtcacgcccctggcggaactggcggcgagcaaaggctacctgtgcgcactggccgatggcgtcagccaatgcgccgacggtgacctggccgcacgctcgaccctgcaggccctggccctggactactacgccacgccgcagacctggggcgtggcccatgcgctggagcgtctgctgctggcgcagaaccgctggttgcaggccaatggcggcgggcaaccgttgctgactaccttgagcgccctggtgtttcgcggccggcgtttcaccctggcccatgtcggcgattgccgggtatatcgctggctcgacggcgagttgcaacgcatcagcgaagaccatgtgtgggaacagccgggcatgcaacatgtgctcaagcgcgccctcggcctggatcagcatctggtgctggatttcctcgacggcgaactgcgcgaaggtgaatgcttcctgctgctcagcgacggggtgtgggccacgctgggcgacgccagcatcggcacgatcctgcatgaacaaagcgacctcgacctggccgtcaacaccttggtcaacgctgcgcacctggccggcagccaagataacgccagtgcgttgctggtgcgcatcgaccaactcggcgccgccaccctcggcgacgccctggtgcagttacagcaatggccgctgccgccagtgctgaaggccggccagacctttgaaggctggcgagtggagagcgtgctggccgagagtcggcagtcgctgctgtatcgggtccgcgatgcccagcatcaaccctggctgctcaagaccctgccactgagccacgacgacgacaccgaagcggcccaagccttgttgtcggaagaatggttcctgcgccgagtcgccggccgcgcctttcctgaagtccacgccgccagtggtcgtcagcatttgtactacgtcatgcgcgaatatcccgggcagaccctggcccagctgttccagcagcaaggcccgttgccgctggcgcagtggcagactatcgccgaacgtttgctgcgcgccgtaggcctgctgcatcgccgacagatcctgcaccgcgatatcaagccggaaaacctgctgctgggagacgatggcgaactgcgggtgctggacttcggcctggcctactgccctgggctgtctgaagaccgcgcccatctgctgcccggcaccccgagctttattgcaccggaagccttcggtggcgagcggcctacggcgcaacaggatttgtatggcgttggtgtgaccttgtattacctgctgaccgggcattacccctacggcgaaatcgaagccttccaacgcccgcgctttaaccagccggtcagcgccagccgctatcgtcccgacttgccggattggttgcccctgagtctggaacgtgccgtggccatccttcccgcccaacgttatgaaaccgccgaagaatggctgctggtactggaacaggccgaccgccgcgaactcaatgtacgaccacggcctttgctggagcgcgaaccgctcaaggtgtggcagaccctggcggtggcttcgctgctgatcaatctggtgctgatgtactggcttttgcaccactaacgagcaaaatccgtcgaggctctatttaaacgcccaataaaacagggggcattcgaacttggcacagctgctgcattagctttcccaacaacccacatacagccgccccttcaacgacgaaggcgcgtgcttcccgagagaacgggaccaggacaaaggcgtcctcgctagctgactagcggggacgcctttttttgtttgcgcgtgtttggtcggagagcgacatgaaaaaactcaagctggtgatgatcggcaacggcatggccggggtgcgtaccctggaagaactgctcaagctcagcagcgacatttatgacatcaccgtgttcggcgccgagccccacaccaactacaaccgcatcctgctgtcgccggtgctggccggtgagcaaaccttcgaagagatcgtactcaacgacctggactggtacctggacaacaacgtcaagttgctgctcaaccgcaaggtggtgcagatcgaccgggtcaagcgcagagtcatcgccgaagacggtactgaggccgaatatgatcgcctgctgatcgccaccggttccacgccgtttatcctgccgatccccggaaacaccctgcagggcgtgattggctaccgcgatatcgccgatacccaggccatgatcgacaccgccaagacccacaagcatgcagtggtgatcggcggcggcctgctcggcctggaagctgccaatggcctgatgctgcgtggcatgcatgtaaccgtggtgcacctgggcgaatggttgctggaacgccagctggacaaaaccagcggccaactgctgcagaccgagctggaaagccgtgggctggtgtttcgcctgtgcgaacagacccaggccctgcacgacgccggcaatggccgggtcggctcggtgcagttcaagaatggcgacatcatccccgccgacctggtggtgatggccgccggtatccgccccaataccgaactcgcggaaaagtccggcatcccctgcaaccgtgggatcctggtcaatgacacgatgcaaacctacgatccgcgcatctacgccatcggcgaatgcgccagccatcgcggcatcgcctatggcctggtggcgcccctgttcgaacaggccaaggtctgcgccaaccatctggcccagctgggttttgccacctacaagggctcggtcacctcgaccaagttgaaagtcaccggcatcgacctgttctccgccggcgacttcatgggcgcagaaggcaccgagaccatcaccctctccgacccgatcggcggcgtgtacaagaagctggtgatcaaggatgacatcctggtcggtgcctgcctgtacggcgacaccgcggatggtggttggtatttccgtcagattcgcgagaaccacgccattggcgaaattcgcgatcacctgatgttcggtgagaatgcgctgggcgacgtcggccaccaagggcaggacaaggccatgagcatggccgacagcgccgaagtctgtggctgcaacggcgtgtgcaagggcaccatcgtcaaggcgatccaggaacaaggcttgttcagcgtcgacgaggtgaaaaagcacaccaaggccgccagttcctgcggctcctgtgctggcctggtggaacagatcctgatcaacaccgtgggcggtgccgccgacgttaaacccaaaagcgaaaaggccatctgcggctgcagcgatctcaatcacgggcagatccgccaggccatccgcgagcagcacctgctgaccatcgacagcaccctgcgttacctcaactggcgcacgcccaatggctgcgccacctgccgcccggccctcaactattacctgatttccacctggcccggcgaggccaaggacgacccgcaatcacggctgatcaacgagcgcgcccacgccaatattcagaaagacggcacctactcggtagtcccacggatgtggggcggtgtgaccaacccctcggaactgcgccgaattgccgacgtggccgacaagtacaacgtggcgatggtcaaggtcacgggcggccagcgtatcgacctgctcggcatcaagaagcaggacttgccgggcgtatggaaggacctggatatgccgtcaggtcacgcctacggcaagtccatccgcaccgtgaaaacctgcgtgggcagcgagttctgccgattcggcacgcagaactccacgcaactgggcatcgagctggagcatgacctgttcaacatgtggtcgccccacaaggtcaagctggcggtctccggctgcccacgcaattgctcggaagcggggatcaaggatgtcggaatcatcggcgtcgactctggctgggagatgtacatcggcggcaatggcgggatcaagaccgaagtcgcggagttcttcgtcaagctgaaaaccgctgaagaggtgcgcgaatacaacggcgcgttcctgcagctgtaccgtgaagaagctttctacctggagcgcacggtgcactacctgcaacgggttggcatggagcatatcaagaaggcggtgcttgaggacccggcccgccgcaaggccctcaacgagcgcctgcagttctcgctgtcattcgagcaggacccgtggaaagagcgtctggaacagccgctgctgaaaaaggaattcgacgttatcgctgtcaaacagctggaggtctcgctatgaactggctggatatctgcgccctggatgaaatcaacaccctgggctcgcgcatcatcagtgggccgaaaggcgacatcgcgatttttcgcaccagtgacgacgaagtcttcgccctcgacgaccgttgcccgcacaagggcggcccgctgtcccaaggcttgatctacggcaagcgcgtggcctgcccgctgcacaactggcagattgacctggcgtccggcgaagcccaggccccggatatcggctgcgcccaccatcaccaggcccgggtggaaaacggtcgggtgatgctggccctacgggacgctggttgatgaaccgccagaccaccgcgtccacctgctgttattgcggggtgggctgcggcgtgctgatcgagcacgacggcgtgcagatcctcggcgtgcaaggcgacccaaaccacccggccaacttcggcaagttgtgcagcaaaggcgcgagcctgcacctgaccggcgacttgagcgcgcgcgccctgtacccgcaattgcgcctgggcaaggacttggcacgcacgcgcaccgattggggcaccgccctggaacacgcggccactgtgttcgccgacaccatcgccgaacatgggcccgacagcgtggcgttctatatctcggggcagctgctgaccgaggattactacagcttcaacaaattagcccgggccttggttggcaccaacaatatcgacagcaactcacggctgtgcatgtcttcggccgtggtcggctacaaacgcagcctgggcgccgatgcaccgccgtgcagctatgaagacctggaaaacagcgactgcgtgatgatcgtcggcagcaatatggcctacgcccacccggtactgttccgacgcctggagcaagccaaggcgcaacgcccgcagatgaaagtggtggtgattgaccctcggcgtacagacacctgcgatttggctgacctgcacctggcaatcctgccggggacggatgtggcgttgttccatgggatcttgcatctgctgctgtgggaaggctggatcgaccacgcttttatccaggcccacaccgagggcctggccgagctgaaacgcctggtgcatgactacacgccgcaaatggtcacgcagctgtgcggcatcagtgtcgagcagttgcgcctgtgcgcccagtggataggcacttccagtagttttttgtcgctgtggtgcatggggcttaaccaatccactgctggcagcgcgaaaaacagcgcattaatcaacctgcacctggccacgggcaccattggccggccgggctgcgggccgttttccctgactggacaaccgaatgccatgggtgggcgcgagaccggcagcctgtccaacctgctgccgggccatcgtgacgcagccaacccagaacatcgcgccgaggtcgcgcgttattggggcgtggatcaactgccggcgcccaccggcctcactgcgatcgaactgtttgaacaggtgcaggccggcaagatcaaggccctgtggatcgcctgcaccaaccctgcccaatccctgccagaccagagtgccgtgcgcgcagccttggcggcgtgcccgttcgtggtgctacaggaggcgttccgcaccaccgaaaccgccgcctatgccgacctgctgctgccggcagccagttggggcgaaaaggacggcaccgtgaccaactccgaacggcgcatttcccacgtacgccatgccatcgacccaccgggagaggcgcgggcggactgggcaatcaccgtggatttcgcacagcgcctggaacagcgcctgcggcccggcgcgcccagcctgttcgcctttgaagagccggcgcagttgtttgatgaattcaagcaactgactcaaggccgtgacctggacttgtcggggatcagtcatgccctgctcgaccagcttggcccacagcaatggccatttcccgagggcgcgcagacgggtacgccgcgcctgtacaccgacggtattttccccacggacgatggccgggcgcggtttatcgccgacccttaccgcgccgccaaggaacagcgtgacgcacgattccccctgaccctgatcaccgggcgcctgcgcgaccagtggcatggcatgagccgcaccggcacggccgcgcagttgttcgggcatgtcagcgaggcattgttgggtttgcacccggacgaactgcgtcgccatcgtttcaaagaaggtgacctggtcaacctgaaaagccgtcgaggcaatgtgatcgtcgccgtcagcagcgatgacagcgtgcgccccggccaggcgttcctgcctatgcattggggtgaccgctttctcaagggcggtgtgaacgtcctcacccagccggcgttcgatccactgtccaagcagccggaactcaagcacagcggcgtgcgcctggaagcggtgcaactgccgtggcagctgtttgcgctgatcgagggcgatgtgcagcaacacttcgaagccctgcgcccgctgtgtgagggctttgcctacgtgagcctgagcctggccggacgtgagagaccagcgctgctggtgcgggcggcacataccgaggcacccgacctgcaacagctgaaccgcattgaccaactgctgggactggacgacgggccggtcatggcctacgacgacccgcgccgctcaatcggcaagcgcgtgaagatcgagaagggacgcatcaccgccctgcgcctggccggcgaaaccctggcccgtcactggctgcaaagcctatggctggaaggtcgcgccgacgaacagctgcgacgctggctcctggcgccattaagcgcgccaccaggcggtgcggcggccagcagcaagattttgtgtaactgcaagaacgtcagtgaaaacgccgtatgcgcaggtattgcccagggcctggacctggacggcctcaagcaggaactgggctgcggcacgcaatgcggctcctgcgtaccggaaatcaaacgtcttttggccagcaccccgcagccaatcgcaatcagtgtgtgagggaacaacatgagcgcaaaagtgtggctggtaggcgccgggcccggtgatccggaattgctgaccctcaaggcggtcagggccctgcatgaggcggatgtggtgctgattgatgacttggtcaacccggcagtactggaacactgtaacgctgcacgggtggtgactgtcggcaagcgcggtggctgccgctccacgccccaggaatttattcaccgcctgatgctgcgttatgcacgccagggtaaatgtgtggtgaggctcaagggcggcgacccgtgcatctttggtcgcggtggtgaagaggcgctgtggctgcgcgagcacggcgttgaagttgaattgatcaatggcatcacagcagggctggcgggtgcgaccaactgcgatattccgttaacgctgcgcggtgtcagtcgcggggtgacattggtcaccgcccatacccaggacgacagccaactgaactggcgcgcactggccgaaggtgggaccaccttggtggtgtacatgggagtggcgaagctggaggaaattcgtcaacaactgctggacggtggcatggcggctgatatgcccgtggcgatgatcgaaaacgcatcgctgccccggcagcgcgaatgccgcagcaatctggcgcggatgcatgaggacgcgcaggcattcgccttgaaaagcccggcgatcctggtgattggccacgttgctgctgccgcacagacggcttgtgtcgctgcagcggccagcgcctgaggcaaattgcaggcgaaaaaaacccggcctaagccgggtttttttataaagccaggctaattacttagcagtggcttcaacagcagcttctacgcgacggttaacagcgcggccagcttcagttgcgttgtcagcaactgggcgggactcaccgtaacctacggaagtgatgcggcttggagctacgccatctttaaccaggacttgcttaacagcgtcagcacgacgctgggacagcttctggttgtaggcgtctggaccgatggagtcagtgtgaccagcaacttctacgttggtgtctgggtactgagccatgaagtcggccaggtttttcacgtcgccgtagctgttaggcttaacaaccgacttgtcgaagtcgaacttaacgtccagctcaacacgaacaacctgagcaaccggagcttctggctctggaactggctctggagctggtgctggggtaggagctggagcagctgcgccagcgttaccgccgaagttcacgcccaggccaaccagtgcggagtagtcccacttgccgttgtccagaccgtagtcagcttcaacaccagcacgtgcgtacaggttgttggtgaagtagtacttcacgccggtaccgatggtagcgaaagtggtctggtcgcgaccgctgtggccatcagccttgacgttggtacggctctggtggccgaaaccgccttcaacgtatggacgcaggctatcaacgccagcctgaccgaagtggtactgggcaacgaggctgccagtgtcacctttgatcttctggttgccagtgccgtcgttcgaacgggtgtggttggtcttgtcgtacgacagattcaacgacagatcgtcggtcaggaagtaaccaatgcgagcgcctgggttgaagccgtcttcgatgtgcttgacgctatcgttgtactgcttcttgtagaacagctcgccttcaactgcgccttggccttgtgccagaacgccgaaagaagtagcggcaataagagaaccaatggccaagcccaaggtgtttttcagtttcatccgttaaatccccatctggtgattgtaaagcagtcccacaaaccgggggacaactcggcgacaagtctaacagaacttgcctacacgtaagagatatttgctacgcactaagtttcagtctcgcccgcaaatttctcacgtaatttatcaagagcacgtttgtaacgcatttttgtagcactcaagcccatatgcatgatgtcagcgatttcctgaaattccagctctgcgacaaagcgaagcaccagaatttctcggtcaatcgggttcacatgcaccaaccagcgatcaagtccgcccttctcctcgggtgccggcgccttttcctcagacgcctcctcaagggggtccagactcaaagcgtccatcaagcgacgctttcgccgttccttccgatactgcgtgatgcactcgttgtacgtgatgctgtacagccatgtcttgaacttcgatttgccctcgaagttcttcaggccgtagagcaccttgagcatcacttcctgacagacatcatccgcatctctatcgttccccaaataccttgaacaaacgttgaacagagtgcgttgatacctgcgcatcaattcttcgtacgcacgtgttacgtgaaacagctccgtgtgcgagcgcgcgaccaactcctcatcagagagctcacgtgggtcatagcgcgtggacagcgtttgggctttattcaaaacaagtcgtgccgacagtcaggtcaatgtccgttgcaacccggtcacccgggttcgcggcggcgtacattagcagggttttccggattagcggctactgacctgctgctcaaggagaatcctgttggacagcgacaccagttccccgtcatcggtcagcacggttgtcttgactgtgccgatctcctcgatttgcccttcgacctcgcccacacgcacctgttgcccaacttgatacagctcacgcacatagattcccgcaagaatctggccggcaatttcccggcttcccaagcccatggccagcgcaacggccagaccaacggtaatcaaaacaatcacaatcacgtggttgagcaggtcagtcttgacctccaactggctgatcgcgacagaaatactgatgatgatcaccagcccctgggcgattcgccccaagcctgccgcatagtccaaccccacgccttcagcggccccgcgcaccagcccgttggccagttgcgccagtaaaacccccaccagcagcaccagcgcgccaccgaagactttcggcaaatacagcgccagcatgtcgagcgtagctgaaactcgctcaagtccaagggattgagccgcagaaaccagaaaaataagtagaacgaaccagtagacgatcttgccgatcagggtcgaaatcggcacttgcaaccctgcccggcccagcaacttggtaaggccggtgccggccatcaggcgatccagccccagtttcgccagcaacttggacagcagggtatcgagcaacttggccacgacaaaacccagcaataccaggaccagggcgccaaacaggttgggaatgaaattcgccaccttggtccacaatgcggtcatcgcggtgaccaggctctgggtccagagatcaagttccatattcaatcagccttatcagcagtgcgagcaagaggtttacgacgggaaaccggtgaaacatgggccgaaccgttgttcagggccatcatcaatgccggcagccagcgcccgagcagaccgaacagatctcccgccccgacctgacggttggcggttttcagtacgcgacccaggcaagcatcgtcatcacggttggatggcgaggcattgagcatgtcacgcaaagactgttcgaacggatcgtgcataagagacctctcgcaagtgttttaaaagacgagggtaaatttcatggggtcacatcggccccttcttacgttcagctcatattcaggtcaaacccagcgcaatcgtcgaaataaccaccactgcccgagtgccacagagaccatcaacaggcaggcaatcatgaatccataagggctggaagagaacggaatgccccccacatttataccgagcaacccggtgagaaaactcatcggcaagaagatcccggtaatgatcccaaagcggtacatggtgcggttcatacgcacgctcaagcgcctatcttcggcctcaagcacaagccccacgcgctctcgcgccaattccagctcttccaggtaacgggtcaggctgttgtgcaattcattccaatagtcggcatcgtcgtcacaaaaccacgccagtttgatccgcgtcagctgggcgaaaatatcccgctgcggcgccaggaaacgcttgagccctgccgctcgccgacggatctgcaaaacgctgccgtgctcaggggtataccgttcgtcggcatcgagtttttcttcctcggcatcgacgatttcagacaaggacgtgaccagatcctgcactttattggtcaggtactgggccatataaaggatgagttcagacgcagtccgtgggcccttaccctcagccaattgcaccagcagctcatcggtcgcacgcagcgggcgcaaacgcagggaaatcacccggttggcggcggcgaagatgcgtaccgagaccatgtcctcgggctcggcgcctgggttgaggttgatcccgcgcagaaacaacagcaattcggcgtccggcagcggcaacagccgtgggcgagtgttctcttccagcagcaggtcacaggcaaactcactcaggccgctggatttgcgtagccaggtctgggtctggggatggctgcgatcccaatgcagccacaggctttcatggggctgcacttgcaaatcgtcgagctcagtccgggcaatcgaacgcgcaccgcctttaccgtccagcaccagggcatgtaccagcccccattgcgcgttctcttcctcgaacatcctcacccctatcggctactgcggtttattcaggcattttcagcgggctgggcgatacgatcacgccgttgttatcggcatagatgtactcgcccgggcggaacgtcacgcctgcgaacgtcaccaccacgttcaggtcacccagaccgcgcttatcggttttcatcgggtgcgaggccagcgcctgcacgcccaggtcggtctgggcgataacatcgacatcacggatgcaaccgtagatcaccagcccttcccagccgtttttcgcggctttctcggcgatcaggtcgcccagcaacgcacgacgcagggaaccgccgccatcgaccaccatgactttgccggcgccaggctggtccgcctgttccttgaccagggagttatcttcgaagcatttgatggtgactatctcgccaccaaaggagtctcggccaccgaagttgctgaacatcggttccactacctgcacgagctccgggtaggcgtcacacaggtcgggggtcacgtaatggttcatcgagaaactcctgtcgtcaaagaagaggtcaaacatccacgctgtacatcaggaaaacgcgccgcgacaggcattctttaagtgcgtgtcggtcagcggcggccatgatcagatccacctcggtgcaacgcaatacacgttgcgcgactgaatatgaccagaagtgcctggcgcgtcatatcttagccgcaaccactcaagagtgaaacgcccttggtagagcgtttcgtcaaaccgccgcggccatgtcgggctgcgtaccgaataaaggtgtcagcgggtctcgcaaccaacgctccaccaatggccatacttcggcctgcgcggccttgctgaccagcatctgcacatgtccaaaatcctcactgaaaccttgcttgcgccccagacacaggtactgacgatgctcgctgccgacttgctcgaagagctggcggcacgcccagtcagggtcttgacgatcaccggccgcactgaccgccagcagtggcacgtcgacctctgccaggcccttccaccaatcacgctcggcatcgccaaaacggccaaacaggccgttccagcgcatcgcttcgattatcacaccggccggctcgtcctccgggccgcgcttgaatcgcgggccggacacctgggcaaggcgcttgaggataagacgcccgccccactccaccggtggaattttcaacggccaatgggtgcgactgacctggcagccgaacaaggccgcagacgctaccattggcgcccccaggtgttggccacccagggccgccgccaaggtcgtggcacccagtgaatgcccgacccaatgggggatttgcccgctttgctcacgcacaaacgccccgatggccggcaaatcgtagcgtgcgtaatcagcgacacggtttctggcgtagtcctggttgcgcttggacaggccatgcccgcgcatttccgggatccacacatcaaagccccggcgcgccaggtaagcgcccaggccgatgcctttgggggagtaccagaagcctcgattggaaaaactgccgtgcaacaaaataatcggcgtgccccggttttcagggacattggccaggcccaaacgggtcaccgccagttcgacggtgccgtcgggactgttgccgggcttgagccggtacacatcttcactcaggtcgccacgacgctcagcgctgatcaaggcgacaggaaatagtttgctgctgctttgcataatgctcttgcacaaaaaagggcggcgtccgcaaggagttccgccctgtacagataagaatgccggtcaccctctacgagtgaccggcacttttgacatagcgaccttaggccgacgcttggccttccgccaggaagaaccaggtttccagcacggaatcggggttcagcgagacgctttcgatgccctgctccatcagccatttggccaggtcagggtggtccgaagggccctggccgcagatcccgatgtacttgccggccttgttacaggcctggatggcgttggccagcagcttcttgaccgcagggttacgctcgtcgaacaggtgagcgatgatccccgagtcgcggtccaggcccagggtcagctgggtcaggtcgttggagccgatggagaacccatcgaagaactccaggaactcttcggccaggatggcgttggacggcaactcgcacatcatgatcacgcgcaggccgttctcgccacgagtcaggccgttttcggcgagcaggtcgaccacctggctcgcttcgcccagggtgcgcacaaatggcaccatgatctcgacgttggtcaggcccatctcgttgcgcacgcgcttgagtgcacggcactcgagctcgaagcagtcacggaaggcttcgctgatgtagcgcgaagcaccgcggaagcccagcatcggattttcttcttccggctcgtagagcttgccgccgatcaggttggcgtattcgttggacttgaagtccgacaggcgcacgatgacttttttcggatagaacgccgccgccagggtactgatgccttccaccagtttctcgacgtagaagcctaccgggtcgttgtagccggcaatgcgcttgtcgacgctttccttgatgtccagcggcaggccgtcgtagttcaacagagccttggggtgcacgccgatcatgcggttgatgatgaactccaggcgggccaggcccacaccggcgttcggcaactgcgcgaagtcgaaggcgcgatccgggttgccgacgttcatcatgatcttgaacggcaggtcaggcatggcatcgatggagttctgcttgatatcgaagcccagctcaccttcgaagatgaagccagtgtcgccttcggcgcaggacacggtcacaccctggccgtccttgagcagttgggtggcgttgccgcaaccgactaccgcaggaatccccagctcacgggcgatgatcgccgcgtggcaggtgcgcccgccacggttggtgacaatggcgctggcacgtttcatcaccggttcccagtccgggtcggtcatgtcggagaccagcacgtcgccgggctggaccttgtccatctcggacacgtccttgatgatccgcaccttgccggcgccgatgcgctggccgatggcacggccttccaccagcacggtgccggtttccttcaacaggtagcgttccatgacattggccgaagtgcggctcttcacggtctcgggacgggcctgcacgatatacagcttgccgtcgtcaccgtccttggcccactcgatgtccatcgggcacttgtagtgcttctcgatgatcatcgcttgtttggccagctcgctgacttcagcgtcggtcaggcagaaacgcgcgcgctcggccttgtcgacgtcaacggttttcaccgagcgaccggccttggcctcgtcgccgtagatcatcttgatcgccttgctgcccaggttacggcgcaggatggccgggcggccggcctcaagggtgtgcttgtgcacgtagaattcgtcggggttgaccgcgccttgcacgacggtttcgcccaggccgtaggcacccgtgataaataccacgtcacggaagcccgattcggtgtccagggtgaacatcacgccggccgtgccggtttccgaacgcaccatgcgctgcacgccggcagacagggccaccagcttgtggtcgaaaccctggtggacgcggtaggagatcgcccgatcattgaacagcgaggcgaagacttccttggctgcgcggatcacgttttccacgccgcggatgttcaggaaggtctcttgctggccggcgaaggaggcgtccggcaaatcttcggcggtcgccgaagagcgcacggccacggccatgtccgggttaccggcggaaagggtcgcgaaggcggtacggatttcttcgttgagcttctcggggaactcggcttccatgatccattggcggatctgggcgccggtcttggccagggcgttgacgtcgtcgacgtccagggcatccagcgcggcgtggatctgggcgttgaggccgctcagctcgaggaagtcgcggtaagcctgggccgtggtggcgaaaccaccgggcaccgagacaccagcgcctgcaagattactgatcatctcgccgagggatgcgttcttgccccctacgtgctctacatcatggacgccgagcttatcgagggaaactacgtactctaccaaggtgatctctccactttctgtgttggaaaagctcaggacgccggctgctcagtaggagctaacgccagcgcttgtggcctggacctggaaaataagtgagaatgcggcccactgcgggacggcaaaatcgcgcctatcatatccaagattcgccatcagcttaaggcccagggctcaaatgaaacgatctgctttctttatctccgacggcaccggcatcacagccgaaacattgggccagagcctgctcgcgcagttcgaaaacattaccttcgccaaattcacacggccttatatagacagcgtggataaagcgcgggccatggtacaacaaatcaatctggcggctgaaaaagacggatttcgtccgatcattttcgacaccatcgtcaatcaagacattcgtgagattctcgcaacgtcgaatggtttcatgatcgacattttctcgaccttcctggcgccgttggaacaggagttgagtgaacactcctcctactccgtcggcaagtcccactccatcgggcacaactccaactatatggagcggatcgaggcggtgaacttcgccctcgacaacgatgatggcgcccgcacccactactacgacaaggccgacctgatcctggtgggcgtgtcccgctgcggcaagaccccgacctgcctgtacatggcaatgcaatttggcatccgcgcggccaactacccgctgaccgaagatgacatggagcacctgacgttgcccacggccctgcgcgcccattcgcacaagctgttcggcctcacgattgacccggatcggctgaccgccatccgcaacgagcgcaagcccaacagccgctattccagctacgcccagtgtgagtttgaagtgcgcgaagtagaaaatctgttccggcgcgagaatattgcgcacatcaattccacgcatttttcggtggaagagatttcagcgaagattttggtggagaagggtgtggagcggcgcttcaagtaatctctgtcgcctgatctgacgctatcgcaggcaaacctgctcccacagttggaatgcgttctcctgtgggagctggcttgcctgcgatgaacggtaacgcggatttacagatgaaaccgcccgcccccctgccccaacgccgtcgccagcgcatcaaacccctcgcgcagtaactgatcatcgccagatgtattgcagatactcgcccggataaactgcggcaccgccgtctgccccacggcgaacgcctcggcagtggcaatcaggtaattattttgcttgagctctgcctcgatttccgacgcacgccatggctccggcacctcaatccagaagtgtgggctattaaggtgagtgcgataggccaggccatcgagcaggtcgctgaccaaggctttgcgacggctgatttcgttgatctgctggcgcagcaggtactccgccgtgccgttctcgatccattgagtggccagctccagggtcacgggcgtggccatccagcaggtcgagcgcagtgccgccgagatgcggctgaccagtgccggtggcgcgtgcacgtagccaacccgcaagcctgccgacaccgccttgctgaggctactgatcaaaatcgtacgctcaggcgcgaaatagctgaggggcggcggacgatcttccaccagcacgccgtgggcttcgtcctcaagaatcagcaggttgtgttcgcggcacacctttgccagggcttcgcggcgcgcaaccgataacaccgccgtcgtcgggttctgaatagtcggcgtgcagtacaacgccgaaatccggtgattacgacagacctcgtccagcgccgtaggcagcacgccctcctcatccatgtccaggccaatcagccgtatgccgagcatgcgtgcagcggtaatcagcccgggatacgtcagttgctcggtgaccaccgtatcgccggcgcgcagcaacgccatcatcgcgcacaacaagccatgctgaccgccgttgacgcagatgacctgctcggggatcggatgaaaatcgcgctgcaccaaccattgggcaccggcttcacggtaccgcggcaggccggcgtcgggggtgtaggcactgatgtcctgaagaaacttggcgttggtcgacagggtttggaagctctgggcgagaaacgccgtctcctgcccaggaatatgcatgttgcggctcatgtcgaagtattggcgcggctcctcgctgaaattgcgaaagccttcatcgcgctgacgctccatcccacgcttgcgcacgaaggttccatcacctactcgcgcgaccaccaaccccaagcgctccagctcaccataggcgcggctgatggtgccgatggtcacccccagattgtcggaaagcacccgatggggaggcagttttcgtcccggttcaatcaagccttcgaggatgcccctctccatgacatcggacaagcgcttgtacttcacgccctgcccgctggacaacccctcacgcataattgacaccatgtcaatatttgttttgacagtcatcttttgccctaatagtgtgcttttacgggttcaatcgccgataaacatacctcattacaagttcaatatagagttcaatttcggctcagggaagcaataaacgatgccaatgtccgccgttctcgaaaacactgcaaaaacaaaaacgcaaaaacagtggttggccgggctggtgaccagcgtgatgttcctcatcgtatgcctgagctggggcaccacctggctgggcatcaagattgccgtggagagcgtgccgccgctgacctccgccggcctgcgcttcctgatcgccttcccgctgttcctgtgttttgccctggtacggcgcgagccgatcctgttcccccgggaaagtcgctggttcttcgtgttcgtgaccctgtcctacttcagcattccttattacctgctcaactacggcgagatgcatgtgtcgtccggcctcaccgccctgctgttcagctgcatgccggtgttcatcctgatcttttccgcgctgttcctgcgtgagcgcatctacttctcccaggtagtcggcatcggcatcggtttcgccagcctctacatgatcatcagaagccagggcctgcacctggaccacgccgagttcttcggtgtgctggccatcctgagcgcggcgatcatgcatgccttgtgctatgtcatcaccaagcaaaaaggcagcgccatcagcgtgattacctacaacaccctgcccatcggcattgccgggctgatgctgttcgtggccggcctgtggtttgaaacaccggtcttccacgccatcaccctgcgttcctggagtgcgctgttctacctggggctggtggcctcggtaggcgggttcatcgtgtatttcatgctgctcaagcgcctgagcccgatcatcctgtcgttcgtgttcattatcttcccggtgttcgcggtcatcatcggtgcctggtacgaaggcgtggaaatttcccgtgacctgatgctgtactcggcgatcctgctggccggctttgcgatcaccaagttgcccatcgaaaaactcctggccaagaaaaattgacccccaaccaacgcgagagaaacatggaagtcctccgccccaccgccctggaacaaatctacgcccacgccagccgcagctaccccgaggaatgttgcggttttgtcttcgccgacggcagcgtgtacctgggcagcaatatccagaacgagttgcaccgcaagaaccccgagatgtacccgcgcagcgcggccaacggctacaccttctcggtggccgacaccttgttgatgaacaaggcgtttcgcagcgacaacccggtggtggtgatctaccactcgcacccggatgtcggcgcttatttcagtgacgaagaccaggacaaggcgctgttcctgggggagccgatctaccccgtcagctatctggtggtggatgttcgccagggccaggccctgggttcaaagctgtttgcctgggatggcaagcatttcgcccttcaacccttcaacgacctgcacacggagttgtccatgaacgctgtctctttccccgacatcctggtccgcgtggccaagctgccggaatcaaccctcgagggcactggatcgacattgcgcgaagtcattgaaaacctctgcagcagttacccgcagttgcgccagcacctgtttcatgaaaacaacaaccaactcaaggaacacttcctgttcaccgccgaggaagaactgatcgaggccgacgaacgcttgccggaaaaagcccgcatcgaagtgttgcttgccacctccggcggcatggacgtcgataccctgagcaatgaagaagtgcagcgctacgtgcgccacatcaccctgcccggcgtcggtcgcgagggccagttgaacctgaagaaagccaaggtgctgatcatcggcaccggcggcctgggctcgcccatcagcctgtacctggcggcggccggcatcggcaccctagggctggtggactttgatgtggtggaaagcagcaacctgcaacgccaggttgtccatggcaacagcaccctggggatgcccaaggtcgagtccgccaagcaacgcctgcaagacctcaaccgccatatccagatcaacgcccacgacacggcgctcaacgccgacaatgccctggagctggtgggcgcctatgacctggtgatcgacggcaccgataattttgacacccgctacctggttaacgacgcctgcgtacagctgggcaagcccttggtgtacggtgccatctaccgcttcgatgggcagatcagcgtgctgaactataaaggcgggccatgctatcgctgcctgtttcccaaggctccccctgccgaactggcgcccaattgcagcgccggcggcgtgatcggcgtgctcccgggcgtggtgggaatgatccaggctaccgaggcgatcaagttactcatcggcattggcgagcccctgtccgggcgcctgatgcgcttcgacgcgctggcaatgaaattcagcgagatccgcttcaagcgccgcgccgactgcccttgctgctcggagctgcgccacagcgaaaccctggccccggcgatctgcgcagatgccgtaccaagccaaccatcgctagcggcagagcgctacataaagccccaaggcctcaagcaagtgctcgaacaccccagcagcgccgatgtactgctggatgtgcgcgacgccagcgaactggaagtgtgcaaactaccgggcgtggtgcatatccccctggccgagctggatgggcaattggccaacctgagccgcgacaacacccattacctgatctgctacgcgggcacccgtgccgagcaagccgccagcaccttgctggcggccggctttgccaataccaaagtcctgcagggcggtatgaagcactgggttcgcgacgtcgaacccgacatgcctttgtattgatcgtgggggcgtgctgatgttgcataactcgattctcgacgtcatcggccagacgccgatcgtgcgtctggcccagttctccgaagacctcggcatcgaggtctacgccaagctggagtccctaaacccgggcggcagccacaaggcgcgcatcgccctgggcatgatcctggatgccgagcgccgcggcgtgctgatccgtgattccggacaaaccatcatcgagcccagtggtggcaacaccggcatcggcctggtgatggccggcaacgtgctcggctacaaagtagtgctggtgatccctgacaactacagccccgaaaagcagaaactgctgcgcctgtatggcgccaaggtggtgctgtcggacagccgcctgggtaacaattcccacggcgaaaagtgcatggaactgcagttggagaaccccaactacgtgatgctcaaccagcagcgcaacggcgccaaccctcagacccaccgcgacaccaccgcaccggaaatcatccgcgccttcggtgagcggcgcgtggactacttcgtcagcggtatcggtaccggcggtcatatcaccggcatcggcgaaaccctcaaggcggcttggccggcgctgcgcatcatgggggtggagccggaagaatgcgacctgttgaaagaccagcacgccgcgcacgcgatccagggcctgtcgattggcctgattccgagcatcctcaacctggatgtgatcgacggcatgctcaaggtgtcgcacgcggcctgcctggacatgatcaaacgcatcatgcgtaccgacgccatcagccttgggttgtcctcggccgccaacatggttgccatcgcccaactcgctcccgaattaccgcctgaaacggtggtgttgaccatggtctacgacaatgccgacagctacctgcccagtttcgagtaacgggttttccaaccatccagaatgcgggggtgcctccatggggggctttatcgacatgcaacagctgcacgatgagctgctgacccatctcatcacgaccctgacgcccggacagatgaagcagctggaaccgcaccttgcgccgctgatccagaacgcggcccaggcggtggccgaagacctgatcgcctacgcctatcgtgaccccgcatcacgtgggcgcggggagttgatcctggaatcctatgcctcgttcaaggcagtgctgttctatcgccttgcgcatctggtgtggaatttccccgaccctggccacgcgatgttttcgcgcatggccctcaagctcagcaatcagggcaagatcctctctggcgccgagattcacccggcggcgcgcatcggccggcgctttgtgctggaccacggcttcggcaccgttatcggcgagacctgtgtgattggcaacgactgctacatcctctgcggcgtgaccctgggcgcacgcggcatcgccaacaacccggacggcaagcgccacccgcgcctgggcaacaatgtcgaggtgggcgccggtgcccgggtgctgggttatgtgtcgattggcgataacgtatttatcagcccctcctgcgtgatcacccaggacgtgccggcaggcaccaaggtcaaggtggtcaaccagatccaactgcaaaaaaacgatgaatcggaccacagcaactacctcggcgcctttgccctggatgagcgcttgcatgtcgtcggcgaggtcagtgccggccacaaggtcaccgtgctggatgctgactttcatccactgcaagggttgatgctcgagcccacggtaaaagagcggcatcacttgcaattccgcctgcatcgcctcgacatcggtgaccaactgccgcgcctgccgctgaacctgaaagtctgcggaccagaatttgaaatcaccctgctctctcctcctggcttgagcgcaatggtgcgccacctactgcaagccagcccactgatcgtcggaggttgaacatgtccgtgcacaccatggaaaccctggcgctgttcgacagcgcgccctaccagaacgctttcagcgcccgggtaattgccgtcagcgaacatggcatcgccctggagcacacgctgttctaccccaccggcggcgggcaaccgggcgataccggccatttcaccctgcccgatggcacgcgggtcgaggtgacaggtaccgtgcgcgatccggtgttgcgctcgatcatctggcatcaggtggaccattgccccgagcagttgacggcaggagtccaggtagacgccggcctggattgggagcggcgctaccagcacatgaaaatgcacacctgcctgcacttgttgtgctcgctcatcgacgcgcccgtgaccggttgcagcatcagtgcggataaaggccgactggatttcgacctgccggaaatgaccctggacaaagacgctctaacccgtgacctcaacgccctgatcgaacaggcccacgcggtgaagaccctgtcgatgcccgccaccgaatacgcgaccttgctacagatcacccgcacccaggcggttgcgccaccggtggtgtcgggctcggtacgggtgattgagatccccggcatcgatatccagccatgcggcggcacccatgtgctcaacaccgaggaaatcggccgggtgttctgcgagaagatcgagaagaagagcaagcacaatcgcagggtgatattgcggtttgaacaagcttgcgcctgacccgatagttgccccaatgatggacaaatgtgggagggggcttgctcccgataggggtggaccagtcaatgaatctgttgactgacacccagctatcgggagcaagccccctcccacattggccgcgttgttttttagatcaccaacagatccatgaaacggttcacagccgtggcctcaagccgtgcctgatccttgcacaacgcaaaaatctcagcactgcgctgggcagtgaaccgcgtggccaggttggctttgaacttgtcttccagcaacgggataccgtccactcgacggcgacgatggccaatcgggtactccaccgccacttgctcggtgcaagtgccatcggtaaagaacacttggatagcattggcgatggagcgcttgtcggcttccaggtactcgcggctgtagcgagggtcttcgacaatgaccatcttgccgcgcaactcagcaatgatcgggtgggccgcgtggaagtcatcttcgtagtgctcggccaccaggttgccgaacgccaagggcacggccgtcatgtattgcaggcagtggtcgcgatcggcagcgttggccaattggccaaccttggaaataatccgaatcgccgactcatgggtggtgatcacgatacgttcgatttcatgcagacgatgcttgacctgcgggtgcaaggtcaccgccgcctcgcaggcggtttgcgcgtgaaactccgccgggaaactgatcttgaacagcacgttttccatcacgtaggtgccgtaggcctgaggcaggctgaaggcgcgcttgtctgtgggcttgagcgccaggtccttgttggtgtggctgaacaacacgtcgtagaacccccactgcggcgcactcaacacaccggggatgcccatttcgccacgcagggcgatatccgccaggcgcacaccacggctcgatgcatcgcctgcggcccaggatttgcgcgagccggcattcggtgcatgacgataggtgcgcaacgcctgcccatcaacgaaagcgtgagacaaggccgacagcagttgttcacgattggcgcccatcagcttggcggtgacagcggtggaggcgactttgaccagcagcacgtggtcaaggccgacgcggttgaaagagttttccagggcgatcaccccctggatttcgtgggccatgatcatcgcttccagcaccgcacgcacggtcagcggcgcgtcgccattggcgacgcgcttttgcgacaggtgatcggccaccgcgaggatgccgccaaggttgtccgaaggatggccccattcagcggcgagccaggtgtcgttgtaatcgagccaccgcacgatgcagccaatatcccaggcagccttgaccgggtcgaggcgaaacgaagtgcccggcacgcgcgcgccgaacggcaccacggtgccctccactatcggccccaggtgcttggtgcactcggggaagcgcagggccagcaggccacagccaagggtgtccatcaggcaattgcgggcagtgtccaatgcgtcccgggagtcgatgcggtagttgaggacatagtcggcgatgtcctgcaaaacctggtcgtagtcggggcggttgttctggtcgacgttggcgctcatggcagttctcctaaaagttgggttgttccatcctcagggtcagggttaatcgttgcgcaggtctgattgcctgcttgtatccctgtgggagggggcttgctcccgatgacggtgggtcagttaatgaatggggcgactgacaccctgctatcgggagcaagccccctcccacataaagctaaaaagcgtcacccggaacgcgtacgaagccttccatcagcacccgcgcactgcggctcatgatggcttttttcaccacccattcgccgttcacttgggtggcctcggcgccaacgcgcaacgtcccggacggatgcccaaagcgcacggcatttcgctcaataccgcccgccgccaagttgaccaaggtgccggaaatcgccgccgccgtgccaatcgccaccgccgcggtgcccatcatcgcgtggtgcagcttgcccatggacagggcgcgcaccagcagatccacatcgccggccttgatagccttgccgctggacgccacgtaatccgcaggcttggccacgaaggcgaccttgggcgtgtgctggcgctgggcggcttcgtccaggtgcttgatcaggcccatgcgcaacgcgccataagcccgcaccgtctcgaacatggccagggccttggggtcgctgttgatcgcgccctgcagctcggtgccggtgtagccgaggtcttgagcgtcgatgaaaatggtcggaataccggcgttgatcaacgtggccttgaaggtgccgacgcccggtacttccaggtcgtcgatgaggttgccggtggggaacatcgaaccaccgccgccctcttcttccgccgccggatcgatgaattccagctggacttcggcggccgggaaggtcacaccgtccagttcgaagtcgccggtttcctgcaccgcgccgttggtgatcggcacatgggcgatgatgctcttgccaatattggcctgccatatccgcaccaccgccaccccgttctcgggcacgcgggccggatcaaccaggccagcgctgatggcgaacgagcccactgctgccgacaggttgccgcagttgccactccaatcgacaaacggcttgtcgatggagacctggccgaacagataatccacgtcgtgatcggcgcggctgcttttggccaggatcacggttttgctggtacttgaagtggcaccgcccatgccgtcgatctgcttgtcgtaagggtcgggactgccgatgacccgcagcaacaaggcatcgcgggccgcccccggcacctgcgcgacttcgggcaggtccttgaggctgaagaacacgcccttgctggtgccgccacgcatataggtggcggggatcttgatttgcgctacgtgtgccatggtagtcctcttcaggcggtggccgccgattccaggaaatcctgggcaaaacgttgcaacacgccgcccgcctcgtagatcgacacttcttcggcggtatccaggcggcacgtcaccggcacctcgacacgctcaccattcctgcggttgatcaccagggtcagttgcgcccgcggggtgcgttcgccgaccacgtcataggtttcactgccgtcgatcttgagggtgtggcggtcggtgcccggcaggaattccaggggcaacacgcccatgcccaccaggttggtgcggtggatgcgctcgaagccttcggcggcaatcgcctccacaccggccaggcgcacgcccttggccgcccagtcgcgggacgaaccctggccatagtcggcaccggcgatgatgatcaacggctgcttgcgctccatgtaggtctcgatggcttcccacatccgcgtgaccttgccttccggctcgatacgcgccagggaaccctgcttgaccttgccgttttcctgcaccatttcgttgaacagtttcgggttggcgaaagtagcgcgctgcgcagtcaggtggtcgccacggtgagtcgcataggagttgaagtcgacctccggcaagcccattttcgccaggtattcacccgcagcgctgtcgagcatgatcgcgttggacggcgacaggtggtcggtggtgatgttgtccggcagcaccgccagcgggcgcatacccttgagcggccgcgcgccggccagcgcgccttcccagtacggcgggcggcggatataggtgctctgcgggcgccagtcgtacagcggggtgactttggggccggtgtcttcgtggatcgcgaacatggggatgtacaccgcacggaactgctcgggcttgaccgatgccttgaccaccgcgtcgatctcttcgtcgctcggccagatatcttgcaggcgaatttccttgccgtcggcatccaggccgagcacgtccttctcgatatcgaaacggatggtgccggcaatcgcataggccaccactagcggcggcgaagccaggaaggcttgcttggcgtaagggtgaatgcgcccgtcgaagttgcggttgcccgacaacacggcggtggcgtacaggtcgcggtcgatgatttcctgctggatcaccgggtcgagcgcgccggacatgccgttgcaggtagtgcaggcaaacgccaccacgccgaaaccgagcttttccagctcatggccgaggccagcttcttccaggtacatggccacggttttggagcccggcgccagggatgacttgacccacggcttgcgggtcagcccgagcctgttggcgttgcgcgccaacaggcctgcggcgatcacgttgcgcgggttactggtgttggtgcaactggtgatggcagcgatgatcaccgcgccgtcgggcatctgccctggcacttcgtcccactggccgctgatgccttttgaagccaggtcgcgggtggcaacacgggcgtgggggttgctcgggccggccatgttgcgcacgacgctggagaggtcgaaggtcagcccgcgctcgtattgcgcgcccttgaggtcatcggcccacaggccggtgtggcgggcgtactgttccaccagggtgacttgctcatcttcgcggccggtgagtttcaggtaggcgatagtctgttggtcgatatagaacatcgcggccgtggcgccgtattccggggccatgttggagatagttgcgcggtcgcccagggtcagtgccgaagccccttcgccgaagaactccagccaggcgccgaccactttctgctggcgcaggaactcggtgagcgccagcaccatgtcggtggcggtgatgcctggttgcagcttgccggtcaattctacaccgacgctttccggcaggcgcatccacgatgcacggccgagcatcacgctctcggcttccaggccgccgacgccgatggcgatcacgcccagggcgtccacgtgcggggtgtggctgtcggtgccgacgcaggtatccggaaaggcaacgccatcgcgcacctggattaccggggacattttctccaggttgatctggtgcatgatgccgttgcccggcgggatcacatcgacgttcttgaaggcctttttggtccactcgataaagtggaagcggtcttcgttacgacggtcttcgatggcgcggtttttctcgaatgcctgcgggtcgaaaccaccggcttcgacggccagggagtggtcgacgatcagttgggtcggcaccaccgggttgacctgggcgggatcgccgccttgcagcgcgatagcatcgcgcaggccggcgaggtccaccagcgcagtctggccgaggatgtcatggcataccacgcgggccgggaaccacgggaagtcgagatcgcgcttgcggtcgatcaactgtcccagagacgcattgagggtggccgggtcgcaacggcgcaccaggttctcggcaagcacgcgcgaggtgtagggcaaggtggcgtaggcgccgggggtgattgcctcgacagccgcacgagcgtcgaagaaatccaggcggctgccggggagcggtttgcgaaactcagtgttcatcgtcaggactcggtcacggtgattacaaaagggacctactgatccagatttgaaatgcagtccaaatgtgggagggggcttgcccccgatggcggtggttcagtgccagttgtttcagctgacagaatgctatcgggggcaagccccctcccacatttttggcctcattccaattctggaagcgttggttttcagcgacgttcgattggcacgaacttgcgctgctcaacgccgatgtactcggcgcttggacggatgatgcggttgttggcgcgctgttcgaacacgtgcgcggcccagccagtcaggcgcgagcacacgaagattggcgtaaacaatttggtcgggatgcccatgaagtggtacgccgaggcatggtagaagtcggcgttggggaacagctttttctgctcccacatggtcttgtcgatagcctcggagaccgggaacaacacggtgtcgcccacttcatcagcgagttttttcgaccaccccttgatcacttcattacgcgggtcgctgtctttatagatggcatggccgaaccccatgatcttgtctttgcgcgccaacatgccgagggtgccttcgacagcgtcttcggccgaggagaagcgctcgatcatttccatggccgcttcgttggcaccaccgtgcagcgggccgcgcagggaaccgatggcggcggtgacgcaggagtacaggtcggacaaggtcgaggcacatacccgagcagtgaaggtcgaggcgttgaattcgtgctcggcgtagaggatcagcgatacgttcatgaccttgacatgcagctcgctcggtttcttgccatgcagcaggtgcaggaaatggccgccgatgctcgcttcatcagtcacgcaatcgatgcgtttgccgtcgtggctgaaacggtaccagtagcacatgatcgccgggaacgcggcgagtaggcggtcggtgacatcgcgttgtacgctgaaatcctgctccggctcgatattgcccaggaatgagcaaccggtgcgcatcacgtccattgggtgggcgtcggcggggatgcgttcgagcacttccttcagcgcctggggcaaatcacgcagcttgctcagcttggcgctgtaggcggccagttcggtcttggttggcagttcgccgtacagcagcaggtaggcgacttcttcaaactgcgcatcggcagcgagttcgcgcacgtcgtagccgcgataagtcaggccggccccggcttggcccacggtggacagagcagtctgcccggccacctggccacgcaggccggcgccactcaatacttttgcttcagccatgttcgttctccaatcttgaatttattagggaggcgcaccgcatcactttttcgcggcaaacagcgcgtcgagcttctgctcgaaggtgtggtagtcgatgcgatcgtagagctccatgcgcgtttgcatggtgtcgatcacgttctgttgggtgccatcgcgacggatcgcggtgtagacgttctcggcggccttgttcatggcacggaaggccgagagcgggtacagcacaatggaaacatcggcagatttcaactgttcggtggtgtacaacggggtcgcgccgaactcggtaatgttagccagaatcggggcttttacgcgggaggcaaacagcttgtacatctcaagttcggtaatggcttccgggaagaccatgtcggcaccggcttcgatacaggccgcggcacgctcaagggcggactccaggccttcgacagccagggcgtcggtgcgcgccatgatcacgaaactgtcatcggtgcgcgcatccacggcggccttgatacggtcgaccatttcctgctgcgacacgatctctttgttagggcgatgcccgcagcgcttggcacccacctggtcttcgatatggatggcggcggcgccgaacttgatcatcgacttgacggtgcgcgccacgttgaacgccgaggagccgaaaccggtgtccacgtcgaccagcaacggcaggtcgcatacgtcggtgatgcgccgcacatcggtgagtacgtcatccaggccggtaatacccaggtccggcacgccgagcgagccggcggctaccccgccacctgacaagtagatcgccttgaaaccggcgcgcttggccagcagcgcgtgattggcgttgatggcgccgaccacttgcaagggcttttcgctggcaactgcgtcacggaaacgctggccgggagtgttgttattgttggaactcatgactcacctcgtgatgaaggagcgccgtccgggaagtgacgggcaatgttgcgtttggatgcgccgatatgtcggcgcatcaacagttcggccagctcgccatcgcgatcggcaatcgcgtcaagaatgcggtgatgctcggcaaaggcctggcgtggacgattgggagtggtggagaactggatgcggtacatgcgcaccagctgatacagctcgccgcacagcatctgcgtcagggtacggttaccggcgccctggatgatgcggtaatgaaagtcgaagtcgccttcctgctggtagtaaccgacaccggcctggaacgccgcatcccgctcatgggtgtgcaatacctggcgcagctcttcgatttccgcgtcggtcatgcgctcggcagccaggcggcaggccatgccttccagggactcgcggatttcatagagttcgatcagctcggcatggctcaaagacaccacccgcgcgccaacatggggcacgcgtaccagcaggcgttggccttccaggcggtggatcgcctcacgcagcgggccgcggctgataccgtaggtacgcgccagctccggctcggagatcttgctgccgggggcaatctcacccttgacgatagccgcctggatacgccggaagacgttctcagacatggtttgggattcgtctgacgtcgctatcggaatttccgcctgatcgagcatattgtcgacacctttcaaatcaatgcggcaaaaactagccaatcaccccgcaatagtcaaagaataaataggtattgtcgacaatcgtctaatacgctcgctttacttacgcagggcatggccgcctgccagcgctggcgccaaaaaagcatcatgttagaatgcccggcgtatttgcctgacatctctggatgaaacggcgcacgagggagtttgcgcagcaatgccagtcgccttgaattgaacatcgcacggcaccgcctcaggatttatgagactcaagcccttccccctgtttttctgccttctgtttatacccagcctcggcatcgccgccgagaagacggtgtatggcctcaatgaatacgccaagctggacggtatcgatctggaagtcgcggccaagctcgacaccggcgccaagaccgcctcgctgagtgcccgtgacatcaagcgattcaagcgcaacggcgaatcctgggtgcgcttctacctggccatcgacaccgcccactcccaccccatcgaacgccccctggcccgcgtcagcaagatcaagcgccgcgccggtgactatgaccccgatgaggacaagaactacaccgcccgtccggtgattgccctggatatctgcatgggcactgctttacgcagcatagaagtgaacttgactgaccgcagcgctttccaatacccgctgctgatcggctccgaggcgctcaaacgctttgatgcgctggtcgaccccagtcttaaatacgcagcaggcaaacctgcctgcgccgccgacgctcataccgccgagtaaaccgaatgcgctctttgaccctgcacctgaaaatcctgatcaccttgctggtggtgctgggcatttcggtcaccgcctatcagattttcgtgctgggcatccccgttaccgaggatgccaccgacgacttgtggaacatcgacgccaaggtcgagttcgtcgccaacccgaaagaccccgtcaagatccagatgttcgtgccgcccctgagccgcgacttcgtcagcctcaacgaaagctttatctcgaacaactacggggtgagcgtcaatcgcatcgacggcaaccgcaaggtcacctggtcggcgcgccgggccaagggcaaccagaccctgtattaccgcctggtgctgaccaagcgctacagtggcgagaaggtcaagatcaagggcccgacctttcgcgacagcatcgctgtggaaggcccggaaaaaatcgctgccgaagccttgctggcgccgatccgccagcactcggccgacgtcgagacctttatcagcgaagcgatcaagcgcaccaacaacctcaacgacgacaatgtgaaattgttgctggccggcgacccgtcgacgccacacaaggccaagatcgtcgagctgctgctgtccatcgcccatgtgccggtagagaaagtccacaccatccgcctggtggccgaccaaccgcaaaccccggaactgtggctgcgcagcttcaatggcagtgactggttgtacttcaacccggaaaccggcgaacagggcctgccggccgaccgcctgctgtggtggactggtgatgaaaacctgatcacggtcgacggcggcaagaaagccatggtgaccttcagcctgaacaacagcgagatgaatgccatccgcctggccaagctgaccgacgagaataccgacgccaatttcctcgaatactccctatatggcctgccgctgcaaacccagcagaccttcatgatcatggtgatgatcccgattggcgtgctggtgatcctgatcctgcgcaacctgatcggcctgcagaccctgggcaccttcaccccggtgctgatcgccctggcattccgcgagacgcagctgggcttcggcattgtgctgttcacgatcatcacggcgctggggctgtccctcaggtcgtacctggagcatttgaaactgcagatgctgccgaggctgtcggtggtgctgaccttcgtggtggtactgattgccgccatcagcctgttcagccataaacttgggctggaacgcggcctgtcggtcgcgctgttcccgatggtgatcctgaccatgaccatcgaacgcctgtcgatcacctgggaggagcgtggcgccaaccatgcgctgaaggtggcgatcggcacgctgttcgcagcgtccctggcgcacatcatcatgagcgtgccggagctgatctacttcgtgttcaccttcccggcgatcctgctgatcctggtgggcttcatgctggccatggggcgttatcgcggctaccgcctcaccgagctggtgcgtttcaaggcgttcttgaaggctgactcctgatgttcggcttctggaagacctggaaggccctcgaagcgcgggggatcatgggcatcaaccggcgtaacgccgactacgtgctcaagtacaacaagcgcagcctgtacccgattgtggatgacaagatcatcaccaaggagcgggcgctggcggccggcattcatgtgccggaaatgtacggggtgatctccaccgagaaggaaatcgacaagctcgacgagatcatcggcggccgcagcgacttcgtgatcaagccggcccagggtgcgggcggtgatggcatcctggtagtggccgaccggtttgaaggacgctatcgcacggtgtccggcaagatcatcagccatgaagagatcgagcaccagatttccagcatcctcaccggcctttattcactgggtggccaccgcgaccgggcgctgatcgagtaccgcgtggtgcccgatcagatcttcaagagcatcagctacgaaggcgtgccggatatccgcatcatcgtgctgatgggctacccggtgatggcgatgctgcgcttgccgacccgccagtccgggggcaaggccaacctgcaccagggtgcgattggcgtgggcgtcgacctggctaccggcctgaccttgcgcggcacctggctgaacaacatcattaccaagcaccctgacaccaccaatgccgtggatggcgtgcaactgcccaactgggacggtttcatgcagcttgcggctggctgctacgagctgtgcgggctgggctatatcggcgtggacatggtactggaccaagaaaaaggcccgctgatccttgagttgaatgcacggccggggctgaatatccagatcgccaatgactgcgggctgaccttgcgcacccatgcggtggaggcgcgactggaggaactcaaagctgccggcgtgacggaaaccccgcaagagcgggtgaagttcgtgcaggagatgtttgggcatataccgcccgtggaaggctgatccggtcttcaaactgtctatccccgacatcccctctaggagcaaatcctacaggggactacaatccccatcccccgcgccattagctgatccaccccgcatgttgacctgctccgtacacccattgccctaccgggccaaccccgccgagtattttgcggcgattcgccatgcccctggcgcggtgctgctcgacagcggccgccccacggctgatcgcggccgttatgacctgctcagcgcctggcccgaagcgaccttgacggtagggccggacgaaagcggcaatgatttcctgcaacgcttgcgggaaaacctcacgcgattgggtgaagccgcaatccccaccgatttacagttgccgttcgccggaggcttgataggctacctgagctacgacttcggccggcaccttgaggacatgccgcacctggcgatggatgacctgcacctgccggacgcgcgcttcgggctgtacgcctgggcgctgatcagcgaccaccaggtccaaagcagccaactggtgtttcatcccacgctggccgatagcgaacgacaacggttgatcgcgctgttcagccagggggctgtcgacacctctgcgacgttcaaactccagggcccgatggcgcccgacctcaccgcagagacctaccgccaagccatcgtgcgtatccaggattacatccaggccggcgactgctatcaggtcaacttcgcccagcgctttcgcgccccctgtatgggggatccctgggtagcctattgcgtcctgcgcgaagcctgccccacgccgttttccgggttccagagcttgcccgatgacggtgcggtactgagcctgtcgccggagcgttttgtacgcatcagtgaccgccaggtcgaaactcgcccgatcaagggcacccgccctcgcggtgtaacgctcgcagaggatgccgaccacgccgccgaactgctggccagccccaaggaccgcgcagaaaacctgatgatcgtcgacctgctgcgcaatgatctcggccgcagttgccgtatcggttcggtaaaagtgccggagttgttcagcctggaaagctaccccaacgtgcaccacctggtgagcagcgtcaccggcatattggccgacgacaaagatgccctggacctcatcgccggcagcttccccggcggctccattaccggcgcgccgaagattcgcgcgatgcagatcatcgacgagctagagccaacccgccgcgggctgtactgcggctcgttggtgtacctggacgtgcgcggagagatggacagctccatcgccatccgcagcttgctggtcaaggatgggcaagtgtgctgctggggcggcggcgggattgtggctgattcagagtggcaggcggagtatcaggagtcgctgaccaaggtgcgggtgttgttacaaacgttggaaagtttgtagagcacagccctttccggggttcgcttgcaggagcggccagtagaaaaagcctgaatcagaaccgctgtggacgggataggcgcttgcagatagcgtcaggatccaccgtccacccgccatctgtgaaggaccacatgaagcgactgccccctcgtctgaaaatatttccgagattgcctattcaagcactcacgcctatgatctcccaaactgggaggttaaggcgatgcggataatcgctctctctaccctacgaatattttgggaaagccactcagcttatagcgacgccaaaataccgctggtcgagttgtatcgtcacatggagaaagccacctatccaacgccgcaagcactcaaggcagagcttagaacagcgagcattctcaaaggcggcagggtcgtgttcaacgtcggtggcaacaaataccgagtgatcatggcgatcgactatcagcgacagctagggttcatacgttttgtgggaacccacgctcagtacgaccagatcaacgcggagattgcgtgatgaacatcaaacctattcactcccaggacgatctgacagctgcactcgcacgggtcgagcagatatggggagcaccacccggctcgcctgaaggtgacgagctggaaatcctggcaattcttatcgagaagtacgaagccgagcattatccaatgcccccttcggatccggtggaagctatcaagtttcgcatggagcagttgggcatgaccgcccgcgacctggagccatttatcggcaccagcggacgggtatccgaggtgttgaaccacaagcgcaagctgagcctgtcgatgatcaagcgcctgcatgaaggcttgagtattccttatgagcggttgctggcagggctgtagccggtgactgcccgcgatggggccctccgcctcgctggataacttacaggctcaactgccgattcgacgccttgatgaactcccgcttcaaatcctcaaacgtgtgcaccgccgggaaatggggaaactcatccatcacattctgcggcgcatggaacaggatcccacgatcagcttcgcccagcatggtggtgtcgttgtaggaatcaccggccgcgatcacgcggtagtaaagcgacttgaacgccaataccgattggcgcttggggtctttctgacgcagttgatagcttaccacccggtcgtgttcatcggtgatcaggcggtggcagagcaaggtcgggaagcccaactggcgcatcagcggctgggaaaactcgtagaaggtgtcggacaggatcaccacctggaaacgctcgcgcagccagttgacgaattcgacggcaccgtccaacggcttgagagtggcgatcacttcctggatatcggccagcttgagcccgtgctcgtcgaggatacgcaggcgctgctgcatcagcacgtcgtagtcgggaatgtcgcgggtggtcgcacgcagggattcaataccggttttttcggcaaaggcgatccagatttccggaaccagtaccccttccaggtcaagacaggcaatttccacaagacactcccattgaatttattagttgagcgggcaaaaggactgccgaactctagcgactcacgcacgccgccgcaacgcgggacagatttgataccatcgcccccctatagagcgctcagcgccactgacctgtaggaaccgtcctgatgaaccaagccttcgacgtcgttgaactcgccacgacttatgccaacaagtctgcccaggacattctcaagctggcgttcagccagttcggcgatgacctatggatttccttcagcggtgccgaggatgtggtgctggtggacatggcctggaagctgaacaagaacgtcaaggtgttcagcctcgacaccggccgcctgcacccggagacctatcggtttatcgagcaggtgcgtgagttctacaagatcgacatcgaactgatctcgccggaccagagcaaactggaacccttcgtcaaggaaaagggcttgttcagtttctataaggacggccatggcgaatgctgtggcatccgcaagatcgaaccgctgcgccgcaagcttgcaggtgtaagtgcctgggccaccggccagcgccgcgaccagagccccggcacccgtagccaggtggcggcgctggaaatcgatacggcgttctctaccccggaacgtaccttgtacaagttcaacccgctggcgcagatgaccagtgaagaggtctggggttatatccgcatgctggaactgccttacaacagcctgcatgagcgcgggtttatcagcatcggctgcgagccctgcacccggccagtattgcccaaccagcatgagcgcgaaggccgctggtggtgggaagaagccacacagaaagaatgcgggctgcatgcggggaatatcatcaccaaggcatgagcctggcaaactggtgtggtaaaaatgtgggagggggcttgctctctcccacattttgttttgtgcgcagcataaaatgtacacaaccttgtaaccatcggtgccatttttgtgtgcaactcatattctggcgcaccaaaacgtaacatccatctctgctagttcccacgcacccaaatcacctcattcccaataaaaaataaatacctgttcaaacggtcaatttatattgcttttaattcagtagcttattcaaacgcactattaaaacgaaattatcccagtttttcatataacgaaaactggcacgcatgtggcttagtgaaatgcacactttgtatacaatcaatacaaaacctacatacactttgccatccgccgctatgctgcagatgtgctggagcctgccggaatgcgtacaagtctctcgagcaacatcgcactggatctgccctcctccaccttgaatcccgcagctgcaagccccggcccgctggtactcagcccacgcctgcacaacaaggacctggcccccaccaaggttgaaggccgccgctgggggcgctacagcatctttgcgttgtggaccaatgacgtgcacaacatcgccaactattcatttgccatcggcttatatgcgttgggcttgggcggctggcagatattgctgtccctggggatcggcgcggcactggtttactttttcatgaacttgtctgggtacatggggcagaaaaccggcgtgccgtttccggtgatcagccgcatcagtttcggtatccacggcgcgcagattccggccttgatccgcgcagtcattgcgatcgcctggttcggcatccagacctacctggcatcggtggttttccgcgtgttactgacggcgattcatccgggttttgccgattatgaccacaactcgatcctcggcttgtcgaccctgggctgggcgtgctttgtggcgatatggctggtgcagttggtgatcctcgcctatggcatggagatggtgcgccgttatgaagggtttgccggaccggtaattctgctgaccgtggctgcgttggccggctggatgtacttccaggcgggcggcgtgattgcctggtcgatccgcgaaccactgagcggcggcgagatgtggcgcaatatctttgctggcggcgccttgtggctggcgatctatggcaccttgatcctcaacttctgcgatttcgcccgctcttctccgtgccgaaagaccatcaaggtcggcaacttctggggcctgccggtgaatatcctggtgtttgccgccattaccgtgctgctgtgcggcgggcagtttcaactcaatggacgggtgatcgaaagccccaccgagatcatcgcggcgatccccaacaccttctttctggtactcggttgcctggccttcctgatcgtcaccgtggcggtgaacatcatggccaacttcgtcgccccggcctttgtgctgagcaacctggcgcccaagtacctgaatttccgccgcgccgggttgatcagtgccttcgttgccgtgctgatcctgccgtggaacctctacaacagcccgttggtgattgtgtacttcctctctggcctgggcgcactgctggggccgttgtacggggtgatcatggtcgattactggttgatccgtaaaagccaggtggatgtgccgcagctgtacagcgaagacccccaaggcatttattactacagccgtggaataaatatgcgtgcggtggctgcgttcattcctgctgcggtgatcgccatcctgctggcgctattgccggggtttgccagtgtctcaccgttttcctggttgtttggcgcaggcatcgccgggttgctgtacctgctgatcgccaagcgtcagccgttctacgccgatgtcagcggcgaaagcattgccgtcgataacgtcagtcattaaacaaggactttccatgcgtatcctcgtggtcaacgtcaacaccaccgaatccatcaccgagaccattgcccagcaagcacgtgccgtggcgtcaccgggcaccgagattgtcgggctcaccccctacttcggcgccgaatcggtggagggtaattttgaaagctacctggcggccatcgccgtgatggaccgggtgatggcctacgatcagccgttcgatgcggtgatccaggccggctatggcgaacatggtcgggaaggtttgcaggaattgttgaatgtgccggtggtggatattaccgaagcggccgccagcaccgcgatgtttctggggcatgcctactcggtggtgaccaccctggaccgtaccgtgccactgattgaagaccggctgaaactcgccggcctgtaccagcgttgtgcgtcggtgcgcgccagcggtatggcggtgctggagctggaagaagacccgctggctgccatggaggccattgtgcaccaggcggaactggcgattcgcgacgataaggccgaggtgatctgcctgggatgtgggggcatggccggactggacgagcagattcgccagcgcactggggtgccggtggtggatggggtgacggcggcggtgatggttgccgagtcgttggtgaggttggggttgtcgacgtccaaagtcaggacgtatgcgcagccaagacccaagaagatcattggttggcccggcaagttcggccactgaagatcaaatgtgggagggggcttgctcccgatagcggtgtatcagccagcttatctatagctgacccaccacaatcgggagcaagccccctcccacattttgatcactacaaggtgttagatggcactgaatctttggcctaactgctgctcggcaaactgctcgatgatgaaatccacgaacgcccgagtcttgcctggcagcagtttatgttcggcgtagtagatgcaaatattgccgtcgttcacataccaatccggcaatacccgcaacaacttgccgctcgccagccagggcacagcaaacggcatgctcaccagcgcgatgcccagcccctggtcggcagcgatgcaggcggcttgggagtcgctcatggtcatgcgcggcttgaggttcagcggaccgtgctcgccattgcgatgagtcagttgccaggaacgcacacgcccggtttgcggtgagcgaatcagaatgccgtcgcaacgctccagatcctcgggctgtaacagcgccgggcgtgccgccaggtagtcgggggatgccaccaacacccgatgagccggcgccagcttgcgtgccaccacgccctggggcagctcgaagccgccgccaatggccgcgtcgaagccctggccaatcaggtcgacctggcgattgtcgaaatgccagtctggaatgatatcgggataacgtttcaggaatacacccagcagcggcacgatatacaagcagccgaccactgtgcccatactgaccttgagcgtgcccaccggccgcccttcggcactggccaggttggctacggcattctggatggtggtgaggctggagctgacctcgtcaaggaacagcttgccggcttcggtcagggcgaggcgtcgggtactgcgttggaacagccgcacacccaggcgtgcttccagtttggcaacgcttttacccactgctgccggggtcaggctcaggtgccgggcggcctcggcaaaactgccaccctcggcgctgcgcacaaagcattcgatactgccaaagctctccatatcgccccactctaaacttttggtttacacagactatagcaatcgcggtctaccggcttgggtgggtgaggtcgatactcggtccatcaactactcggagatcgacatgaccacacaaaatctgatcggcaaagtcgccttgattcaaggcggttcccgcggcatcggcgccgccatcgtcaagcgcctcgccgcgcagggtgcagcggttgcctttacctacgtcagctcggcctccaaggccgaagcgttgcagaacgacgtgatcagcgatggcggcaaagccctggcgattcaagccgacagcgctgatgccacggcaattcgcaatgcggtcaatgccactgtcgaagcgttcgggcgcctggatatcctggtgaataacgccggcgtgcttgccatcgccccactggaagatttcaagctggaagacttcgaccagaccctggcaatcaacgtgcgtagcgtatttatcgccacccaggaagccgccaggcatatgggcgaagggggtcgggtgatcactatcggcagcaccaatgccgagcgcatgccgtttggtggcggcgggccttatgcgatgagcaagtcggcactggtgggcttgaccaaaggcctggcacgagacctggggccgcgaggcatcaccgtcaataacgtgcagcccgggccggtggataccgatatgaacccggccaacagtgactttgccgaaagcttgatcgggttgatggcggtgggccggtatgggcatgtggaagagattgccagctttgtggcgtatctggcagggccggaagccgggtacatcaccggtgccagcctgaccatcgatggtggcttcagcgcttagttttttggaaaactgcaaaaccaaatgtgggagcaaggccccacattttgccctgagttgaatcaggccatggggggcaggccataggccgccaaatcgaaatccgcgagcttgcggatgatctggtcagcatgctggtacttgctgtccgccatcgcctcatcgggcactgcaatggcagtcatatgggcagccttcgccgcggtcacgccgaacggcgagtcttcgaacaccaggcaattctgcggcgccacacccagacggcgcgcggcggtcaggaagatatccggcgcaggcttggcagcgccgacctccgggtcgtccgccgtaacgatagtgtcgaagaggccaaaccattcgcggtgcagggtggtcttgtggccaaacgaattgcgcgacgaactggtgcccaccgcaatcggaatattgtgcgccttcaaatgccgcaccaacgcctcggcgcccggcatgcccagggccttgggaaagcgctcgctcatcagcggctcgcggatctccaggaactcggcgggtgtgatcggcaagtccagcgccttgaccacgtaatcggccaggtcttgggcgccccgcccaatgatgtgctgcttgatcccccagtcataggtacggccgtagcgttcggcaatgatctgcgtgacttcggtatagatgccttcggtatccagcaacaacccgtccatatcgaaaattacggccttgatcgggacagcggtacgcggtgcactcatcacaacacaaccctgagtatgactaaaaggattcagcacaatagcggccctcgttgcctgcaagcaaccttcgttgcccacgatgaccaattcataccacgcaacagtttcaccagccgacacccacagcggctgtctagggtttatcaaggcagagcgatcaaccattgactcgcgcaggaaaatacaccttgcaaaccttataaaagacttattaacctccgatgaattcaatccactggacgcgaaaatccgtcaaacaattgcttcggctacattcgtaccatcagcaacaggtccgcgatgccgtgtccgctcttgagcgaatgcccgatgcagtcaacgtcaaggcgctggtaaaccatcctcacagctataggttgcgggtaggtaattaccgcgtcctcttcgactgggatggcagcatccaggtggtcagcatccaagaggttaaaaaacgtgacgagcgaacctactgccgtacagatcatccacaatacgcagggcaagcccgccttcgtggtgattccctatgaacactatgtagcgcagcaaaacgatcaaaacctgatcccccacgcggtagtcagccgcctggtggatggcgcgacacctatccgggcttggcgcgaacatctgaacctgacccaggaagaagtcgccaggcgcctgggtatttcacaacctgcctttgcccagcaagaggcggtcaataaacctcgacggaccacgcgggaaaaaattgccaaggcgttcggtatcaatgccagtcaactggagatataaacgtgatcctgcaagattcgcgcgccctttaacctcaaatcgagctcaagcatgctctatcgtttagccgccgacggcctcgtgctgtttcacctgacctttatcctgttcgtgctgttcggcggcctgctcaccctgaaatggccccgagtgatgtgcctgcatttgcccgccgttgcctggggcatcgctgtggaggtgctgcacctgccctgcccgctcacccgttgggaaaacctgttgcgccacctggccgggcaagacagctatggcggcgggttcatcgagcactacatcctgacgctgatctaccccgccggcctgaccgcgaatattcagctggcgctgggagccgtggtggtgttggttaacctcgcggtgtacgggcgggttatccggcgttacgtacaggcttgagacagctgcgctggtgaagaatcagccctcctcaatccgttcgcagacgccgccatgtccgaagccttcgaagtccccagcccccacgaaaaacacatcgaacacaccaccgaacatgcccacggtcgcggcgataccttcgccagccgcattgccgtgatgaccgccatcatggccaccgtcggcgccatgctcagctaccaggccggctccagcgaaagcacagctgcgatggacaagaacaacgccgccatcatcaagaccgaagctgccaaccaatggaattactaccaggccaaatccagccgccagaacctggcagaactagccacccatattcccggcgtagatgcggcgcactacacggatgagatagagcgctacaaacaccagaaggaagacgtgcgcaggcaagccgagaagctggaggccacgtcacgggaatgggatcagaaatccgagcaggcactgcaccagcaccatcgctgggcccaggcaatgacagcaattcagatcgcgatttcgttggcggcgattaccttgctcacgcgtaaggagtggctcaaacgcatgtcgtacacggcaggcgcagtggctgtggtgctgggcagcctggcatcgctgcatctctgacccaatgcgggcaaatgttggagggagcttgctcccgatggcggcctgacagccgccacctacacatgaaaccttggccgattgatttcaatctgcctgctgagcgcttagagtgtcgcccctcgagaattgagtctcgagattgagtccatggagttacaagtgaaatacgtcagtaaagtagttgcagcagccgttctcggtttcaccctggcaggttgcaccggcaccgccatgaaaaccccgcaatacgacgccagccaatacaccgtcctcggccacagcgaagccagcgccaccggcatcatgctgctgggcgttatcccaatcggccagaacaaccgtttcgtacgcgctcagaatgccgccatcaaggccaagggcggcgacgcgctgatcaacacccaagtgcaggaaaagtggttctgggcctgggtactgaacggctacaccaccaagatttctggtgatgtgatcaagctgaaaaccgcgcaataaagcacgaaatagccagggcgccgagcccggcaagcgacgtatcatgggccggacttcccgaggatggcccatgaacctcagtatcgtttacgccctcgccgccgccgcgctgttcggcgccagcaccccgctcgccaaaagcctcggcctgggcctctcacccatactacttgcgggcctgctttacctcggcagcggcataggccttgccggcgcacgcctgatccgcgatcgcggctgggcacccaccgggctcaccccgtcggaatggccctggctacttggcgccatcgccttcggcggcatcctcggccctgtcgcccttatgttcggcctgacacgtaccgccagcgccaccgcctcgctgatgctcaaccttgaatcggtgctgaccgccgtgatcgcctgggtcgtattccgagaaaacgcagaccgccgcatcatccttggcatgctcactattgtgctgggcggcgtggtgttgtcctggaccggcgctggcgttagcagccaggattggaccgggccacttgccgttgcgctggcgtgtttgtgctgggggatcgataacaacctgacgcgcaaggtctctgcatctgacgcggtgtttatcgctgcagccaagggcttgattgcagggctggtaaattgcagcctcgcgctttacctcggggcgcagattcccggcgtggcgcaactggcgcctatcctgctggttgggctcctcggctatggcatcagcctggtaatgttcgtgctggcgctacgcgggctgggcagtgcgcgcaccggcgcctacttctcgacggcgcccttcctcggtgccgcagtggccttgctggtgtttggagagtcggtgaccctggcgttctggattgcttcggcgctgatggccgtgggtgtgtggctgcacctgacggaacggcatgcccatgagcatctgcatgaagcgacggaacatgggcatcggcatgtgcatgatgagcatcatcagcatgagcatgggtttgagtgggatccgaaggaggcccatagtcatgtgcatgttcatggtgtgatgaggcatagccatgcgcattttccggatgtgcatcatcggcataggcattgagcggatgtatcagggcggctctattggccgccctggtggagagcaggcccgtttaagcgtggtggcccgtgtagcctttatgctcatactcccaccccctgcatgccaacccgacatgcttgggaatcagcgctgcaccactgctgtacgcggtgatagtcctacgagaaaagcccagttcaacagcagctgcggaaagggataaattgttactgagcatccactttctgaaatcctgggtcagcatgacttcaccagattgctccaacgccaggcggtgcaacgtgacagcggacagttccaggtcattaccccatgtcacatcaaagccccactcacccactaccacttggctgaatagcgccaaatccaagagtggtgtaagcacaggaaaagtatttatatgatcggtgaggtcaacagtgtgtcgcttaccgttgttccattcgatctccaaggcatgcttgccggcaactggttgcacagcagaaatgcgaagcttgctggtcatatgtcagtccctccggttttgttcatcccatacccgtttaagatcagcgatatgagcttttgcccaaagcagggcagctttcaaggctttcttctcggcgcctgtaccgagcacaacaagcccttctatctgaaccagcgactcaccatccggcgtctgcacgtggaaatgcggcggcgcgtggtcgtcgggatagatttttattttccagtttcgttcagtgtgaagggtagccatgacggaagatgctagagaaatattttctctagcacaacctcactttttaatcccatacgccaagactctacgattccttcggcaccctgagacgactagacaagaagccgcaacaagagccgttcatacgagcaacgtcctacaggccaagcagaaatgtggggctcccgtttcaaaatcgcaatgtctatagtcacccggtcgcccatacggcggccgagtttggcgactcgaaaacaagacggaacgtagacggcgttattttcatgcggctgccatctttgacggcttagcgtgaaaagccttcgttgtttttatatttgtcttgtggaattacgcatgaaccaatacatagccctcaccagcaacgacagcgccacccctgccctttttgtcgataccaccgtgccgctggaaatactcctcgacgccgcgacctatcgacttcgtgccgttacacaggtccttgaaaaccttgctctacgtagtgaaatcagtagtgatgcggtggtgctcagtgattttgcgctgctctgctcaattcctctgcgggacgggtgcgatttgctcgatgttattggacgacggatggatgcgccgagcatatgacctgaaaaactaagttttcaaactcaaaaaccacaagccctctagcttcttccgagccagagggttcgtttgattcaaatttggtggggtcgagattaacgattcactcgtctattttttataaaaatcactgttaggcatgcgtgtaaaagtatacattcccaacatctgtatacgatgtatacgagtgagattgaggagtcttttatggcatcacccgtgctgtcatttcgcgtggaagaggaattggttgaacagcttgatcagttgtcattggcaacggatcgcgaccgccaatatcacctcaagcgcgccttggctcgttacgttgaggccgagtcatggcatatcaacgcgatcgctgaaggtatcgcagacgcagaggcaggcaacctcatagatatggacgccgtaaaggctaagtgggtaaaccgtgccaaaaatcgcgttgacggaaaaggcgaacagtgatctagagtcgatctacgaatactatgagtcacgcttgggggcagaagccgccgaaggggtcgtggctcaaatcattgaggcgcttgagcagctggaaacatttacaggtttgggcaggccctcccaaattccagatgtcagagaactgatcctgtccggatttcctttcatcgccccctatcgtcttgctcacggaataatacagattctgcgcatcctgcatcagcgcatggagcgctctgaagactggtaatcaccagcgctctacagcgtgacagcctggacgtcatcggcatgcggcagcgcatcctaagcattcaacaaatgcccgtgttcccatggatgttccgataagagccttttttgaccctctgaaaacacaaaacccctgaaaactttaacgttttcaggggttttgtcgtttcaaatttggcggtgaaggagagattcgaactctcgatacaatttcttgtatacacactttccaggcgtgctccttaagccactcggacacttcaccgtatctcggcaaaccagttcagtctgtcgaggcgcgctaatgtagtcgaaagcctttctgatggcaaaggtttttttcagaattttcatgcggttagacggttatgccgtggcgcgcctgataacgggcggtgtttctgccattcttgggcaggcccggcgccggttttgcgggactgctgcgctgtgccgcggggcgtctacccttggggattgaggaaaagcctgaccgggtagtcagtcacagcgctttacccgcgagggcgtggtgggtaacgtctgctgcattctctctataacaagccctacaaggaaccgcgtcatgagtgagttgattgcctaccatttcgaagacggtatcgcgaccctgaccttgagcaacggcaaggtgaatgccatttctccggcggtggtgagcgaattcaacgctgcgctggatcaggccgagaaggatcgggcggtggtgatcatcacgggtacgccgggaattttgtcgggtggttatgatttgaaggtgatgaccgccggccctaaagaagcgatcagcctggtgacgtcgggctcgaccctggcgcggcgtttgttggcgcatccgttcccggtgatcgtggcgtgccctgggcatgcggtggccaagggcgcgtttttattgttgtcggcggattaccgcattggcgtggaaggcccgttcagcattggtctgaatgaagtggcaatcggcatgaccatgcatcacgctggtatcgagctggcgcgggatcgtctgcgcaagtcggcatttcatcggtcggtgatcaatgccgaaatgtttgatccgcaaggcgctttgcaagccggcttcctggataaggtggtggcgccggaagagttgcacgctgcagcgttggaagcggcgcgtcagttgaagaagatcaacatgaacgcccacaagcacaccaagttgaaagtgcgtcgcgcactgctggaagccctggacgaagcaatcatccaggatcagggccacaacctgggttaattcccacacctgcttgattaaagcccgacctagagtcgggctttttcttacaaataaacctgaaacatctgtaaccgctctagacggcctttatcggcatatgtggaaacatgcgcttaaacatcgcctatctcctacatctgtaggggcaattgccgaatacagtgtacatccgtacactgcgccaccttttgtcccaataggccgtgtcgatgctgtttctgttacgtatgttgttgatgagcctgcactttatggtcgccggggtattgggcgtgcttatcggtgtgtgccggccgtttaacccggataacagtcgtctctgcgcccgcctctatgcgttgccagccatgtggattctgcgcctgaacgtgaagacggatgtggattcgctgcgcaacaaacccggtacctgtgtggtgatcgccaaccatcagtccaactatgacctgtttgtgttaggaaatgtggtgccgcatcgcacggtgtgcatcgccaagaaaagcctgaaatgggtgccgctgttcggccagttgttctggctggcgggcaatgtgctgatcgaccgtggcaatgcacacaaggcgcggcgtgccatgctcaccaccacccatacgttgcagcatgaggacacctcgatctgggtgttccccgaaggcacgcgcaacctgggcaacgggttgttgccgttcaagaaaggcgcgttccatatggcaattgcggccggcgtgccgatcgtgccggtgtgtgtcagcacttatgtgaagcagatgaagctcaatcgttgggacagtggggatgtgctcatacgttcgctgccgccgactcctacgattggcctgacagtggacgacatccctcagttaatgatgacctgtcaggcgcagatggatgagtgcattgccctgatggaccgcgaacttgtagaagcgagcttgctcgcgaagaccgaataggcgacgcgggtcacctgatagcgctgcgtcatcgttgatgatcttcgcgagcaagctcgttcctacaagggaatgggcaatgtctgccagcaacaacggaacgtcattcaggctaagctgcccaacatctgtcctcttgataagaagtgatcagcaccatgggtagagttgttgcggccgccgtctacagtgccggaaagaaagtctcggatatcaccctcgatgaaggcgcagcctgggccgccaaacccggacactttgtgtggatcggcctggaagagcccagcgcccaggagttgaacaacctgcaacgccagttcaacctgcacgaactggccatcgaagacgccatggaaaagcacagccgcccgaagctggaaaccttcggcgacgcgctgtttatcgtcacctactcaccagttcgtgagaacggcaagctggagtttatcgaaacccatatctttgccggcaacggctacatcatcaccgcacgcaatggtcattctgcgtcctacggttttgtgcgccaacgttgtgaagcgcgaccactgttgctggagcatggggaagacttcgtactctatgcgctgctggatttcgtcaccgaaaactaccagccggtgagcgaggcgatccatgcggagattgatgagctggagcgcaatgtgctgtgcagttcgctgagcgagggcgatatccagaacctgcacggcctgcgccgcgacgtgctgcggctcaagcgttatgtggcaccgatggtggagatcagccaggagctgcagaagctgagctttccgtttatcgacaagaacatgcgcccatactttcgcgacgtgcagatccatgtaacgcggcagatggaagacctcaccaccctgcgcgatatcgccagccagaccatcgagatcggtgtgttactggaggcctcgcgccagagcgtagtgcagcgcaagttcgccgcgtgggcggcgatcctggcattccccacggcagtggcggggatttatgggatgaacttccagaacatgcccgagctgcaatggcactacggctattttggggtgctcgggtttattgcgctgggctgcacaggtttatgggccagcttcaagcgttcgggctggctttaacgctggcgtccggcttgtgggcgacaaaacgcatcatccactccgccacggttgcgccgtggtggtcgcgttccaagctggcaacgccgttggtgtaaaccttttcccccagggttgtctgaagaatctccaacaactcgcgggaatagtcttggacaaattcagggtgcccctggaagcacaacacctggtcaccgatgtggtaagcggcaatcgggcaaaactcactggaggcaatgaccgtggcattttccggcaaggtcgtgacctggtcctggtgactgatcaatagcgtcagttccggcacctcggggctcatccacggggccttggcatccagcttgtagtcatggatgcccatgccccagccttggctcgcgcgctcagtcttgccgccgagcagcaatgccaggagttgatgaccgaagcagatacccaacagcttgtcaccgcgctcgtagcgctcgagcacataggtcttgagggtctggatccaaggatcggtgccaaaggaatcggccttgctgccagtgatcaggtatgcgtcaaacacttcatcatccggcgggtattcgccctgcaccacgttatagacaacaaattcggcggcaatcggttgcttggcgaacaggcgcttgaacatctgcccgtaaccttggtactgatcgatcaagcctggacgcaggatatcggtttccaggatgcagacgcgtagcgacataaaaaatacctgacacggcgatgggaatattgcacaccccagagcctgccttgaaatacaccctcaaggcaagctccccctcccacattttgctcagcggaacacttccccctgtgccgctttctccagcaacaaagccggcggcgagaagcgctcgccatactgctcggccaggtaacgggcgcgggcgacaaagtcgtccagcccgtactggttgataaactgcaacgccccgccactccacgcggcaaaaccaatgccgaagatcgaaccgacgttggcgtcagccgtggacatcagcacgccctcctccacacaacgtacggtttcaatggcctgaataaatagcaagcggtcgcgcacgtcctgagctgaaatgcgcttgtcgggctgttcgaagcgggttttcaactcgggccacagctgcttctggccaccggctggataatcgtaaaaaccgccgcccgccgccttgcccgtgcgcttgtattcgttcacaagcaaatcgatcaccgcggtcgccggatggttcggcagtgccttaccttcggcctgtagatccttggcggtttgctgtcggatatgactcatcaggctgagggaaacttcatcggacaccgccagcggccccaccggcatgccggccttgcgcgcttcggtttcgatcatcggcgcggccacgccttcgccgagcatggcgatgccttcgttggtgaacgtgccaaacacccgcgaagtgaagaagccacgactgtcattgaccacaatcggggttttcttgatttgcaggacgaagtcgaaacctcgggccagggtttcgtcgctggtgtgggcgcccttgatgatttccaccaggggcatcttgtccacggggctgaagaagtgcaggccgataaacttggcttgatcggggactgccgtggccaggccgctgatcggcaaggtggaggtgttggaggcgatcactgcgtcggcaccgaccacgctttgtgcggcggccgagaccctggctttgagttcgcggtcttcgaacaccgcctcgatgatcaggtcgcagccggccagatcagtatcatcctgcgtcggatgaatgcgcgccagggtggtttcccgctgctcggcggtcaattgcccacggctgaccttcttgtccagcaacgctgccgagtgtgccttgcctttctcggcggcagcgaggttgatgtccttgagcaccacgtcgatgccggcacaagcgctgacatacgcaatgccggcgcccatcatcccggccccgagcacaccgaccttgtgtgtgacgtaaggggcaagaccctggggccgcgagctgccggcgttgatttcattaagctggaaccagaaggtgccgatcatgtttttcgccacttgcccggtcaccagttcggtgaagtagcgggtttcgatcaggtgcgcggtatcgaagtccacctgggcgccttccacggcggcgcagaggatcttctccggcgccgggaagcagccattggttttgctgcgcaaaatcgatggggcaatggcgagcatctgcgcgactttgggatttgacggcgtaccacctgggatctgatacgccttgttgtcccacagttgctttgcctcaggattagcgagaatccaggcccgtgacttgctcagcagctcatcacgatccgccgccagctcatcaatcaaacctgcttgcagggcctgggcggcccggacttttttaccctcgagcaagtacggcagggctttttccaggcccagcatgcgcaccatgcgcactaccccgccaccgcccggcaacagaccaagggtgacttccggcaggccgagctgaacagctttgtcgtccagcgcgacccgatgatggcaggccaggcagatctcccagccgccgcccaaggccgcgccattgatcgcagccaccaccggcttgccgagggtttccaggcgccgcaactgcgccttcaacaccagcacgctggcgtagaaatccttggcgtgagccttgtcgaccttgatcagttcattgagatcgccaccggcaaaaaaggtctttttggcagaggtgatcaccaccccggcgatcccatctttttctgcctccaggcgcgtgacggtggccgccatggcctcgcgatacgctgcgttcatggtgttggcgctctggccgggcatgtccagggtcagcaccacgatctggtcctggcctttttcgtaacgaatggcgtcggtcatgacagattccttaggctcagaggcgttcgataatggtggcgatacccatgccgccgccgacacagagcgtggccaggccgtagcgttgctgacgcacctccagctcatcgagcaaggtgccgaggatcgcgcaaccggtggcgccaagcgggtggcccatggcgatggagccgccgttgacgttgacccgggcggcgtcgatgcccatgtccttgataaacttgagcaccaccgaggcgaacgcttcgttgacctcgaacaggtcgatgtcttcaacccgcaggccggccttggccagggccttgcgagtggctggcgccgggccggtgagcatgatggtcgggtcggtgctggtcacggccgtggcaacaatgcgcgcccgcggttgcaggccgagttcgcgacctttggcctcagagccgatcaacatcaatgcggcgccgtcgacgatgccggagctgttgcccggggtgtgcacatgctggatgcgctccacatggctgtagacccgcagtgcggtggcgtcgaagcccatctggcccatcatttcgaagctgggcttgagcttgcccaaaccctcaagggtggagtcgccgcggataaactcgtcatggtctagcagtacgataccgttctggtcctgcactgcgatcagcgacttgttgaaggaaccgtccgcccgtgcccgggcggctttctgctgggactgcagggcaaaggcgtccacatcctggcggctgaagccttccagggtggcgatcaggtcggcgccgataccttggggcgtgaagtggctgtgcatattggtttgcgggtcgagcacccaggcgccgccatcgctgcccatgggtacccgggacatggattcgacgccgccaacgacgaccaggtcttcgaagccagaacgcaccttcatcgcgcccaggttgaccgcctccaggcccgaggcacaaaagcgattgacctggacgccggcgacgctgatgtcccagtccgctgccaacgcggcagtcttggcgatatcggcgccctgatcgcccacgggagtgacgcagccgagcacgatgtcatccacctggcgcgtatcaagctcgctgcgttgcgccagcgcattgagcaagccggccaccaggtttacaggcttgacgctgtgcagggcaccgtcggccttgcccttgccccggggcgtgcgtaccgcatcaaagatcaaagcttgggtcatgacatcctcgagccgctgtgggtgtatgccccttaccttaggcccgattgacacggtttcaatgacggatgcgctcaatgcttttgaccccctcgctcggacgaacggtaggtagctacggaaaatgcctgattaaacgttttagctgtctagccctagggctggcgccaagatggcaataagcctcatgccttttttagcgcaaatgctgattagctgatatgaaatggatctaagcgaagtcgaacgcgcgctctaaggttgaacctgtagggcgctgctgccgggtcttgctggagcagctgtaagaaaagtgcaacgtcagctcgcgatactggaataaaacggcacgcatttgacgctcaggaataacaacaaataggcagtcagccatgttcaaacattcgaaagtacgtcaggcaggacttattctgttcgccaccacactgattctgatcttgcccaacctgaccaaggtgctcgggtgacgccccgccccccagaagccgtgcatatacagcaccaggcctgcagcttttggcagcacctgccggaacagtgcgcttagcactgccgttgcgggcgctgtcttttttacctgtcaatttccggtatcgtgagcgccatcgccaccttgcatcgggccgctgccttgaaatcgatcctcgccttatttgccctgctgctgaaccttcctgcagccgctgcgcaactcaccatcgacttggaccacaccagccggacctggcagaccgccgatctgctcaagcacccgcaggcacagacggtacagatcgtcgatgacgtgtcctacaagcgcgacatgacctatcgcgcagtacccctggcggtgctcctgccgggcctgaaccctgcgagccacttgcaagcggttgccctggatggtttcgccgccgaactgtctgccgcgccgttgttggaaaagaccggtgcccgcgcctggttggcggtggaagacccggctcatccatggcccgccctggcgcaaggcaaaccgagcgccgggccgttttacctggtgtggacccaacccgaagccgggcacatcagcccggaacagtggccgttccaagtttccaggatcaagcaattgcagacggttgccgaacgttttcccgcgttgttgcccgacccgaaactggccgcaaatgacccgatcaaccaaggctttgcgttgttccagaagaactgcctggcctgccaccgcctcaacggtgccggcgatgcccaagtgggaccggacctgaacattccctacaaccccaccgagtatttcggcggtgatttcctcaagcgttatatccgtgacccgcaaagcctgaggcactggccacaggcaaagatgccggcgtttgctgccagtgtattgccggataacgagctggatatgctggtcgagtatttgcagcatatggcggggcgcaagcaccaaccttaagtctggagcaattcaaaagttattgctgctgcactgaaaccacggtcggtgccacgaataccttggcatgcatctgctcatgcccgcccccacggcgcataccgcgtaccgggcaggcgtcgaggtagtccaggcccacggccagtttcaagtgccgctccggccgggccagttggttggtcacgtcaaaactgtaccaggcgtcatccagccaggcttcggcccaggcgtgactggccagatgtgcgcagtcttcggtgtacaaataccccgacacataccgcgcaggaactcccaggctgcgtgcgcaggcgagaaatgcatgggtatggtcctggcacacgcccgcagcgcctgcaaaggcctgggcggcacaggtgtcgacttcggtagcccccggcgtgtagatcatcgcttggttgagggcctgcatcaggtcaatgagcgccgtgcggtcgcgacgctggtggcaatgctgctcggcaaaccggcgcagggcttcatcgggctcggtcagacgcgtgcagcgcaggaacggccaggcagactggctttcgtgttcggcctcgcgcaactcgtcgatctccacctgaccacgggcgccgatgataatggcgtcgtggggttcgtccagggtcagcacatgcaggatattaccgaaggggtccacctgcgcccgcaccgggcgtggcaggtcgagctgccagctcaatacgtgctggcgttcgctgtcatggggcgtgagccgcaggtactggatgctggcgcgcacttggtcttggtagtggtaggtggtttcgtggctgatggagagtctcatgccgcctccaggtaggaactgtagatggcgtcgcccaattggcggaccaaggggataaagtcggtcagccaggcatgcaggccttcctcgaggatttcgtcgatcgcggtaaagcgcaggcgcgcgtccatctcggcggccaggcgctgggccgggcggccgttgaggccaggcaggctggcgagcacttggtcgatttcctcgctgcaggcccgcagcgagcgcgggacatcggcgcgtaacagcagcagttcagccacttgccgggaccccggcgcgtcacgataaatctcggtgtaggcctcgaacgacgacaacgcacgcagcagtgcactccattggtaatacgcgtgagccgtgccatcgctgaccgacgcggcctgatcgccggccatttcgtagcgcgcatccagcaggcgcagggtgttatcggcgcgctcgataaaggtgcccaggcggataaagcggaaggcatcgttacgcatgatggtgccgtaggtggcgccgcggaacagatgggaacgctccttgacccactcacaaaaccggctcatgccgtatcggctcagcccctgctgggcgatatcgcgaatgtccagccaggtggcgttgatgttttcccacatgtcagcggtgattcgcccacgtaccgcatgggcgctggcccgcgcagcacccaggcaactgtagatgctggccgggttggccgcgtccagtgcgaaaaagtgcagcaggcgttcggcatgcaattggccgtggcgctcgtggtaatcctccagggtgccggtgatcaacaacggcatggccagttcgtgcagtccgtcgccgcgcccatcctggggcatcagcgacagtgaatagctgacgtcgagcatgcgtgcgaggttttcggcacgttccagatagcgcgacatccagtacaaatccgaggcagttctactcaacatggcatcagtcctcgaccacccaggtgtctttagtgccgccgccctgggacgagttgaccaccagcgatccttcgcgcagggccacgcgagtcaggccgccgggcaccacgcgggtttccttgccggacagcacgaacgggcgcaggtcgatatgccgtggggcgataccgttttcgacaaaggtcgggcaggtggataaacacagggtcggctgcgcgatataagcgtggggcttggccttgatgcgcgcacggaaggcttcgatttccgccgccgtggacgccgggccaaccaacatgccatagccgccggagccttgggtttccttgaccaccaactcgggcaggtgggccagtacatgggacaattcgtcgggcttgcggcattgaaaggtcggaacgttctgcaggatcggctcttcatccaagtagaagcgaatcatttcagggacaaacgggtaaaccgacttgtcgtccgccactcccgtgccgatggcattggccagcaccacattgccgcaacgataggccgcaagcagaccgggcacgccgagcatggagtccgggttgaaggccaacgggtcgaggaaggcatcatctaggcggcggtagatcacatccacggcctttgggccgtcggtggtgcgcatgaacacacggtcatcgcgtacgaacaggtccgccccctccaccagttccacgcccatttcccgggcaagaaaggcatgctcgaagaacgcgctgttgaagcgccccggggtcagcaccaccacgctggggttatccagagggctggcgcttttcagggtatcgagcaacaggttggggtagtggtcgatgggcgcgatgcgctgggctgcaaacagttccgggaacaggcgcatcatcatcttgcgatcttcgagcatgtagctgacgccactgggcgtgcgcaggttgtcttccagtacgtagtaggtgccgtcaccatcgcgtacgaggtcgaccccggaaatgtgggaatacagatcacggtgcaggtccaggccctgcattgccaactgatactgctcgttggccagtacctgctcggcgggaataatgccggccttgataatgcgttggccgtggtacaggtcggcgaggaacatgttcagtgccttgacccgttggatgcagccgcgctcgacaacccgccactcgctggccggaatactgcgcggaatggtatcgaagggaatcaggcgctcagtgcccagctcatccccatagagggtgaaggtgataccggcgcggtggaacagcaaatcggcttcacgccgacgctgggccagcaattcggtgggggtgtcggccaaccagcgggcgaactcgcggtaatgaggacggacctgccctgccccatcgtacatttcatcgtaataagtgcggatcatgccgtactccttgtcacccggacgcgagaaccttcgcaaggcccgtgccagcggcataaacacttaataatcaacgatttgaataattcaggcggcttcgtcgcaccattcaggtgcgtagaacctgcccgttgcatgtcgcacgcttcattgcaacgcggcccttggctatcgacagcatagccagagttgatttcactgcccggccggcgctgcggataatcacctccatcggctgaacaggacatgtcctacagcgaaaccctttgtgcaagcggtactgtgttacttcgtgtactgatctgctccctcgagcttccctttccgccaccctactggggtggcttttttttgcatgtaacaaaaccagtgcaggtcacccccaaacaaaatcggccgacccaaaggtcagccgatacgctgcgctgctcataaaaaccaactacatgggtaacccacgcacctcctgcttgacgccccatccttcgatgatcccacccaggggctcgaccaccgcctcgaagtcttgctcgaagtctcctatgccgtcgtaggttgcaaacatgattttgctcagttccaggtaccacgcgccatcgtcgcgcgcgctgacctgggcattcagggattcgccacgaaatcgacccgcagccctgcgcgcccgttcctcatccgggaaaatggcgtagaactcaatggggtgaaaacgcgagaaatcgaagccgccttctttcatgcggcgcaggacgttggtactgatgtcttcttgataggctgtgctcatgaaaagtgctcctcaaatgatggatagactttccgtgcttcccgaagctcgcgccctactggcgcgagtactacggcaggaacaacaccgctggaaaacaagcatgtagctgacaagaccagaccttagcgattcattcgctgatctcgattgcagagtagcgcgaagctatcacctccaccagaggtgcttgatgggtctaacggaaatattcaggccgcgggttcgaccttgaggtccttgataccattttgatcatgcaggctcttgaccgtgggctcgggaacacgatcggcaagatcgttaaggtccagcttttctaacaccggcgacacacgcacccgcaccatctgtgcggcttcttccagcgtcggctcatgctcgcagtcgaattgctcgactaccggctcgccacggtcattgatgaaagaaacattccacttcggcatcggtgcctcctcgataaaaccctatgtgtgggcttacatctatctggaccttgaggcttcgccaaacgttccacccaaggcaggaggcaccggatcagttgcgcttatttttcagcgcgtcccttaagggccttcagggtattgaacggcgcttccaccacgaacttgttggccaaccaagacggcacgctgccgcccggctcggtgtgcacttggtaggtcacttcggtctcattggcgcccttgggcaccagtttccagaagccttcgacctgagcgacgcgcacatagcctttttcttccggcttgtaggtaggcacgccctgcaaggtgcgggttacgctgccatcggcgtttttagcggttgtgacatgaatatacgagtcacgatcactcaccggaaacggtgccttgaattgcgtgtaggtccaggcctcgtcgcctttcttgtcgaccagtttctgggatttacactcgtgaatccacgcgcaggcacccgccacgtcttcttgcaatgcaacgatcttggccacaggcgccttgatcacggtcacgccgcgatacgctttgtacttggagccggcaatttcgctcagggacaccttgataccgtcttcgtccttggccacttgccattcctcagcttgggcagtagcagcaaacagcagtgtaaaaccgcacaacacggccagtcgtttcagcgaacccattgttgtattccttattgttgaagttccaatagtaaagcccatcaagccgccgtcatctgctcccaccagccgatcaagcgaattgcatcggcctggtcattgccacagacctcgatatcagccttgaaatcactgcacaccgccggccgttcaggcaggccgaacagctggcacagttgtccgaccgacaggtgcaggcagcgaacgcctgcaggcttgccctggggcattccgggcagcggcgaactgatggagggggcgatgcagcatgcgccacagccttcacggcatttcatgaccagcaggtcctcgacgactcaatagggatggccgggctagagtacgcccttaaacagccgttttaaaatggtcaaacaggggtttttcgcgcaaaacaaaagtgaccgaccagtctgcgacagatggtcggcaacctgggtcacgcgtagcggcaaagtttattgcttgaattcgaaatccagcgcggcaccttcaacatcacggcgctcatcgttgcgcagttgcagcttcatctcattgctgagcaagcggccgttgatctggaacgcactgttgtcggtgggcttttcgccaaacatcggcggcagtaagggcacgctcttgggcttgggcatggtgccgatcggctgcaacagcctgaccatgtccgagggcagcgaaaggtccaactgtgccggtggcaatttagtctgggcgacttcatgggcagacttggacttgctcgcaacgggcgcgcgctttttgctcgctgcggcttttttctgtgtggccggggcttttttcacgggcgtcggcttcttcacggaggccttctgctcaacactggcagccggcgtgctatcgcccaccggcgtggctgccagcaccccgctaacattgcacaggctcaacaagccaatcaccaaggtaacgcgaaaaatagatgtcatatcgccaacagcgttaacggcagaaggccatatgctcgcttgttgtgcacggcatgacaagggcgcagatcaatgctgtcccctttgcacgcctcaaaaacccgccgcagtctcctggcacagctggctggccagcatgcccaaggtcatcaacgcccgctctgcctcgcggttccagggagtaccgcagttgaggcgaatacagtggttgaactgttccgtattactgaagatcagccccggcgcaatactgatgccctgttgcagggcacgtacgtgcagttcctgggtattgacccgacccggcaaactgacccacaggataaagccgccggttggacgggtcatctgggtaccttcggggaaatattgctgcaccgccagttggaaggcgctgaggttcttgcggtattcctggcggatgtagcgcaggtggcggtcgtagccaccgttttccaggtaagccgcgacacccatctgggtaacactgcatgctgagtgggtactgaacatctgcaggcgctggatctcctgctggtacttgccggcgatcatccagccgatgcgcacacctggggacaaggtcttggaaaaactcgagcagtagatgacccggtcaaggcggtcgtaggctttcagagccttggtgcgacccagttcgaacatcagctcgccgtagatatcgtcctcgacgatctggatatcgaaatccgacgccaggcgcagcagttgtttctggcgctcctcgggcatggtgccacccagggggttgctcaggcgcgcggtgagcaccagcgccttgatcgaccactggttggcggccagttgcagggcttccaggctcattcccgtggctgggtcgctggggatctcgataactttcaggccgagcaaatcggcgagttgcaacaagccgtagtaagtcggtgattcggcggcgatcaggtcaccaggccgcgtgagcacgcgcaaggacatctgcaacgcgtcgacgcagccgtgggtgatcaccacctcggaagggtctaccaccacaccggcatcgcgcatgcggatcgccacctggcggcgcagcggttcaaagcctgggctgaacatgtagctgaaggcccgcgggctctggaaccgtgtgaccttggccaattgctggtgcagcgcccgtacaggaagatagtcgacactcggcaccgcggcgcccaaggggaacaccccttcacggcgcgactcgaccaatacctgctggatgatactgctgcgggtgaccaagcctggacgttcgacccgcgcaatatctggcgtcggcgccgtgagtgcgggtgtctggtgcacgtaatagcccgactgcggccgcgcccggatcagcccctggtcttccaggttggcataggcctgcagcaccgtggcatggctcacattgagctgggaactcatcttgcgcaccgacggcacgcgctcccccggttgatagacaccgcgtcggatgtcctcagccagttgctgggcaatacgctggtaaagcaacagattggtcatgacgcagcactcgatttcacgggtattttatttttgtgtgaaacataccagcacagtttagaagtgtacggggacagttgtcacgatagtcgagcgcgggtgggagtgatagcaaaaactttaaagggagtacgcctgacaaaatgtgggagggggcttgctcccgataacggtgtatcagtcaaaaatgttgcaactgaactaccgctatcgggagcaagccccctcccacattgaatttcgtcagacttcagcgagcagcgcccagttggcctttctcgtcggagaatacgatttccacgcggcgattctgtgcgcggcctcgttcggaggcgttggcttctaccggatactgatcgccataaccctggacctcgatacgcttgtcatcgatacccaggtccatcaacaggtccgccaccgattgggcacggtcgcgggacagtttcaggttctcctgctcgcccccggtgttgtcggtgtagccctcgatgcgcacacgacgcttggggttaagttgcagaaactgcacgatcttcaacaccgtgcgattggccgagttggccagttccgcttcgccggtgtcgaacagcacatctcccagcgtcatcaccaagccacggtcggtctgggtggtgaggctggcaatttgtgcttcaacccacttgccctgttgctgcacgctggccagtttgttttcgcgcagggccagttgcaggcgctggcgttccaattcgagttgggcgccgcgttctgcgttgaggccttgctcggtgtgttcacgggcgatggcactgtagcgctggctcaggtaggcgtaatgcaccacatcggcgccgctgccccagtagctggacaagcgatcggcacgggccagggactcgccggcgcggatcacatccttgggggcgaagcgcagcacgttggcgtcctccttgaccttctgaaagtcatcgccggcctgttgcaacgcctgctcgctgctgggttgactggcgcacccgccgagggctgcgctgcccagcagcaacacacagcctaaactacggatcatcgggctcattgcgcgtctcccaactgcagctgcttacgcaggcgggtgatgcgggtattgagcacgttcaattgctcctggctcttggcggtgagtactttagcctcggcgagacgcgcatccagctcagcctgctcggctcgcatacgcgcacgcttgtaggattggtcggccatgttcgccttggccctggcgaatttttcttcggccagtttcagctcgggcgattcgtcggcgttgaccccgaccgcggtggcttgctccaaggcttgctgggtcaggcgcatttgttcattcggcgcaggatcggttgcacatcccgccagagcgacaacggcgagggccgcgaaaagaggtcgaaaaatcactgtaaatccctactgtgttggggtgccgacgggctgttgcagttgcgccttccagcgctccagattgcgctgcagcgcggcttgcgcgacaccggacgcgggcaattctgtcatctttttcgccaactgtccgcgcagccatggatcattgcacgctgagttgtgggaaatcgccaggtacaagccgggctgatcgacaggctcttcatgggcgaccaagtcgtcactcatgcccaacgtctgggccatggccatgccggaatagcgcccggccagcacgtaatccacctcacccagcaacagtttctggaatgccggcgtcagattgggcaggcgttgcaggctgagctgctggctggcgaaggtttcgaattcagcgctcaagcgggcgcgctccgataccgcgcccttgtggccatgcaggtcagccactgaggtgtaggccagctgtgaatccttacgtgtccagaccaggtaatcggtctgcatcaacgccggatggatgtagtcgaagttatccagttcaacgaggttcagcggcgcgtcggcgaggatgtccatgcgcccgctgcgcgcttcatccagggccagggagcgtttgccgccgtagagcaggtcgattttcagcccgaggtccttgcccacttgttgcagcacctcggcggtagcgccgatcagatgcgtcgggtcctgggggtcacgccacaacaaaggtggggcatcagggctgccggtgatcaccaggcgctcgcacttgccggcggccagtgacaggctcggcagcagcacaaggcccagcagtacagtccaggggcgcagctccatggcatgttccttcgtaaagttcttggtaggagcgagcttgctcgcgaaaaacgtcaacgataacgcgtgctttctgaataaatgcatcgcctgggagtttttcgcgagcaagctcgctcctacagggaataaaaaagcccggtcacaagaccgggctctttataagtgaagcggctggattagaccagcttctccaactcaggtacggcttcgaacaagtcagccaccaggccgtaatcggcgacctggaagatcggcgcctcttcgtccttgttgatcgcgacgatcactttggagtccttcataccggccaagtgctggatcgcgccggagataccgacggcaatatacagctgtggcgcaacgatcttgccggtctggccgacctgcatatcgttgggtacgaaacctgcgtcgacggctgcgcgggaagcgccgaccgcagcgcccagcttatcggccagggcgtacaggtgcttgaagttgtcaccgttctgcatgccgcggccgccggaaacgacaatcttggcagccgtcagctcagggcgatcggacttggccagctcttcgccaacaaaactggacgtgccagcgtcgtgggcagcagagacggcttcaacggcggccgaaccaccttcggcggcaaccggatcgaaaccggtggcgcgtacggtaatgaccttgatcgctgcgttggattgcacggtggcgatggcgttaccggcatagatcgggcgcttgaaggtatcggcgctttctaccgagatgatctcggagatctggtcaacgtccagttgcgcggcaacccgtggcaggatgtttttgccattggaagtggcggcagccaggatgtggctgtagtttttgcccagctccgcaaccagaggagccacgttttccggcagctggtgcgcgtaagcggcattgtcagcgttcaggactttgcttacgcccgcgattttcgcagcggcttcagccacggcaccagcgccttggccggccaccaatacgtggatgtcgccaccgattttagcggctgcggccacggtgttcagggtggccggggccagcaccttgttatcgtgttcggcgattacgaggatagtcatgatcagatcaccttcgcttcgtttttcagtttctcgaccagttcagccaccgacttgaccttgatgcccgcgctgcgtgctgccggcgcttcaaccttgacggtcttgttggtggaggcggtagaaacgcccaaagcatccggagtcagcacttcaagaggcttcttcttggctttcatgatgtttggcagagacgcatagcgcggctcgttcaaacgtaggtcggtggtgacgatggccggcagtttcagggaaaccgtctgcgcgccaccgtcgatttcacgggtcaccgcgacgctgtcgccgttcacttcgactttcgaagcgaaggtgccctggccgtaaccggtcagtgcggccagcatctggcccgtctggttgttgtcgctgtcgatggcttgtttgccgaggatcaccaactgaggctgttccttgtcgacaacggccttgagcagcttggcaaccgccagggaggtcagctcttcggcggattcgaccaggattgcgcggtcggcgcccagggccaaagcggtacgcagctgctcttgggcagtggtcggaccgatggacaccacgacgatttcagtcgcaacacctttctctttcaggcgtacggcttcttccacagcgatttcgcagaaagggttcatcgacattttgacgttagcaaggtcgacgccggaattgtccgccttgacgcgaactttcacgttgtaatcgacaacgcgtttgacagctacaagaaccttcatggattcctcgttactctccggtgaaaagaaagtcgcctaggcgaacctggcggttgatgctcatcggcacacaagggcacctccaaagacttcggcagtggccttgcacacgggaagtgacgaccgttcgtcagtggtgactgagaggtcattctttatcgcggcgtgtaaactgcgcccctgtgtgcgggtacgcgtcacatttttaccttcggccggcctttggacgtgctcttgaaacctgcagtctgcctacgggaagcgcaaaaccgaccgtatcttgaccggaacgcctattctggtcaatacggcaaaatggtcagtcataagccccgttgctttgatttacctaggctgcgggcaattcaaacaaacgtttgtattggacgctgccagtggtctatatataatgcgccacctagagagacaggtgggtgctgccgttgagcagaaccccgccgaacctccacccattagaaaaaaaagcctgttgagccttgagtaggagatagcctgtggaacgcgaatacatggaattcgacgtggtcatcgtcggcgctggcccggctggcctgtctgccgcctgccgcctgaagcagaaggccgccgaagccggtaaggaaatcagcgtctgcgtggtcgagaaaggctccgaagtcggcgcccacatcctctccggtgccgtgttcgaaccccgggccctgaacgaactgttcccggactggaaagagctcggcgccccgctcaacacgccggtggtgcgtgacgacatctacgtactgcgcagcagcgatacctccaccaaggttcccgacttctttgtgcccaagaccatgcacaacgaaggcaactacatcatttccctgggcaacctgtgccgctggctggcccagcaggccgagaacctgggcgtggaagtctacccaggtttcgccgcccaggaagcgctcttcgacgagaacggcgtggtgcgcgggatcatcaccggcgacctcggtgtcgaccgtgaaggcaagcccaaggaaggcgtatacaccccgggcatggaattgcgtggcaagtacacgctgtttgccgaaggctgccgtggccatatcggcaagcagttgatccagcgtttcaacctggacagcgacgccgacgcccagcactacggcatcggcctgaaggaaatctgggaaatcgacccggccaagcatcagccaggcctggtagtgcacaccgcgggttggccgctggacatcatgagcgccgaaaacaccggtggttcgttcctctatcacctggaaaacaatcaggtagtggtcggcctgatcgtcgacctgtcctatagcaacaccttcctgtcgcccttcgatgagttccagcgcctcaagcaccacccggtgctggcccagtacctggaaggcggcaagcgcgtcagctacggcgcccgcgccatctgcaaaggtggcctgaactccctgcccaaaatggtcttcaagggcggtgcgctgatcggttgcgacctcggcaccctgaacttcgccaagatcaagggcagccacaccgcgatgaagtccggcatgctcgccgccgatgcggttgctgatcgtctgtttgccgaatccgaaggcggtgacgagctgaccgcgtatgtcgacggcttcaaagccagctggctgtatgaggaactgttcgccacccgtaacttcggcccggcgatgcacaagttcggcccgatcatcggcgccggcttcaactggttcgaccagaacatcctcggcggcaagatgccgttcaccctgcacgacaccaagccggactatgcctgcctcaagctggccaaagactgcaagaaaatcgactaccccaaacccgacggcaagttgagcttcgacaaactgagctcggtgttcatctccggtaccaaccacgaagaagagcagccttgccacttgaagttgaaagacccgagcatcccgatcggcaccaacctgccgctctacgatgaaccggcgcagcgctactgcccggccggcgtgtatgaagtgatcacgaaggaagacggcgagaagcgcttccagatcaacgcccagaactgcgtgcactgcaagacctgtgacatcaaggacccttcgcagaacatcacctgggtgacaccggaaggtgcgggcgggccaacttacccgaatatgtaagccactgaggctcccaattgggagccttttttatggccaacatcaatccaaatgtgggagggtggtttggcctgaaatgctacgcagcgcgctcttcaccagggttacgcaggaaatagcgcttgtactcgcgactgaactgcgacgtgctctgataccccacgctatgcgccgcctgcgccacactcatgccgtctatcagcaacaattgctgggccttcaacaaccgcaggcgcttgaggtactgcaccggcgacaacaaggtgcagcgcttgaaatgctcatgaaaggtcgaggcactcatatgggcataaccggccaacgtctcgatattcaacggctcggcgtaatgggcatgcaggtggttcaatgacgtggcgattcgcgaaaactgcccctgctgttccaccaacgcacgcaacacatccgcctggggcccacgcaacgcggtgaacaacaattcgcgtacccgcgccgggcccatgatccggctttccagcggatcgtgcaggcactgcaacagccgctccacgcagccgcgcatggcatcgtccagcaccaccgaactcatcgactccaaggtctgcgccgtcggcggtggtccgccctgcatgcccatggcaatgaccaactcccccagcaccacccgatcgatacccaccgtcacgcccaacagcggcgcgccaggcgccatggcaaaggtctcgcactcgaacggcaccggcatcgcctggaccaggtaatgcccggcgccatactccagcgttctcgggccgaggtaggcaaccttgctgccttgggccacgaacatcaggcttggctcgtagatctgcggcccacgcgccacgtcgcaactggcgcgcagcacctgcacgccgggcaggttggtcggggagaaaccgtcgcggggcgcgagcccttcaatcagggacaccagcgtggcgttggcgtcgagatggcgggtcaacaacatggcaaaaaacttcgtgaacaagggatgagagcatcatcgcaggtctgacggcgaatacatccaaagcaatgccagtcccggacgaataggcatgagactcggagcatttgccatgttcgcgcccatgacccaagcgcagaatgcgccgcctccccagtccaagctttagcgaggtttaccatgtacaccgccatcggttatgccgcccagtcggccaccactcccctcgcccccatgtcgtttgaacgccgcagcccgcgcgtcgatgacgtggccatcgagatcctctactgcggcgtgtgccactccgacatccaccaggcacgcaacgagtggggcatcgccgtttacccgctgatgccgggccatgagattgtcggcaaggtcaccgctgtcggcaccaatgtgaccgcacataaagtcggcgatctggtcggcgtcggttgcatggtcgactcgtgccgccactgcgaagcctgtcagtcagacctcgagcaatactgcctcgaaggcccgaccatgacctacgccaccccggaccgtgtggatggcagcaacaccatgggtggttactccgacagcatcgtggtcagcgagcacttcgtggtgaaaatcccggccaagcttgacctggccagcgccgcgccgatcctgtgcgcgggcatcaccacctactcgccgctcaagcactacggcgtgaaggccggcgataaagtcggggttctcggcatgggtggcctgggccacatgggtatcaagtttgccaaggccatgggcgccgaagtcacgctgttcacccgctccgccagcaaggccgaggaaggccgtcgccagggcgccgaccatgtgatcgtgtccaccgatgccgagcagatgaaagccgctgccgggcacttcgacttcctgctggacaccatcccggtgcaacacgacctgaacccctacctcgatgtactgcgctttgacggtgtgcatatcctggtcggcctgatcgagccggtggacccgcccgtcaatgccgcaaagttggtgctgggccgtaaagtactggccggttcgctgatcggcggtattgccgaaacccaggaagtcctggatttctgcgccgagcacaacatcacctgcgacatcgaaatgctcgacatccgccagatcaacgaggcttacgcacgcatgatcgcgggtgacgtgaagtaccgctttgtcatcgacatggcgagcctgaaagcctgatcaggctttcgcgcccaactccgctgacagccgggctgcgacctgtttgatcacagggatcagctcggccattttttccagcggcatgtagggcacggtactggcgatgctgatgccggcgactatacgcccgctggcatcacgcaccggcgcggccacacagcggatcgatggctcgttatcttcgagatcgaaggcatagccacccgccacatattcacccatgcgctgcttgaattgcgcccaggattgctccgggtgctgcggccattgcaggtttttgcctgccgccggcaagctgacttcgtagaggcgctgccactcctgcggcgaatcatccaacaacaacgccttgccgatgccggtgcgcgccagcggcatgcgatgaccgacccgcgagcgcatctccgggccattgcgaccggggttcttgtgcaggtaaagcacgtcgtcgtattcacgaatcgccagatggatggtgtcgcccgtcaaggccgacagctcgtccagatacggcaccgccaggctcaccaatggcagctcttcgcgggcctggaagcccagctcgatcagctttggccccaacaggtagccgacctgcggcaccacgcgcaggtaacgctcatccaccaggcaactggctaggcgatgcgtggtgctgcgggtggtgccgatgcgccgggcgatctccttgagatcccgcgcaccggccgccaccgcttgcaccacgcccaggccacgcagcagggtctgggtgccggtgggggcggcgtctttgacgggggtgtgggcgttttcctgcatatccgggcctataaataaaaaagcgggggcattatggcaaataccgcccttcaatacagagcagatccaaatgtgggaggggcgtcgcgacgattcgacttgctcccgatagcggtgggtcagttacagattttctatctgatacaccgctatcgggagcaagccccctcccacattgagtcctcacctggcataactcagcgctgcttcatgcggtcgatgatcaccgccagcagcaggatcgagccgcgaatcacgtactggtaaaaggtgtcgatgtttttaaggttcatcgcgttctcgatgatcgccaggatcagcacacccgcaatcacgtggcggatcatgccgatgccgccactcagcgataccccgcccagtacgcacgcagagatcaccgtcaattcgaagccctggccgatcatcggctggccggaggtcatgcgcgaggcgaggatcaccccggccagtgcaccgatcaaaccgtgcacggcaaagataatgatcttggtgcggtcaacattcacacctgccaatagcgcagcttcctggttgccaccaatcgccatggtgttgcgcccatagctggtgtagttgagcagccagccgaagaatacaaagcacagcacggtgatgataatcggcaccggcacgcccagcagctggccgttgccgaacacaaagaagccttcgtccatcacccccaccgccttgccgttggagaagatgtaggccaggccgcgtacgatttgcatggtcgccagcgtcgcaatcagtgcattgatgcgcagcttggcaatcacaatgccgttgatcagccctaccaccaggcccatggccagagccgccgacacgccgagtgccacactgtcggtgtcgcggatcacaatccccgccactacgccggcgcaggcgatcaccgagcccaccgacaaatcgaaatgccccgaggccaggcagaacagcatggtgcacgcggcgatgcccacggtggaaattgccaggccaaggccgcgcatgttcagcggcgaaaggaagttgtcgataaacaccgcgctgagcacaaagatgcccaacgccgctaacagcatcacccagtcatcgagaaatttgcgctggttgaatgccggccagaagccctttgcagtttttacctgagtcatagccaaaccctcttattcttcaagcccgcgaacgcgggagtgccagttgcaacaggcgcgcttcatccgcctgcgcgcggggcagttcaccggtcaaggcgccttcactcatcgcgaggatacggtcggcaatgcccatcacttccatcaggtcactggacaccacgatcaccgcaatgccgctcgccgccaggttatggataatctggtagatctctgacttggcgccgatatcgatgccacgggtgggttcgtccagcagcagcactttcatcggcatcgacagccagcgacccagaatggccttctgctggttgccgccggagaggtacaggatcttctgcgcggcgttcggggttttgacccgcatcgcctgaatctgccgctccgcgttgcccttctcccagccgtcgcgcaacagccagccaaaggtggaatgcgccgcgcgggcactgatgttgatgttttcggcgacgctggccagcgggatgatgccttccttcttgcggtcctccgggcacagcaacacgccagcggcgatggcgtcgcggggtgagcgcaactgcagcgcttgcccgcacagctccaggctgccggcgctggcgcgctccaggccgctgagcaaacgaaacagctcggtgcgccccgcgcccaccagcccgaacaggcccaggatctcgcccttgcgcacctggaaactgatcggctcacgcagccccgggccgagcaggccgtcgaccttgagcgccacctcgccctgctcccgcgggcggtagtcgtagatgtcctggatatcgcggccgaccatgcaggtcaccaactggtcgtgggtcagggtgctcatgtcttcgaaggtgcgcacatagcgaccgtccttgaacaccgtcaccgcatcgcagatacggaacacttcttccatgcggtgcgacacgtagagcaccactttgccctcgtcacgcaggcgcgcgatgatcgccatcagccggtcgatttcccgtgccgacaagctgctggtgggttcatcgaaggcgatcacgttggcgccacgggacagcgccttggcgatttccaccagttggcgctggcccagggacaggcgcccaagcttctcgtcggggtcgatctcatcggccaggcccttcaggcacgtcagcgcctgctggcgcagcaggccgcgattgaccacgcccaggcgcgtcggcaagtgcccgaggaacaggttctcggcgacgctcatttccggcaccaggtgcagttcctggtggatcaccgcgacgccgctggcgatgctgtcggcggcatttttgaacgccatgacctgcgcgccgatctgcacgctgccgctgctgggaatgtaggcgccgccgaggattttcagcagcgtcgacttgcccgcaccgttctcgcccatcaaggcatgcacctgcccgggatgggcggtgaagctgatgccgtccaacgccttgaccccgggaaaggttttgccgatcgcgtcgaaacgcagggccgcagcggtcatttccacagcccgatcttggtcagttcttccttgaagttcgcgcgggtgatcagggtgacttcgtccatggcggtgtacttcggtggttcagtgcctttggtgacccactcgtacatcatcagcgcggtgttatagccctcgatgtgcgggctcggcagcatggagccgaagaaaccgctgtcggctttcttcaattcgccgatggcgtcggtgccattaatgccgatgccgatcacgttggcggccttgaagccggcgctttcagtggcgcgcacgccgcccagcacggtgttgtcgttcatgccgccgatgatcaggtttttagcgccgccgggcagcttgaccagggccgagttggtggcgtccatgctgccaggcacgtcaagagtcttgagggcagcggtgaggatgtgatccttggggatgccggcttcctccagggatttgatcgagccgtcagtgcgctttttaccggtatcgagctcgttgaaggtgttgatcaccgcgtaagtgtccttccagtcccaaccgcgtttcttcgcctcggcggccatggcggcgccctgcttctggcccacttcgaaggcggccatgcccaagtacggcacgtcctccatgaagttgcccttggcatcgacaaagcggtcatccacggccatcactttcaggccattgaccttggccttggcgacgatggccgggcccagggacacgtccggcgggcagatcacaaagcccttggcgccgttggcggccaggctgtcgatggccgagagggttttctcgccgtcgggcacggcgatcttgatcacggtgaaaccgtgttccttgccggctttttcggcgaaggcccattctgtttgaaaccagggttcttcggcctgcttgaccagaaagccgatcttcacttcttcagccgatacaacgccgctgaacgccaacgccagcgccacagccccgagtgccttcttgaacatgaaccacctccttcttgttattggaaaacgctttagtcgtggtacatcaccgaccgcccgccatcgatcatcaggcaggtggcattgataaagggcgcctcgtcggtcgccaggaacagcgcggtcatcgccacctcgatgggctggccgatgcgcttgggcgggtgcaggtcgaacgcgcgctggcgctcggcgtgagggtcggcgaaaccgttccagtagtcgacgttgagctgggtttcgatataacccggggcgatggcattcacacggatgcccttggacgcgtattcgatgcccagggcgcgggtaaggccgagcaggccatgcttggcgacgggatagggaaagcacccgggaatgatgtggctggaatgggtggaggcaatattgatgatgttgccgatgccctgctcgatcatgtgcggcaacaccgagcggcagccgtaccaggcgccgtcgaggtcgatggcaaagcagcggcgccagtcttcgtcggtcatcgccaaggggtcgcggaacacattgaccccggcgcagttgaccagcacatctacgcggccgaagcgttcgatcgccaggttgaccagcgcccgccattgatccttggaggtgatatcgacgggctgggcatggatctgcgcaccgcgttcgcgccaatgggcggcgatcttctcgattttttcgccttggatatcggcaatcaccaaacgcgcctgctgggcctggaagcaggcgacaatcgcttcgccaatgccttgggcagcgccggtgacgatcactaccttgttcttcaaacgctcgccgtaagtcggctcgggcaccgcgggtagtgacaacggttgtgcctgcatcgcttcacctgttttattttttgatagtgagtgctgatgcaggcgactataaacctagatcttgaaatatctcaatatataaatttcaatcccatattgtgagcaatcgcaaaaaaaccggccattcatagccggttccgaagaccgtcagccttgggcaaaatccctcagcgcatcaccttccatacgatagcgcacccactcttcctgcggctgggcgccgatggacttatagaaggcgattgccggctcgttccagtccagcacgctccattcaaagcgaccgcaaccattgtcacaggcgatcttggccaagtggcgcagcaacttcttgcccgccccgccgccacgttgttccgggttgatataaaggtcttccaggtacaggcagttgctgcccagccaagtggaatagctgaaaaagaacaccgcaaaaccaatcggcaggccgtcgcgcagacacatcaggccatgggccgtggcaccttcgctgaacaggctgcgttcgatatccaccacgctggcgatcacctcatgccgggctttctcgtactcggccagctcggtgataaaggtcaggatctgcgcagcatcgctgggcacggcggggcgaatctcgatggtcatgggcaagccttgggtaaattcagagcccacatactaaggcggttcagtgaccgattgcagcgcaatttcatacccaggagcatgttttactccgctgcaccgggatgccagcaccggcaaacacagaacaatcccgctggatacccatggtaaacagttggcataaatccaacgatcaggtcctgctcatgcacgccacgtctccagtcggcgcaaagactttcgcgctgttctgcctcgccagtttcctgctgtcgctctcctatggctcgacctttttgctgtcgctgctgattcattcacgcggcggcaatgagcacgacgctggcagtgtgattgccacggcaatgctcagcacttttgtggcggtgcttctttccgggcatttggcggatgcgctgggcgcggcgcgagcgattgcgagcgccggcgtattgctggtgttggcctgcctggggttcgccctgacgcctgggtttggtcagggcttgatgctgttcgggctgtctctgggtctgggctggggcgtgttctataccctgggcccgatcatcgtgacgctgctggtagaaccctgccagcgtgccaggtatttcgccctgctgtcgggcagtatgttgagcggaataggctccggccctttactagggcgcgccgccattgcgctggacctgcccctgacgactgcgttctatatcgccggtctggccagccttgccggcgtggtgatgttctggcgcatgggcgccctgctcaaggggcatgcgaatgtgcctgcgtcgaggatcacctggttcgctagccgccgcgtactgtcgtccaaagcggtgttcgccatcctgatggtcggcctgggtggttgcgtatttggtgggctgtcatcgttccagaccagctacgccgctgcccatgggctggactactcattgttctttgccggcttcctgacggcagcgatcaccagccgtctgctggtcgccggttttgtggtcaagcgcgatgcctatcaggctgcctgcgtgttgtccgggataatgctcggtgcgatcgcgctgtttgcatttggtgtgagcggcaacctcagctatttgctggccgccgctattttgggggtcgggtatggcctgacgtattcggtgatcaatgggctggtggccaatgaggcacccagtggcaccacgtcccaggcgttattgctgttcagcatggcgtactttgtcggcgtcttcgggtttccctggctcgcgggcaagatcattgtcgattacggtctttgggcaatgatgctgagcgtactggttatcgccgcactcaattgggcaatcgccgcacttcgcctgataacgcgcagcgtttgggcacataaaacgaatacaggcgaattgataccgttcgtcgacatcaaggcacgatcaccgaatgaggggggaccaatacagggtaaggacattaatcatatggagacaccctcatgaaaaattccaaattgtctgccctcgccctcgccggcctgttgtccgccgcatccctgggcgcgtttgccgccacatcatctaccggcaagactgatccagtcggtagcccgcctagccccgccacccaggaatcccaggattcaatgggcaccggccttgataccaatggtggcgcgatcatcgacaacggcgcggacccacgcaccaagggcaacgacacccagcgccaggcgccggctgccgtcggcaacggcaagatgggtcccggcaccactaacaatgagccgaaaatcaacaaaggggatgactcaaacgtcccaggtgcgccgaaacaacccgcgccttgagatacccgtagtacgaccgacacccgaccatttcccagtgaagaggtacacatgaacgtcgatagaaaccttgaaaaagaagtcctcacccgtctgctgcacgcccatccgcaaggcttgggcaaggaggtgctggacaattaccgcggtgaaaaggaggtcgccagtgtcttggcgttcctgcaggaccgcggattgatcaaggatgggcatgtgaccaccgatgacgccggtgaatactcgttgaacctgccgatcaagctgactgcctcgggtgtggatgaggcgcgcaagctggacggtgcagtctctcagtaatccatttctgggctggcccctggtaacaggggccagcaggagttttagcgatgcctcgtggaagcaaagccaaatacaccaccgaacagaaacgcaaggccgctcatatcgaagacagttatgagcacaagggattatccaaggaagaagccgaagcccgtgcctgggccaccgtcaacaagcagtctggcggcggtgaaaaagccggtggttcgggccggcgcaaggccccggcgaagaaagccgaggatcggcatgagtcgtccaagcgtgcggcggccagccgtgaaggacacccgcgcagcagccgggcctcgctgggtacgcaaaccaaggaaagcctgatgaaggaagcgcgggccaaaaatatccccgggcgctcgaccatgcgcaaggatgagttgatccaagcgctgaaaaaagcaggctaaacaccaatcaaaatgtggcagggggtttgcccccgattgcagtggaccagtcaacagatgtattgactgacactcagctatcgggggcaagccctctcccacatttggatctatgtttacctggaaactagtgcatcaacttcggctgcgcctggacaagtcgccggtccccaacgagtcactgccaatgccgccgccgcattagcccggcgtgctgcttcagccggcttcaaacccgtcgccaagccagcaataaacacccctgcgtgtgcatcccccgcaccattactgtccaccgcatgcactttgaacccgggcacatgttcaacctcacctgtgcgtcccacccagcagccattcggcccgtcacgtactacgagcaacgtttgtgcagctaaatatcgattcagttcgcgcaacgcggcggcgatatccgtcgccccggtaaacgctagagcttccgggccattgctggtccagatatcaatacgcggcagcaacccacgcatcaacgttgaatccggcgccttgaccagcggccccgggtcgaacaccacaacgatctctcgtggcaatgccaacagccagtcaatcaacggctgtgccttgccttcaaggagcaagctgtaaccactgacatacacataatcatccgcacgcggcaccgcgcgggccaggtctgcggcactcagctcgccctcgacgccgatatgggaaatgaatgtgcgctcggtgctggcttcggtcagggacacacacaggccggtgtctttgtcgctgctggccgccaaggccatctcaacgccctcagcctgcattgcctcacgcgccaggtcgccgaagcgcccgtttccgtggcggcccaggtacaccaccggcaagccattgcgccgagcggcagccatcacgttaaagccaccgccggcttggaaactggcggatttcgccagcacatcaccgcccgttgccggcagggtgtcgagggccatgaccaggtcgacgatgacctggccggtgtgcagcaatctagacattcggactctcgactaaagccgcgcgccggtcggccgcgccgcccagtaccgcataaattccgccagccaccaggaacgtgacgatccagcccaggccgttatggccaagccaggagtcggacaacggcccggcaaaccaggtgttgtcggcggtggtgccgatggtggtgaagctgaaccccagcactatggccacgacccaggcgccaaacgcccgccattccacgccgccgcgataccagtaggcgctgcttgggctgacgtccagcaggtccttggggctgtagtagtgacgatgaatcaggtcgaccacgaaaatcccgacccacgcagtgatcggcaccgccagcagcgaaatgaaggtaatgaacggcccatagaagctgtcggcgatcagcatgaagtagatggaacctgcgaagatcgccacgatatcgacgatcaccgcatgcacgcgcttgaccttcaagcccagggtcagtgtggtgagaccggcggaatacactgacaggttgttcgacagcaacaagccgccgaacgccgtaatcaggtacggcacggccatccaggtcggcagcatgtcgcggatcgcgatgatcgggtcggtggccgacgccaggtcattgttacccaccgacagcaggccgccaagagtgatcagcagcaccagcggaatacccgcgccaaacgcggcggacgccaccaagcgcacggccttgacgctgcggtgctggtagcgcgacatgtcggcaccggcgttggcccaaccgatccccgtacccgcggccatggtgccgacaccgatgatcattgcgctcagcggcgctggggtggcgttgaacaccgcgctccagtcgatggtggcacagaggaatccacccaccaggatgttcaagccgccgaatacgtaggtggcccacttctggatcaccagcaaggtggcatggccgagaccggaaacggccagggtcagtagcacgaagatagcgataaagaccagggtcaacagcggcgcgcttttcgccgccactggcgaaccgaacaggatcgaacacaacgacaacagcacaaaggcggcggtggtggtgttgacggtttcccagcccaggcgcgacatcaacgagaccagggtcgggccgatattgccgcgtacaccgaagatggcgcgggacagggtcaggctgggcgcgcgacctcggcgaccggcgatggaaataatccccaccaccgcaaaggagccggcggcgccaaggatcgcaacgatgatcgcctgccagatggccaggccacgaaacgccacgagggtcgcgcccagcggcaaaccgaggatgctgatattggcggcgaaccatacccagaacagctgcagcgggtggccgttgcattcgctttcagggaccggctcgataccgcgtgtttccaattgcccggcaccctggccggaagaggtgctgctcatgagggggtgctcctgatgcctgtattattgtggttgtggcagatgtgcaatgtgcagcggtatcccggtcttctttggcttgtgctgctcaacgcaatttgagcagttcttgaaccagcggccacaactcaaggccattgacctgcttgacctgctcgatcagcgcctcgggccagcattgcatacccaggcacgcccccagcatggcgccgaggatcgcggcgatggtatcggtgtcgcctcccaggctggcagccaggcacagggcctcgaaggcattcatctcgcccgacgccacttgctgcgcgagggcgaacgacaccaccaccgactcctgggaggcgaccgatgtgccgatcaattcatagagcaggtccgcaaacagcgctgtatcgccactgccaacgctcagggtgcgcgcccagctgatgcgcgtggaaatgcgccccccggcgatccaatggccgtggttttcggcccgctgcgcaatctgggtgccgatgttcagggcttctcccaggtccactccgttgatgccggccgagaccaccgccgccacggctgctgcgctggaaatgcccaggctggtgttatgggtgacctggcaagcctggatcaccgcccggataaatggctccggatcgctgacatcggccgcgatgcccactggcgtgatacgcatggccgcgccattggtggtgccgtagcgcccagactctgccgcggtgtggccggccaggatcatgtcgatggcacgtttggtcgacggcccgagcaagtcctgggaacccttggcgcgcatcacggcctcccaatcgatcaggcgctgagccagcaccgtgggttcgatctgaccctggccttgcaccaacaactcggcgaccaggatggcttgctcggtgtcatcggtaatggagccggcaggcatgttcggggcgatgggctggtcggcgcccgcatcttccagggcggtgatgcctccgaaacgctgtcgaacctgctcccggctcaacgactgggtgggcatgcccaaggcatcgcccagggccaagccgtagaaggcaccaagtgcgcgatgttctgctgtcatttcgacgctccgaattgcaggtgcaggcgaaagtgcacagggtcgagcaggctctcaacatgctccatgaaacgctcgcgacggtcataggtggtgcgcgaggctttgagaaagaccgtgccgatcggccgcccgagccgttcggcgtcttcgtcgctgaggggctcggcaccgatccattggtcgccatcggcgcccacatagccgtaggccgccagggtgatggtcaaggaattgtcgatcaggccgatgcgcggcaggctttccaggtcgccgacagcgggcatcagcgagcgttccagggataccggggtaccgtcggcagcgcggcgcaggcggtcaagggcgatgaattggtcggtgccgaaacggctcaacaggtccgcacgggtcacggcctcgaagcgcaggatctcggtggacacctgcgcgccggtatccgccagggcctgggcccaaccgctacgctggtccagcaccatgccgtcgaaggtgacgatggagccgacaccgctttgggtcgcaatgtagtgacgacgtttaagctcagccagcgcttcgcgcaacgtgccacggctgaccgcaaactcctcggccagttggtgctcgcccggcagcaggaaaccgtcggccatcactccaccctcgatacggcggatgagttcgtcgacgacgcgttttttcttatcaaatcggacatgtctaatcatgtacaaattgataaccgaaagcgcccattcccggcaagggaattatttcagagcaaagacaaaatcggcttcaaggttccaggccaatggggaaaaataccccgccgctccatacgccaagccagttctgaccgttgatcggacgactcaccgccagctccaccaattgatagaaggcattgcggtgcaccagggcttcaagattagcgcgcacccgcagatagggcgcaggttcctgggtgtcggggtcgatcaccacccgcaacgggtgttcaaggccggcctcgatctgctcatcgacgttggtggtaaagcgcagtaattgactttcgccctgcccttgcacgtccagggtgacggcgacaaacggcgcgtcatcgacggttatcccgactttttccaccggggtgaccagaaaatagtcatcgccatcgcgacggatgatgttggagaacaacttgaccatcggcttgcgcccgatgggcgtgccttgatagaaccaagtgccgtcgcgggcgatgcgcatgtcgatatcgccgcagaaatccgggttccacaggtgcaccggcgccggtcccttgcccttgggcagttgggccaatagatcattggccttggcggaatcggtcatggggttctcctcaggtctactgattgctcatgcccaacaagcctcgggcgtattgcgccaggggacgggcaatcagatcttgtggtgatgtgtcgtggaacgtcagtaaaccgccacgactgcgaatacgggcagtatcgatcaaatactgggtgctggtctcgatcaacatgacttggatcacgccgctgtccagccccaggcggtccagggcttgctggtcagtccattcgtcggcattgccgatacggtcatcggctgccgcaaaacggcaatacagcaagtagtgggcacccgcctcgcgggcttcggccatggcctgctcaagaccttccggttggcgcgcacgacgcaccatcgggaaatattcgacgaagccgttgaacgcctcctcggctaccacgttaggccgcggatacgcactgcccggcggtacgaaggcgccctgggcgataaacacaaaggagtccggctgtatgcgcactgaggcagtacgccgggtatcgctgtggtcgagcaacccggcgtcgctcatctgatagcgggtgccttcggccatatcgctgacggtcatgcaaccgcccagggccaacaacgccagcagcaaaaccagactacgcatcctaatcctccagaagccggtgacggaaaaccggcgaatgggggtgagatgcagaatccgcgccattgagcagcgcccccaatcaaatgtgggagcgagcccccacattcatttgtgtgaactcggaagatctacattagccgccgatgatcttcatgaccgtcgcgccgccagaaaacgctacttcctgtttgtcgcccagagccttcatcagcaagccctgcagggccggcaatgcctggtggcgcggctgatcgagcaagtcaccgacgtagtggcgattgctcgatgaaaggcacccatgcagccatccagtggaggacaagcgcagccgcgaacaggtgcggcagaacggcacgctttcgttggcgatcacgccgaagaagcccttgcccggcacttcgtagcgcacggcagtagcgtcgacgggcgcattggcttgcaagtattcgtggtgttcgccgatcaggctgagcagttgttgcaagctgacgaactgttgcaggaacgcgttggagtccttggccaggtggcccatgcgcatcagttcgataaagcgcagctcgtagccgcgctccaggcagtaatcgagcagcggcatcacctggtccaggttctggccgcgcaacggcaccatgttgaccttgatcttgatcccggcagcgctggcctggtccatgccgtcgagcacggtgaccaggtcgccgccacgggcgatgctgcggaaggcatcggcgtccagggtatcgagggaaacattgatgcgtcgaatgccggcggtcaacagcaacggcaacttgcgcgccaacagttggccgttggtggtcaggctgatgtcgctgaggcccatctgccctaccgcgcccatgaaagcttccaacttggggctgaccagcggttcaccgccggtaatgcgcaagcgctcgataccggctgcttcgatcaggtaagccaccccccgagccatggcctcggccgaaagttcgtcttgggcagccaccagccgcttgccatttggcacgcaataggtacacgcgtaattgcaggctgaggtcaggctgattcgcaaattgcgaaaacgcctgccttgacgatcaacgatcatggatcactccggcagaggataattcgggcgcactaaaagctgacttataaatcagcttttagcaaggtccttgcctgagtatattcctggggtactgcgcctggcagtaaatcattggcgaatgacttacgtagccggggtttcaccactcttttcagcgcctggcagttcagtgctgtgcttgcgcttgttgcccatgcgcacaccgatgtccatcaggaactggaagaagccttcctgatcttccagcacattgctccagaacggcgagtggtacaacgccacggcgccatgcaccaaagcccaggcggcgcagtagtggaaatacggcggaacgtcttcgagcttgccttcactgatacggcccttgatcagcagcgttaggcgttcgaagttcgaggcgcggatcttgtgaagctcctcgaccatttccggcacctggtgacctttgaccaccttctcttccaggcggtcgaacaggcggtagcgttgcgggtcacgcatgcggaactcgaagtaagcgcgggacagggcttccttgtctttgtcgacgtcggccgagtgcagcaactcgttcaagtcacgctcgtaatcgagcatcaggcgcaggtagatctcggccttggacttgaagtgcttgtagattgtgcctttgccgatacccacggcatccgcgatcatctcgacggtgacactgtcttcgccctggtcgaggaataacttgagtgcagtgtcgagaatttcctgctcacggcggcgaaactcacggaccttacggggttctttgtgcatgaggaagaggtctgcaaaggtcggaatagggagggttgcgcagggccacagatacgtggcgatacgatttacccgatgcgagggattatcccgactgaacggtcgttgggcaatgtctatgtgaacccgccaggcacataactttcaatgcgccaacgatcctgcctctatcagtcagaaataatacgtatcacctgaacctgcccacctgagcaatgagaactcaagagaagcgggcgtattccaaatctgtttaaaaaacgatcagatccgactggactgaatgagatagtgatcaatacttcaactgtcggcgcgacatctcccccaagtgacgcgtcgacctgggtaccgacggactgtgtgcccttgttttactcctaatggtcttagcccggattccccccccagaacccgggttttttttgcctggaattcgagcgtttatccaactgctacatgggccagcggaaacagtcgcttgaagttctcggtagtttgctcggcaaaatgctcgtaggactcgccgcgcagcattgccaggtagtcagccacgtcacgcacatattccggcaggttcggcttgccgcgatgggggataggcgccaggtagggcgagtcggtttccaccagcaggcggtcggccggcacttggcgggctacgtcacgcagcgcgtcggcattgcgaaaggtgacgatacccgacagggaaatatagaaccccaggtccagggcggccttggccatgtcccaatcttcagtaaagcaatgcagcactccggcctgtggcagcgcggcttcacgcagcagcgccaaggtatcggcccgtgcgccacgggtgtggacgatcaccggcttgccggtctgtcgggcagcttgcaggtgcaggcggaacgaggcctgctgcaactcggcggcttcgggctcgtagtggtagtccaggccggtttcaccgatggctaccacccgtgggtggttgagttcgcccaatagccaatcgagggccggggcttcgccgggcttgagatccagcgggtggatacccacggagcaatccacgtccgtgtagcgctcagccagggccttgacgtcggcggcgttctcagcgctgacaccgatacacaggaagtggcctactccacgctggcgggcagcttcaagggcggcgtcgagggaaccgccgtgctgggcaaggtcgaggcgatcaaggtggcaatgggaatctacgagcatagggagtcagggctttaagtcacgaaaagggtctggcccacgatacacccgtcggccacggaaattaacgccgcccgagcaggccgacccactgcaccagcagcgcctcgagcaacagcacgcggttgaggttagccttgccgagcaccttctggcgctgcgcaagaatccagtcctggatgttcagcactttgtcctgggcacttttctgcgccaggtattgcacgaccttgcgcatatccgccaggcccaggccgttttcatcctgggtcagctggtagcgcaggatcaggctggaccagtcgcagaaccagtcgaacaacagcaacagggggatatccttccaggcgccttcggccagttgcgtggcggacagctcctgcttgagcagcttcttcacgccatccacgaccaacgcccgctgctcacgcacgccctgggcttgcagcttgactgccgccaagggcgaaccggccgccagggtcagtaattcgacgcgttcctctgcggtgcactccggcaatgcctgcgccagccattgcaggctcatggcctcgctcggcaatgggcatgcctgctgcacgcagcggctgcgaatagtcggcaacaagcggctggactgatggcttaccagcaacaacacggtatcgccggagggttcttcgaggcttttgagcaaggcgttagcggcgttgatgttcatcgcctcgaccggctcgatcaacaccactttgcgcccgcccatctgcgcggtctgcaccacgaagctgaccaggtcacgcacctggtcgaccttgatcgctttgtccgcttcctcgggttccagcacatagttgtccgggtgactgccggccttgagcagcaggcaggatttgcactcaccgcacgcctgcagatcgaccgggcgctggcacaacaggctggccatcaggcgctcggcgaggtggcgtttaccgatgcccaccggcccatgcagcaaataggcatgggcgtgctgggcacgcccggccagttgctgccagaggctgtcctgccatgggtaggactcagccacgggtgcgctccaacagtgtcggcaacagtgcgtcgatggcctgttgcacccgggccagcggctgggcggcgtccagcaggtgataacgcgccggctcagccttggcacgctgcaggaaagcgctgcgcacagcttcgaaaaatgcctgcccctccaactcgaaacgatccaggcgcccccgggcactggcgcgagccatgcccacttccaccggcaggtcgaacagcagggtcagatcggggcgcaaatccccctgcacgaaggtttccagggtagcgatgcgttccaggcacaagcctcggccaccaccctggtaggcgtaggtggaatcggtgaaacgatcacagatcaccaccgcaccgcgtgccagggccgggcggattacttcggccaggtgctgggcacgggcggcaaataccagcagcagctcggtgtccgggttcatctgctcgtcacccggggccaacaggacgtcgcgaatccgctcggccagtggcgtaccacccggttcacgggtcagcaccacttcgatgccctgagcacgcaggcgctcggccaggtagtcacggttcgtgcttttgccggcgccttccgggccttccagggtaataaacaagccagtcacgggcagtccttagtcagagtcattgcgggctttgcggcacgatagtgtccggcgcgggctcggtcggtgcgtcgccgggtggggctgcgtcgtccagtggtttcaccaccggcgccgggctggagcggtagtcggcacgccgcttgagctggaactcgcgcacggcggcattatgcgcatccaggttatccgagaaaatatggctgccatcgccacgggcgacgaaatacaggctgctgcccggttccgggttcagcgccgcgtggatggcctcgcgaccgaccatggcgatgggtgtcggcggcaggccggctatcatgtaggtattgtaagggttggcttccttgaggtgggcgcgggtcaacttgccgttgtagcgttcacccaggccgtagatcacagtcggatcggtctgcagcaacatgccgatcttcatgcgacgcacaaacacaccagcgatctgcccacgctcttgcggtacaccggtctccttctccaccagggacgccatgatcagcgcctgataagggtcggtgtacggcacatcggcggcacgcttgctccactcctgagcgaggacatcgtcgaggcggttgtaggcttttttcaggaattcgacatcggtcataccgcgcacgaagcgataagtgtcggggaagaaacgcccctcggggaatacacccgggtggccgagcttttccattacttcactgtcagtcagccctggaagggtctgcacgatcttttcgtgcttggccagggccatgcgcacctggcggaaattccagccttccaccagcgtcaggctgtactgcaccacttcgccacgttgccacaggccaatcagtccctcggcggtaagaccgggagtcatgcggtattcaccgctgtgcagtggctggccttcgagattgaagcgccagtacaggcgcagccagaaggcatcgtcgagcacaccgtcagcttccagacgattgaaggtgcccgtcggggtagcgccagccggtacgtcgagcaactgctcctgggacagcttcaagggctgcttgagggcagagtcgagtttccaggccgaaaagcccacgagcaacgccgccgagaccaggctgatctgcagcagtaacaccagttttcgtatcaactcaaatatccaatagcgcgcgaacaataccctgcagtttacgggtgagcggcccaaccggccagctcatcgcagcgcatccgcgcaccggccaaatgccatatacgctgttgcagacgaagacttcatcggcctgtcgcaactgctcgacactgacctcggccacgactaccgggatgcccagcgctttagcctgggccagcagctcggcgcgcatcacgccggccacgccacatcgactcaggtcagaggttagtaacaagccgttgcgcaccagaaacaagttgctgaacacgccttcgataacccgaccggacatatccagcatcaagccttcggcatgatcggcatcttgccattctgcgcgtgcgagcacttgctccagacgattgaggtgcttgagaccggccagcaacggctgttcggccaagcgggtcgcacacggaaacaggcggatgccttcgacaccatggccggggggataagtcgcgggcgcactgccctgcaagatacggcgcaccggagcgccagggttgagaccatagccgcgcaggctgtcgccacgggtaaggatcaacttgaggacaccgtcgccgagggcggcggcataggccagcacttcgctgcgaatcacactgtggtcggcaaccaatgccaaacgcctgcagccctcattcaggcgctgcaggtgacggtcgagcaacagcggctgcccggccttgacggcgatggtctcgaacaagccatcgccatacgccaggccgcgatctttcaggggcacggagtccgctggttgaccgtcgacccagctgtgcatcactcggcgaaccggcggaacaccagggacccgtttgtgccaccaaaaccgaacgagttggaaatcgccacgtcgatcggcatcggttgcgcttcgtgaggcacgaagttcaggtcgcagccttcgtcaggctcatccaggttgatggtcggcggggcgacctgatccttgattgccatcacgctgaagatcgcctccaccgcgcccgccgcgcccaacaggtggccggtcatggacttggtggaactgaccgccagcttgtaggcgtgctcgccgaacaccgacttgatggcctcggcttccgccaggtcgccggtcggcgtcgaagtaccatgggcgttgatgtactgaacctggttggggttgaccttcgcatcgcgcagggcgttggtgatgcagcgcgcagcaccggcaccgtcggacggtggcgaggtcatatggtaggcgtcgccgctcatgccaaagccgatcagctcggcgtagatggtggcaccacgcgccttggcgtgctccaactcttccagcaccagggcaccggcgccgtcggccagtacgaagccgtcacggcccttgtcccaaggacggctggcacgggtcggttcgtcattgcgggtcgacagcgcacgggaggcgccgaagccgcccatgcccaggccgcaggcggccatttcggcgccaccggcgatcatcacgtccgcttcgtcataggcgatgttgcgcgccgccatgccgatgcagtgagtgcccgtggtgcacgccgtcgaaatggcgtagttaggcccctgcgcccccaagtggatggacaggaagccggaaatcatattgatgatcgagcccggtacgaagaacggtgaaattcgacgagggccggattcgtgcagcgtgcggctggtttcttcgatattggtcaagccgccaatacccgagcccatggccacgccgatgcgctcacggttggcgtcggtgacttccaggccagcgttacgcactgcctgaaaaccggcggccaggccgtattgaatgaacaggtcgagcttgcgggattctttgaccgagaggtactcctcgacattgaagccctttaccgagccgccaaaacgggtggaataggcagaaaggtccgtgtgttcgatcagaccaataccactgtggccagccagaatgccctgccaactgcttggcacatccgtgcccagtggcgacaacatacccataccggtgactacgacgcgtctacgcgacacagcactctcctttttctaatgacgacacttcgcttcgcagcttgcttttcatcaccgcttaaagaaaaaaccgcacgccgttacagcagtgcggtttttccctgacagcaagcgacgactacaaactattacgcctggtggctagtaacgtagtcgatggcagcttgaacagtagtgattttttcagcttcttcgtccgggatttcggtctcgaattcctcttccagagccatcaccagctcaacggtgtcaagggaatcggcacccaggtcttctacgaaggaagcagtgttgaccacttcttcttccttaacgcccagttgctcggcgacgattttcttgacgcgctcttcgatggtgctcataccttgtttaactcctaatggacaaattcaggcagctggccagtgggtaagtgtatagaaagccatttcagcttttcaactgaaagcttcaccctgtaccccgccgaccatctgcctataaattaagttgcagctttataacggattttagacagctcgtatgacatttttttgaagcgatccgtcacaatttaactcatgtacatcccgccgttcaccgggattgtagccccagtcacgtatgccgcaccgtcggatgccaggaaagtgaccacattcgcgatctcttgggcctggcccagacggcccagcggaatctgcgtcagcaaggcttcacgctgtgcttccggcagttcgcgggtcatatcggtgtcgatgaaccctggggccaccgagttgaccgtaatcgaccgcgagccgacttcacgcgccagtgcacggctgaaaccttccaggccggccttggcggaggcatagtttacttggcctgcgttgcccatggcacccactacggagccaatattgataattcggccccaacgcgccttggtcatgccgcgcaaaacgcccttggacaggcgaaacagactgttcaggttggtatcgaccacgtcgtaccactcgtcgtctttcatgcgcatcatcaggttgtcacgggtgatgccggcgttgttaaccaaaattgccggcgcgccgaactgtgcggtgatctgggccaatacggcagccacggactcatcgctggtcacattcagctcaaggccggtgccctgcacgccattttccttcaaggtcgcggcgatacgctcggcgcccgatgcggaagtggcggtgccgatcacaacggcgccctgacggcccagttccagggcgatcgcctggccaatgccacggcttgcgccagtaaccagtgcaactttaccttgcagactcatgcaggcttctcctaatttcgcaattcaggccagtgccgcgcgggcggcagcgaaggcttcaggggtgttgaggttggcggtcgacacaccgtcggcgcaacgcttgttcaggcccgccaggaccttgcccgggccgcactcgaccagttcggtagcgccgttggcggccagggtctggaccgattcaacccagcgcactggcttgtagagttgctccagcaggtcgcgcttgagagtctcgaggtcgggtgcaaccgcggcactgacgttctgcaccaacgggatctgtggagcctgccagttgatggctgcgatggactcggcaaaacgctcggcagccgggcgcatcagttcacagtgggacggcacgctcaccggcaatggcagcgcacgcttggcaccacgggccttgcagccttcgatggcgcgctcaacagccgccttggcgccggcgatcaccacctggccaggggagttgaagttcaccgcgctgaccacttcaccttgcgccgcttcggcgcaggcctcgattaccaccgcatcgtccaggcccaggatcgcggccatgccgccctgcccggccggaacggcttcctgcatcaactggccacgacgctcgaccagcttgaccgcttcaccaagggtcaggctgcccgccgccaccagagcgctgtattcgcccaggctgtgcccggcaacaaatgccggacgcgccccgccttctgccagccacaagcgccacagggcgatcgaagcggtcaggatggccggctgggttttatcggtttgattgagctgctcttccggcccctgctgggtcagcgcccacaggtcgtaacccagggcgtcggaagcttccttgaaggtatccaggatcagcggatattgcgcgcccagctcggccaacatgccgagggactgcgaaccctgccctggaaagacgaatgcgagggatgtagacatgtaacaagcccctaatgatctggtcgtcggaaatagtcgctcccgatcttaaaatgaatgccgggagcacacgaaactgacagattggatggtcaattgaactggccggtcacatttaagcactcccgggccaattcgcctaaggcaacagatcctcaagacggccgtgcaagcgttgcggcaggttttcctggatctcgatcaaggcccgcgcaatcgcgctttggaagccctcgacacctgccgaaccatggcttttcaccacaatgccctgcaaccccaggaagctcgcgccattatgccgagccggcgccagatcagcctgcaggcggcgcatcaacggcagcgccaaggcacccaccatgcgcgacgccaggttgcgcttgaacaatgcctcgatacgcgaggcaatcatggtcgccaggccttcgctggacttgagcagtatgttgccgacaaaaccgtcacacaccaccacatcggcctcgccacggtacaagccgtcaccttcgacaaagccgatatagttcaagccccgcgcactttgcaataaggtggcggcaagcttgacctgctggttgcccttgatgtcctcggtcccgatattcagcaaggctacacgcggacgggcaacgcccagcgcttcggcggccaccgagcccatcacggcaaactgcaagaggtgctcggcactgcaatcgacattggcgcccaggtccagtagctggcaatagcctttctgcgtcgggatcgccgcgaccatcgccggccggtcaataccgggcaaggttttgagcacatgccgcgacaaggccatcaacgcccccgtattgccggcactgacacaggcttgcgccttgccatcacgcagcaactccagggccactcgcattgaagaatcgggtttgccgcgcagggcggccgccggcttttcatccatgctgatggcttcactggctggcgtaatcgtcaggcgcgcgcgatccaccgccggatggctggcaatcagttcttcaagaagggagggttgaccgacgagggtcaggtgcagcgagggcgttgcagtcaggctggcaatgcaggcctgaacaatgctgcggggaccgaagtccccgcccattgcgtcaatcgcgatgacttgagcagacaagtgattactcgtcagcgcccttgtcgatcactttacggccacggtatacgccttctggcgatacgtggtgacgcaggtgaacttcaccagtggtcttttccacggacagggtgctagcctcgagagcgtcgtgcgaacggcgcatgtcacgggcggagcgggattttttgttctgctgaacagccataattgattaactcctaaacgtttgggtcacgctttaactgcgccaatacactgaacgggttggaccgcgttacctcgtcctcgctcggctcggcctcgtcatcgagaccctccggctgctggcattcttccggatgatgagcaggcacaatgggcaaggcgagcaaaagctcctcctcgatcagtgcatgcagatccaatggatcttcgcccagttccagcacgtcataacctttcggcaacgactgggtattcgcaccctctttcaccacagcataactgcattcgctgtggatcggcagggtgaccagctcaagacaacgctggcaaaccattttgacttcggtgtcgataaagctgtgtattaccacagacttacgttcatctcgttcaaaaacgaatttagcctgcaccgtaccgacagtgtcggaaagcgggtcgcagagtctctccaaatcggccagcagcacttcaccttgaagggtggtgccacgatcagccaatttgcgcgggtcaacgtgaggtggaatcgggtcattcaacataggcgcagcattatagggatgcccccagccatgtcaaaggaaattcagccctgtgcgtcagccggtcacgtcgctagaatcggcgactgccttgaggagacgtatatgctgccgttattactcgcgtccagctcggtttatcgccgggaattactgagccgcctgcacctgccgttcacctgcggctcgccggatatcgacgaaagccaccgcacttatgaatcagccactgagctggtcaagcgcctggccgaacaaaaggcccgcgcccttgcggctagccatcctgggcatttgatcataggctccgatcaggtggcagcactggaaggccggatcatcggcaaaccccacacctttgaaaacgcccgcgagcaattgttggcggccagcggcaaacgggtgagctttcttaccgggttggcactgcttaacagtgagacggggcattgccaggtcgactgcgtaccttttaccgtgcacatgcgcgagctggatgcagagcgtattgagcgctacctgcggatcgagcaaccctacgactgcgcgggcagcttcaaggccgaggggctgggcgtgagcttgttccagggcaccgaaggaccggatgcgaccagccttgtcggcctgccgctgattcgactggtggatatgctgctcgccgagggcgtgcaaatcccttaaatacatcacggctaaatgtgggagagggcttgcccccgatagcagtggatcagccagcttatctttagctggcacaccgtcatcgggggcaagccccctcccacattgacctcacccgccttataaatcagcgcagcgtcgggccctggaagcccatataaagggcaagcttctcagccacactggcaccaagcttcttggagaagcgatcaaacggcgattcctcaaccgtgaaatccaccaactccttctcgccaaccacatcccgcgccaccgaactggcactgcccaggccatcgatcaaacccaatggcaacgcctgctcgcccgaccacaccagaccggaaaacagttccggatggtctttatccttcagtcggtccccacgaccctgcttcacgctggcaatgaactggcgatgggtagtatcgagcacgccctgccagaactgggtctcatcggccttttgcggctggaacggatccaggaacgccttgtgctcgccggaagtatagatgcgccgctccacccccagcttctccatggtgccgacaaacccgtaaccggctgccgtcaccccaatggagcccaccaggctggccttatcggcatagatctggtcagcggcactggcgatgtagtaggcccccgaggcgcccaggtcggaaattactgcatagagtttggtatccggatgcagtgcgcgcaggcgccgaatctcgtcatagacatagcccgactgcacagggctgccgcccgggctattgatgcgcaggatcacgcccttgaccttggagtcttcgaacgcggcgcgcaggctggtgacgatattgtcggcgctggcgggctccttgtcggcaatcactccgcgcacttcgatcaaggcagtgtagtgactgccacgggtggcgcttttttccatgtccatcagcggactgaacagcgccagcatgccgagcaggtaaacaaaggtcagcagcttgaagaaaatcccccagcgccgcgaacgacgctgttcctggacgctggccaggagggtcttctccagcagcttccagcttttatcatcactgttctcggccttttcgggcgctttccactcgtcactcatgccattaaccccagcaaaaactcattgggcccggctaagccaggcctgcaattcagaaaaatgatcaatcgtcagcctgggctcgtattgctgcaacgcctcgccagcctgggcaccatagctgaccgccacgctgtccatgccggcattgcgcgccatcatcaggtcgaaggacgcgtcacccaccatcaatgcctggcgcggcgatacaccgcaatgatccaggatctgctccagcatcagaggatgaggcttgctggcggtttcatccgcggcgcgggtgatgtcgaaataatcttcgaaaccatgggccttgagcacccgatccaagccacggcgagccttaccggtagcaacagccaggtgatagccctcggcgcgaaacgccgccaaggattgccttacgccgtcaaacagtggcgacggctcggtttccagagcgatgtagtgatcggcatagtgctgacggaacgcaaccagttcctggtcaccgatctgcgggtacagggtgcgaatagcctcaggcaaccccaggccgatgatgcctttaaccgccaggtcgctgcataactcatagcctgaacgggttgacgccatgtgcatcgactcgacaatccgaccaatggaatcgcacagcgtcccatcccaatcgaagatcagcagtttgtagtcagggtgcgacactcaaacgctccacggtcttggcccacatctcgtcgaccggcgcctgcaatttcagctcgccaccatcgggcagcggcacagtgagcatgtaggcgtgcaggaacagacgtttaccgcccagatcgcggatctccttggagaaaccctcatcaccgtacttggtgtcaccggcaatgcagtgccccgcgtgcagggtgtgcacgcgtatctggtgagtacgaccagtgaccggcttggcttcgaccatggtggcgaagtcgccgaagcggcgcagtaccttgaacagggtcagggcttctttgccctcctcgtccacctcgaccatacgctcaccggaacgcaggttgcttttctgcagtggcgcacgcacgctcttgatcgaactggcccagttaccacgcaccaacgccatataacgcttgtccacgccatcgccacgcaaggcagtgtgcagatggcgcaacatgctgcgcttcttggcaatcatcagcaggccggaggtatcacggtcaaggcgatggaccagttccagctccttggcatccgggcgcaactggcgaaaggcttcgatcacgccgaaattcaggccactgccgccgtgaaccgcaatgccgcagggcttgttgatcacgatcagtttgttgtcttcgaagacaatcgaggcttccaggcgctgcaacaggccctgggccaatggcacaggctcgtcgcgctcaggcacgcgcacaggcggcacgcgaacgatatcgcccgcctgcaacttgtactcaggcttgatccggcccttgttcacgcgcacttcgcctttacgcaaaatgcggtatatcaaggtcttgggcacgcctttgagccgggccaggagaaaattgtcgatgcgttggccggcatattccggcgagacctcaagcagctggacgctgggggtcgggggggtggtagtcgtcatgccggcgatgataacaattttttatggaattgaagcacttaatcattgctgctatagtcgcgaacgccgccaaaagcggcctggacagaggacatgcggcaaactgccggccctgaccatcgcaattcatcaggacgcgaggccgtcctacggggctttcgccaccttggaaggctcgggattgtaacaagcgcaggtgacatgaggcctgaagcgagtgcagaaagcagagtgaatactcgccttttgcgccgatatttacggccagttcacaaagtgcagtcagtcttgagccagaccatggcgaatgcttcggaaacaacgcctgttaagagctgagtgagagcgcagtcgcccacacctagtcttgtttagccatgagcgtggactccccattggagaacacggtaaatgccaacccgctgcggattctgcgcgcggcagcacccgaattatcagggatacgtgtagggtggagatgcacaaccgtcggactgtgtagcactaggcttatatttagacgcttcatctcgtccacagtcgccggttgattcctcctcctgaccttagcttttgttgaagtggtgcctttgtcaccaccgctaacgagcaggacgcgtccgtcgcgatagcggcccaattggccggttattgctggacactggagtggccaaccactcttgacgcacctgacaccgaccgtgagaagtcgtgtgtgccgaacgccgtttccggcagcccggaaaccgacggtacaacatgaaaagaatgctgattaacgcaactcaacccgaagagttgcgtgttgcactggtagatggccaacgcctctacgacctggacatcgaatccggtgcacgcgagcaaaagaaggccaacatctataaaggccgtattactcgcatcgaaccaagccttgaggctgcctttgtcgatttcggctccgagcgccacggcttcctgcccctcaaagaaatctcccgcgaatacttcaagaaagcccccgaaggccgcgtgaatatcaaggacgtcctgagcgaaggccaggaagtcatcgtccaggtcgagaaagaagaacgtggcaacaagggcgccgccctgaccaccttcatcagcctcgccggccgttacctcgtgctgatgccgaacaacccacgtgccggcggcatttcccgtcgcatcgaaggtgaagagcgcaatgaactgcgcgaagcgctgaacggcctggtcgcaccggccgacatgggcctgatcgttcgcactgcaggccttggccgcagcagcgaagaaatgcagtgggacctcgactacctgctgcaactgtggaccgccattaaagaagcgtccctggatcgttccgcgccattcctgatctaccaggaaagcaacgtgatcatccgcgccatccgcgactacctgcgccaggacatcggcgaagtgctgatcgacagcgttgaagcccaggacgaagccctgaccttcatccgccaggtgatgccgcagtacgccagcaagatcaagctgtacgaagacagcgtaccgctgttcaaccgtttccagatcgaaagccagatcgagaccgccttccagcgcgtggtcgaactgccttccggcggctccatcgtcatcgacccgaccgaagccctggtgtccatcgacatcaactcggcgcgcgccaccaaaggcagcgacatcgaagaaaccgccctgcagaccaacctggaagcggctgaagaaatcgcccgccagctgcgcctgcgtgatatcggcggcctgatcgtgatcgacttcatcgacatgacccccgccaagaaccagcgcgccgtggaagagaaagtccgcgaatgcctggaagctgaccgtgctcgcgtgcaagtcggccgcatctcgcgcttcggcctgctggaaatgtcccgccagcgcctgcgtccatccctgggcgagagcagcggcatcgtctgcccgcgttgcaacggcaccggcatcatccgtgacgttgaatcgctgtccctggcgatcctgcgcctgatcgaagaagaagccctgaaagaccgcaccgccgaggtccgcgcgcaagtgccgattccggttgccgccttcctgcttaacgaaaaacgcaactcgatcaccaagatcgaactgcgcacccgtgcccgtatcgtcatcctgccgaacgatcacctcgagacgccgcacttcgaagtccagcgcctgcgtgatgacagcccggaagcccatagcggccagtccagctatgaaatcgctgctgccgctgccgaagtggaagaagtccagccagccgctgcgacccgcaccctggtccgccaggaagccgccgtgaagaccgcgccggcccgtgccaacgcaccgatgcctaccgaagccgctgctccggttgccgccccggccgccctgcctgagccaagcctgttcaagggcctggtgaaatcgctggtcagcctgttcgccaccaaggaagagcctgctgccccggtagtggtcgaaaagcctgccaccgagcgcccggcgcgcaacgaagaacgtcgcaacggtcgccagcagagccgtaaccgcaacggtcgccgtgacgaagagcgcaagcctcgcgaagatcgtgcaccgcgtgaagaacgcgcgccacgtgaagagcgtgcacctcgcgaagcccgcgaagcccgcgaagacaccccgaccgtcgcccgtgaagaacgtgcaccgcgtgaagagcgcgcaccacgtaccccacgtgccccgcgtgaagatcgcaagccgcgtggcgagcgcgaagagcgcgtgcgtgaactgcgtgagccgctggacgccgcgccagccgttgctgctgccgctgctgccagcaccgaagaacgcccggcgcgccagccgcgtgaagagcgtgccccacgtgaagagcgccagccgcgcccaccgcgtgaggagcgtcaaccacgcgctgagcaagccgctgccgccagcgaagaagaagtactgaccggcgaagagcaactgcaggaagacggccaggacaacgccgaaggcgatcgtccacgccgccgctcccgtggccagcgtcgtcgcagcaaccgtcgtgagcgtcagcgtgacgccaacggcaacgtgatcgaaggttcggaagaaaccggtgaaaacgcagaagctgccaacaacgaaccaacaggcgccgaactggctgctggcttggccgttaccgcggccgtcgccagctcggtcatcagcgcacctgcgcaagcccaggcccacgagcaagccgagcgtgctactgccgctgtcgaagaaaacgctgtggtagaaacgctagctgccgagaccccagaggttcaagcgccagctgttgaagcgccagtggtcgaagccactacccctgtcgaaaccccagtggttccggaggtggaagttgccccggttcgcgacgcacagccagaaaccgaagtggttgccgttgaaccggctccggtggttgagcctgcaccagtggttgaagccgcagcagaagcaccggttgtcgaagaagccgccccggccgtgcgtgaagttcgcgaagaacagactgccttccagtggactgccgaacctaccgccccggttgaagcgccagcgcctgcccctgtgattgaggaagcgccagccccggctgccgaagtggttgaagccgcaccggttccagagcctgcgccggtggttgaagcccctgtggttgccgaagtggctgctccggtggttgaagccgcacctgccagcgctctgaccgagaacggtcgtgcgccgaatgacccacgtgaagtgcgtcgtcgtcgcaaggaagctgaggccgctgctgctgcggcagccgctgcaccggctgtggtcgaagccgctccggctccggttgctgaaaccgtggtagagcacgtggcccaggaagaagagcacgagcctaaacctctcgcctgattctgccagccactaaaaagccccgcctgagtgatcaggcggggctttttttgcaaaaaattcgaacatactactgctcaaatttgggggcttgccccctcccacattcagtcggcgctgaaactcaaccgttgcggcacgtccacatcccatagcaccccaggatcatccacctgcacgccccgcacctgtgcttgtgcaaacaaaggcttagcgccacggtccccggtcaacgccatcaacgcaggcccaaatacacgaccgaaagccaccggatgcccatactgcccggcatgcaccggcacagtgatacttcccggatcggccagcacgcgctcgatcgtcgcggatcgaataaacggcatatcacccagcacaactagccagccatccaccgaggcgctggccgcaacggctgcggcaatgctgtcacccataccagccgattccagcagcaggaccttgcaaccgtacgcctcagctaaatgaatcacctcaaggcgctccggtgaggtcaccacccagcgctcaacaagcgtcgcgggcaggttaaccagcacctgctcgatcaccggtcgggaaacgccatccaggcccacgcaaacggccagcaacttgtcctgatcagcaccggcttcggcgcgaaaacgactgccctgccctgcggccagcacgatcgccgtgacagtcactgcgccaccaccgccaagggttttttctgcaccggtgccacgccgttcttgattgcgacaatttccgccatcaacgacaaagcgatctccgccggggtatggctaccgatatgcaagccaatcggcccgtgcaaacgtgcaatggcgtcctccgacaagcccagggctgcgagattctctcgacgcttctgggtattgacccgcgaccccagcgcgccgatgtagaacgcggtggagtccagcgctgtcagcaatgccatgtcatccaaacgcggatcgtgggtcaggcagacgatagcggtgcgttcatcggtttggatattcagcaccgcctcgtcgggcatgcctggcacaaagcgaccgtgctgttcttcccagccatagacgaattcttcacgggggtcgcagatcagcacttcgaaatccagcaagcgcgccatttgcgcgacgtagcgtgacaactgcccggcgccgatcaacaacaggcgccaacgcggcccataaatggcacgcagacgctcgccgtcgaagctcaccacatcggtcttgctcgcggcgctcagggctaccgcgcccgtggtcaggtccaattcacgcgcgacgacctggtggtcttcgcagcgcgccagcagttcggccacccagccccagtcatccacccgctcttcagtcaggcgcagcgtaccgccgcacggcaagccaaagcgcgccgcttcatcgcgggtgacgccgtaggtgaccaattggacgggcggcccatcatcagccagccgcccgtcctgcaggcgggcgatcaagtcatcttcgatgcagccaccggacaccgagccaatcaccaccccgtcgccgcgcaaggccagcatcgccccaggagggcgcggcgcgctgccccaggtctgcaccacgctgtacaacactacgcgctgcccggcgcggcgccactcaaggacgctacgcaggacattcaaatccacactgtccatcaaacctcctgccagcgttgttaatgaaatcgtcatttactgtaaagcaaaagaatccagaagtggccgtacacacacgcaaacgccccgaaccagtcggggcgtttgcgggttgccttggcgtcagatcacgccagcagcgatttacttgatgacaggcgccgggccttcggccacacccaggtcatcttcttcgcgggtgtcggaaatacctgtaccgccggacgccagctcactttgcagcttgtcggtgtccagctccttgacccacttggccacaacgatggtggcaacggcgttacccaccaggttggtcagcgcacgggcttcggacatgaagcggtcgatacccaggatcagcgccaggccggccaccggcaagtggcctacggccgacagggtcgctgccagtacaatgaaaccactgccggtcacgcccgccgcgcctttggaagacagcagcagcaccagcagcagggtgatctggtgggtgatgtccatgtgggtgtcggtcgcctgggcgatgaacacggcagccatggtcaggtagatcgacgtaccgtcgaggttgaaggagtagccggttgggatcaccaagccgaccaccgacttcttcgcacccaggcgctccatcttgatcagcatgcgtggcaatgcggattcggaagacgaggtacccagtacgatcagcagttcttcacggatgtagcggatcagcttcaatacgctgaaaccgtgggcgcggcagatggcgccaagtaccacgaccacgaacaggacgcaggtgatatagaagcagatcatcagctggcccaactgcaccagagaacccacaccgtaggcgccgatggtgaatgccatggcacccagggcaccgatcggagcgagcttcatgatcatgttgatgatgttgaacatcacgtgggcgaagcgatcgatgaagtccagcaccggcttgccgtaggcgcccaggcggtgcagggcgaaaccgaagatcaccgagaacatcagcacttggaggatatcgccgttggcgaaggcgccgacgatggtgttcgggatgacgttcaggataaagccgacaatgctctggtctttaccggcggtaacgtaggccgccactttggaggcgtccagggtcgctacatcgatgtgcatgcccgcacccggttgcacgacgttgaccacgaccaggccgatcagcagggcgatggtggagacgatttcgaagtacagcagtgcatagccaccggtcttgcccaccgacttcatgctttgcataccagcgatgccgctgaccacggtgcagaagatgatcggggcgatgaccattttgatcagcttgataaagccgtcacccagtggcttgagggccacgccggtctgcgggtagaagtggccgagcagaataccgataacgattgcgacgatcacctggaaatacagggatttgtagattggctgacgagtcgtcattgcaaagttcctcaaacgtcccgggggcaaatatccgccattgcccacgacacttgaattgcgaaccctcctgcactggagggatttgttgttggcgaagcctgtaggacaaagcctgcgctgtagtccttatcgcaaacggcgtgccactttgcgcaaatccgctgaaggcctttagacatctgggccaggcgggttacttccgcccctgagcactcgatcatgtggcggatttccgcccacctagccggtctcgtcctacaatttggcggatatccgccttgtcgctcgaccgggtcatggctaccatccgccactccacggacgaggcccttgcatgcgcgaacgtaccatcgccagtcactacgcccgagcagccctcggcggtgcgcgtcgagccggttacgactactcggtgttgttgcagcaggtgggcatcacccctgaactgctgagcgagcctcgcgcccgcattgcaccggagcaattcacccggctgctgcaaatgctctggctggagctggatgacgagtacctggggtttgccgatgggccgagcaaacgcggcaccttcgccatgatgtgccacgccctgatccattgccgcacgctggagaaggctctggagcgcggcttattgttttatagcctcttcccgcagggcccgcgctggcagctgacgaaagaaggcgatatggcgcgactgagcctggacgactcacagctatgggacccggatcactttctcagtgagtgcctgctggtgatctggcatcgcctgggcagttggttgatcggccagcgaatccgtctgcagcaggcaaccttcagttaccccacgccggcccatgccagtgaatacgacctgttgttcccctgccctcacatgttcgacgcgccgaacagcagcctggtatttcccagccgctacctgagcctgcccctgttgcaggatgaacgcaccctcaagcatttcttgcagcgctcgcctgccgacttattgtcccgaccggatgaaggcgacagcctgagcagccagttgcgccgcttgctgagtcgcgatcgtacgccctggccggacttggaggccgtcgcccagcatttgcacatcagcccgcagaccctgcgccggcaccttcgcgaagaaggcaccagctttcaggcattgaaggatgagttacgccgggatattgccatctaccatttggggcgggcggatttgtccttgcaggagattgccgagcatttggggttttctgagccgtcggcgtttcatcgggcattcaagaagtggacggggctgacaccgggggcgtatcgcgcgcaggggagttaaacggaggtggacttggctcagcacgggtatctacacaacttttggtatgccccctcccacatttggatcgcagggcatcagtcagatagcggtcgactgtctggccaccatcgcgtaagcccagtcgatagacatcacaacgccggaaaatggatcctgaaagccgcgccgcctagtgccgagtcccctagcgtcaaacgcgcgttgtagctctcgataatgtccttgaccaccgccagcccgatgccctgccccgggtgctggcgatcaagccgctcgccgcgctgcagaatccgtgcgcgctggtcgggcggcacaccggggccgtcgtcttcgatacacaactcaataccgtcaaggttttccaccaggctgatacgcacctgacgcaggcataggcgataggcgttttccagcaagttgccgagcatttcgagcagggcgcctttctcgatgggcacgtcacactcttgcggcaggtcaaaggagacgttgacgcgcttgtcgcggtagaccttttccaaggtatcgcacagactttgcaacaccggctccaaacgcacctggtggcgcaccaggccgcttttacgcaggctggcacgctgcaattgatagcctatctgctggctcatgcgctcgatctgcgattgcagcacccacgcctggccacggtcttcgtggcgctgagccatgtcctcactcactccctgcaagaccgccagcggggttttcaggctatgggccaggtcatccagggaatcgcggtagcgggtgcgttgctcgcgttcactgtgcagcaatcggttgagggagccggtaagtcgcagcagttcgcgggggtgttcttcggaaaggctctcacgggtgccaccttcgatctggtcaagctcctggctcaagcgtcgcagggcttgcaagccccaggtcaggcccagccacaacagcgtcaacagcacgagcaaggcggcgccgaagcccaggtagaggttctcgcgcaagccttcgagggtcagttgatattcacgcaccggttgcagggcgacgatactgaacgccgcactcttgccccccagcagcttgacctcgacgtcatacacgaaaaattcctggccattagcttcgcggatgcgcgcaaactcgttgccgcgcccatcgtagcgcggcttgtagttgatgttttcttcccgggtcgcccgcgaacgccataccaagtggccctcgcggtcgtaaatatagccaagcagccggctgtcggtgaggttgaagcgttcatccggcagctgcgccggcatcagcaggcgattattttcgacccgcgcggcggagatcagggtggtcacgtccgacgccaggcgctgctcgatggaatcctgcagggccaggctgaacgcgccttgcatggcgggcaacaagccgagcatgaacagcacggccagggtggcggccgccagcatcaggcgcacacgtagtgagcgaatcaacggcagcgctcattgaacaggtaacccaggccgcgcacagtatcgatcggcttgaacccggtcggtccttccagcttgcggcgcaggcggccgaccagcacttcgatgacgttcgggtcgcgttcgtcgtcatcggggtagagctgctccatcaaacgatccttggccaccacttgttgatggtgacgcatcaggtattcgaggattcgatactcataagcggtcaacgccagcggctgttcatccaaggaggcttgcttgcgattgaggtccagcaacaagggcccggcaatgatggtggactgggtaaaaccgctggagcggcgtaacaaggcgttcatccgcgcctccagctcttcgaactgaaacggcttgaccacatagtcgtcggcaccggccgccaggccttcgactttatcctgccagttgccgcgggcagtcaggatcaggatcggaaaggtcttggcctgggtgcgcagttggcgaatcaggtccaggccgcccatgccgggcaggccaaggtcgatgatcgccaggtcatgattgaattggcctgtctggtacagggcttcctcggcattggccacggcttcgaccacatgcccgctgtcggtcaggcgggtaaacaggtgatggcgcagcagcgcctcatcttccaccaccagcaatttcataaggctctccaaggcaattcaactatccgaccgagggatatcatagcggccctgcacgtcttgcgggcgcagtttaatgccattgtaatggcccgtcaggtgcgggtagccgctgcgatagtcgggttgcgcggcgctagcgcccagggcccgcccccacggcgcggtctgggtgccggcgtcttcgaagctgacacgatggatcgggctgccggatttcttggttttctcgctgccaaatgccctaaagtcgccatccgaggcttgcacgccggcggtggcgccgagcatggttaacgccaacatcagcttcttgatcgcagtcatggtggttacctcatacgcgtttaggctgtggggtccagactacgcaagcgcccctgaactccccctgaacaggctctgaaccacaactgaaccgctgccgggctatccactggcgcgccaactcggcaaaatgctgcgcatgacgcccctacccgcttgctgtaccccactcgatgcccgttggccgctgcctgcccccttgccgggtacggtgtttttgagcacgcgattcgacccggccttattgaaccccttggatttccagcgtagcgccgtgccgccgccggcgagcatccagcgctcggtggccaagcggcaagcggagtttctcgccggccgcctgtgcgcccgcgaagcgctgcaacgactcgataacctcaactgcatcccggcgatcggtgaagaccgcgcaccggtctggcctgggcatatcagtggctccatcacccacagcaccgggcacgcggcagccattgtcggccacaagacgcagtggcgcgggctggggatggacctggagaacctgctggccctggaacgggcggaacgcctggctggggagattctgacggccgatgagttgcagcgcatggcggcactaccgcgtgagcagctcgggctgctggtgacgttgacgttttcggtcaaggagagtctgttcaaggcgctctatccgatcgtgcaaaagcgtttttactttgaacatgccgaggtattggagtggtcgcaggctgggcacgtgcggctgcggttgctgacggacctgtcgagtgagtggtgttgtggcaaggagttggaggggcaatttgtgctggagggggaacagttgttgagcctggtggccgtcggcgcttgataggacgctatcggggtttctcttgatcccggggccaactcaggctgaaacatgccccgcccagattgttacttttgctgatcaacgcccgcccgccgtgccaatagatgatccgccgcacaatcgacaggcccaggccgtggccgccagacgctcgggtgcggctgtcgtccaggcgcaggaatggcgtaaatatccgctcccaggcactttccggcacgcctgggccatcgtcttccacgtcaatgcggcagcgcacctggcctacctggtaactgatcagcacgtggcccttggcgtggcgcatggcgttactcaccaggttctgcagggcacggtgcaggtagcgtggttcggcgtcgacccaggcgtcatcccaatgcgccgatgacaggcaaataccgcgggtaacggcgacctgcgggcgcagtggcgacaattcgccgatcacctggtcgagcaaggcatcgaggtccacccgctggaaattcagctccggcgccccttgctccaggcgcgcataggtgagcatctcatccaccaggccatcgaggtcctggatatcgccgtccatgccttccaggtatttgcgccgagcctcgggggtggcggcatcaccgatcatctccaggccaaaccgcaggcgcgccaccggtgtgcgtaactcatgggacaccgcacgcaccagctcgcgctgaatcgccagcaattgttgcaagtgctcggccatgccattgaatgcggccgcaaggcgcccgaccgaatcagctcctcgggccggcacgcggacctccaggttgcccttggcgatgcgtgtagctgccgcttccaggcctttgagccggcgctcaagctgacgcaccagcaaataaacgatcaagccgatcagggtcaggccgatcaaggtgatcagaatcagccattgcgccgggtaagggttcatttgatacagcgggccgatctccagcacccatggtgtgccaaccatgccggcaaacacgcggatcgaatcgccgcccttgcccagggccatcaccgtatcgccttccgctacgcgccggcgctggtcgtcgtccatgtcggcctggtcaagggccaccaagtgcatttcaaaaccaaagcccttggcttgctttatatcggccaggcgctgcggctgctcggcgactggaaagcgcaccagttcgtcggccagcaggtaaatggtcgcacgggccaattgctcgctgatctgctgcacttcgccggtgagcaccaactgctcctgttcgctgaccaatcgcagcacccgcgccgcatgggggccggtctgttccaccaagacctggccacgttgcaggcgattgcgctgacccaggtccagttgcgcctgggtgaacgtgcgcagttccagcggaatgcccagcaagcgctcccacaccgccaaggcgcgcagccgctcaatggcactcatgggttgcaggttatcgcccatcaacgcaaaggtgccgtgggccaggcgctcgcggtactggccgctgcgcacatcgttgagcaggtgcaacgccagggcaccgagcagcgccaccaggatcagcgccgcgcacatgccgccgtagatgcgcaggaagatcgagttcacaacggcatatcggcggcggcttcggggacgaacaggtagcctttgctgcggatcgtcttgatcaggcgcggatgaatcggatcgtcgccgatcttcggccgaatgcgcgagatgcgcacatcaatggagcgatcctggccgtcgtagccgatgccgcgcagggcgataaagatttcctcgcgggacaggatgcgcccggcgttcgccaccaacagccacaacaggtcgaactcggcgctggtcagttcgataccgccatcgtgcaaccaggcctcgcgcaaggcgttgtccaccaccaaggggccgaactgcaggcggcgctggttttccactatggcaggtaacgccgactcgctgcggcgcagcaatgcctggatacgcgccagtaacaaacgtgggcgcacgggtttgcatacatagtcgtctgcacccatgtccaggcccagtacctggtccatatcgtcggtgcgcgcagtgagcatcaggattacaccgtcatagccctcgcgcaccttgcggcagatgctcaggccatcttcgccgggcagcatcaggtcgaggatcaccaggtctggttgttcggcgatgatgcgcgccgccgcctgtgcgccgtcgctttccaccgacacacacaggccgttactttccaggtattcgcgggtcaactcggcgagtcgctcgtcgtcctcgacgatcaatatctgccaggcttcttgctccatgcgctacctcggttctttattgtaggagcgagcttgctcgcgaagaacgcaagggcaccgcgcttatccaagtgtgctgcattatcgttgacgattttcgcgagcaagctcgctcctatagttgtcatgaggagcaagcatgctatcgccctgatcaaggccgattgtagccatggctcgccccttaaaaacaagcctggaaatccattcggagatcacgtttgtttgtgatagggttcgcgcccttcgaaaatgggcaggccgtttcaagcccgaaatatttaatgacaaacggcgtaatccagcagcaatgcggcctacacgcctattcgacctttcttacacattttactcacagcgttatccacaggttactccgttgctaacccctcgaaaacgcattatcttgtacctcggcgctcatgaagaccctacatgtagggttttcgacaccagcgtccaaccacacaagtggctcgaaactcaagcgttttattgctagcgcagcgttgaaccaacagatttttcagtagaccaaaccgctcacgcggatggcagctgttctccatccccgacatggaaaacggtacgggtgttgcaggaaaaagcctggcactcgcaatcaaatatagaacgtggagacaaccccccatgcaaaccgacacaactcgcgagaacccgcagggctccgtgccgcaggccgctgattcgaacctggatctgtccgccactgcacctggccaactgcgcgtgatcaagcgtaacggcactgtcgttccttataccgatgacaaaatcaccgtcgccatcaccaaagcgtttcttgcagttgaaggcggcaccgctgctgcctcgtcgcgcatccacgacacggttgcccgcctgaccgaacaggtcaccgcaaccttcaagcgtcgcatgccatcgggcggcactatccatatcgaagaaatccaggaccaggtcgaactggccctgatgcgtgccggcgagcagaaagtcgcacgcgactacgtgatctaccgtgattcgcgcgccaaggaacgtgccgtgcgttccccggctgaagaagctgccgtgcaagcgcacccgtcgatccgcatcaccctggccgacggcagctttgcgccgctggacctgggccgcctgaacaccatcatcaccgaagcctgcgaaggcctggaagaagtcgatggtgacctgatccagcgcgaaaccctgaagaacctgtacgacggcgtggccctgaccgacgtcaacaccgccctggtgatgaccgcccgtaccctggttgaacgcgagccgaactactcgttcgtgaccgcgcgcctgctgatggacactctgcgtgccgaaggcctgggcttcctgggcgtggccgacagcgctacccaccacgagatggccgacctgtacgccaaggccctgcccgcctacatcgccaagggtatcgagttcgaattgctcaacccggtgctggccaccttcgacctagaaaaactcggcaaggcaatcaaccacgaacgtgaccagcagttcacctacctgggcctgcaaaccctgtacgaccgttacttcatccacaaggacggtatccgcttcgaactgccgcaagtattcttcatgcgcgtggccatgggcctggcaattgaagagaagcagaaagaagaccgcgccatcgagttctacaacctgctgtcgtccttcgactacatgtcgtcgaccccgaccctgttcaacgccggcaccctgcgtccacagctgtcgagctgctacctgaccaccgtgccggatgatctgtcgggcatctaccacgcgatccatgacaacgccatgctgtccaaattcgctggcggcctgggtaacgactggacgccggtgcgtgccttgggctcgtacatcaagggcaccaacggcaagtcccagggcgtcgtccccttcctgaaagtggtgaacgataccgccgtcgccgtgaaccagggtggcaagcgcaaaggcgctgtgtgtgcctacctggaaacctggcacatggacattgaagagttcatcgagctgcgcaagaacaccggtgatgaccgtcgtcgtacccacgacatgaacaccgccaactggatccctgacctgttcatgaagcgtgtcttcgatgacggcaagtggaccctgttctcgccatccgaagtaccagacctgcacgacctgaccggcaaggccttcgaggagcgctacgagtactacgaagccctcaccgagtacccaggcaaggtcaagctgttcaagaccatccaggccaaagacctgtggcgcaaaatgctgtccatgctgtttgaaaccggccacccatggctgaccttcaaggacccatgcaacctgcgcagcccgcagcagcacgtgggcgtggtccacagttcgaacctgtgcaccgagatcaccttgaacaccaacaaggacgagatcgccgtttgcaacctgggctcgatcaacctgccgaaccacatcgtcaacggccagctcgacaccgccaagctgcaacgcaccgtcaacaccgcagtacgcatgctcgataacgtcatcgacatcaactactactcggtgccacaggcgcagaactccaacttcaagcatcgtccagtgggcctgggcatcatgggcttccaggacgcgctgtacctgcagcacattccttacggttcggatgctgcggtcgagttcgccgacaagtccatggaagcggtcagctactacgcgatccaggcttcctgcgacctggccgacgaacgcggcgcctacgagacgttccagggttcgctgtggtccaagggcatcctgccgctggattcgcaacagatcctgatcgaacagcgtggccagaagtacatcgatgtcgacctgaacgaaaccctggactgggcaccggtacgtgcccgtgtacagaaaggtattcgtaactccaacatcatggccatcgcaccgaccgctaccatcgccaacatcaccggcgtgtcgcagtcgatcgaaccgacctaccagaacctgtatgtaaaatcgaacctgtcgggcgaattcaccgtgatcaacccgtacctggtccgcgacctgaaagcccgcggcctgtgggactcggtcatgatcaacgacctgaagtactacgacggttcggtgcagcagatcgagcgcatcccgcaagaactcaaagagctctacgcgaccgcgttcgaagtggacaccaagtggatcgttgacgccgccagtcgtcgtcagaagtggatcgaccaggcccagtccctgaacctctacatcgctggcgcatcgggcaagaagctggacgtgacctaccgcatggcttggtaccgtggcctgaaaaccacttactacctccgtgccctggccgcgaccagcaccgagaagtcgaccatcaacaccggtaagctcaatgctgtttccagcggcaaccacggtgatgattcggtactcgcagcccccgccggcccggcaccagtgccaaaggcctgcgcgattgacgagccggattgcgaagcttgccaataagctgaaccgatccagggcttgaacgccctggatttaaaaagcccgatgaaccccgactgcacagggtttatcgggctttttcgtttatcacgcctagaggaacgcgtacgcaataccctgcttcggcgcgccacctcgccgcccccatagctcaactttaccgtcgatgaccgccattgaatggcgatcataggccacgacgcccagcttgccgctcgccagttcgctactcgaggattgcctgtagagccctttcaagccaaggcgatccaaagcttcgtggggcatttcgccgttgttcaggctttgcatcgcgtgggcaaagctctttttcgattcgttcgggttgtcgtccaggccattgccctccatctgcgcacgcttggcgctcgccgcaaacatgaagttagcatcagtcaacatctgcggattatcgcccttgaactgcgcatacctggctgcctgcttcaactcatccttggataaatcaagtttgaacccatcgcgcatggtcacctgatagccattcgccgtttcttttacctctttgaaaacgtcagtaggcttctgaccaaacttcatcattgcgcccttaatcgctgaaacggtgacgcaattgccgtccggcccctggctgaatccactccagatattgtctggttttttacctgggctactttcatcgggcttgtagttgaagtgcttggagccttcggtaatcggcagattactcatgggctcgctggggccgaaattgttcgggcttggcgtaccgcctccaccacctcctccacctcttggcgatgggccaggggaaggcggtgagggcgttggcgacgtatcatccagctccgggaaccacatcctcatcatacgccgcagataatccaaccaggagacgtcagccttctccatcaactccttcatgatctctttgaatttttcgtctccgagctcttcgcgcttatcgttcagcttgtcgcgaagctcttgagcggtctggctcttggaggttttttcggcatccatcaattcgctgagcagttgcctgactgactcagtattggcagccctgtcgtcattgaacccgtacgccggactttgccgcccgtacacaccctcatagatactcgcgtcaaaaccacgcgctccccgcgcgccactctcccacagtgcataacccgccatttacttcccctatagtcgccggacgacaaccgtccgctggctgatccgtggccaaatcggcgttacgcgttcccgcatcggggcgtggtgaaacgagcagtaaataactatgtagcgcacacaaaaaaaggcccctcgatcgaggggcctttgattgaacgctggtacttgagcgacggtatcaggtcatctgaatgatggtctgcataatggtgctctgggtggagatggtcttggcgttcgcctggtagttgctctgggccttgatcaggtccaccagctcgttggtcaggttgacgttggaggcttccagagaggagcccttgatcgaacccagggtgccagattccggcgcgtcgtaacccggctggcccgatgcaaaggtctctttccaagccgtaccgccagccggctgcaggccttgctcgttgttgaagctggccagggaaatctggccgatggccttgctctgctggttgctgaaggtcgcgaacaatacaccgctgccgtcgattttcaggccggtgatctggccagtggcataaccgtcagtgaccggcggattgcggtagctggccgagttgtactgagtgacgttgcccatgttgatagcaatgccgtccttgttcgctgtcgcatcgttaggcttccaaacaccatcggtgactgtgccaggtacccaatccttgatggtcaaggtgttgccggcgacaccaccggtcacgatgctcttgagattaccggcaccatcgaaactcagagtcgagggcacaggcgccttcacgtcagcaccagtaccggtaggcgccgaaccatcagggttgcggccatcgatcaaggtgtaggactgccactggttggcatcggttttcaccaggtactgcaccatagggtgggcgttaccctgagcgtcgtacaacgtagtgccgtattgcgtggtgaatgtttcggacttgctcggatcaaacggattcttggtctggtcgatcaccggcgacgaggagttgaggttgctggccgaatccaccttggtggacgccttcggtggcaagttcgccaggttcagttgcaggtcgaccaggccacccttggtgatcttgccattctcgtccgccgcgtaaccctgcagacgcgaagtgccggtgttgttggtgatgtagccgtccttgtccgcacggaaagcaccgctacgggtgtattccagcgagccgtcgctacccttctgcacgaagaaaccaccaccctggatcgccatgtcgaggatgccgccaccgccgttcacgtcgccctgggtgaactgctgggacaccgccgccaggtttacaccgttgccgatagtattctggccagtacccagtttggaggccgcgtagatatcggcgaattccgcacgggatgacttgaagccagtggtcgcgacgttggcgatgttgttgccggtcacgtccagttgtttgttggccgcatagaggccgctaaggccgatattaaaagacatgttctctccctctgccgtatctagccggctctatgtaccgatagtctgaatttgcgacagcttgacgctgcccatgccgcctgcaaggttgagcagcatttcgccgccggtcttgctcagggtcacgctggttaccgtggccggcagtgaggtggccagggccaccgcatcacccttgtcgttcttggtagaggcattgaaggtgtaggtgccggctggggcgacttcgcccttctcattcttgccatcccagataaagctctggctgccggcactctgcgcgcccatatccacggtgcgcacaacgttgccgtccttatcggtgatcttgacggaaacgttgcccaccgccgatggcacttccaccgaaccgttcatgctcttgctggtatcaaccatggctttgtcggtctggataatgatcgaccgccccaccagcgacgaagcctgcagcgcttgcgaggagctgaagttgctggagatgttattcaccgagtcgttcagggtgttgatgccttcaaggctgctgaactgcgcaagctgggccacgaacgcgccgttgtcctggggcgacagcgggttctggtttttcagctgggtgaccagcaactgcaggaatgcatccttgcccagcgactggttgccggtcgcggctttggaaacattcgctacattgttcgaagcatccttgaccttggaattgaacaggtcttggactgccgtgttgttagacgtatcaacgatggccattatttggcgccccttatcactgacccagggtcaagaccttctgcatcatggctttggcggtgttcatcatttccgcgttggtctggaacgagcggcttgcggaaatcatgtcggccatctcctcgaccacgttgacgttggggtagtagacgtaacccttttcgttcgcagcgggatggttcggctcgtaacgggcctcaaggttgctctggtcttcgactacacccagcacctgcacaccggagccggctgcgtcctgatcctggaacaacgaatcactgccgccgctctgaccagcctggaacatggtggcaaacaccgggtgacgggcgcggtaagtctggtcaatgctcgaagacacggtctcggcgttggcgatgttactggcgacggtgttcaagcgcgtggtttgcgcgctcatgccactgccggcaatattgaaaacactggacagagacatggcttactctccacgcagggctgacatcagccctttgaatttactattgagcagggtgaagctggcctggaagttcaccgagttctcggcgtaattcgattgctccagttgggcgtcgacggtgttctggtcgatcgacggctgcatcggcgtgcgatacagcagcgactcgtcagcattgcccaggccctgcgcttcgatatgacggttgttggtcatgttcaaggcgaaggtgccgttcttggtcttgtcctgctgggcggcgagcacggcggagaagtccaggtcccgagccttgtagttcggggtatcggcgttggcaatgttgttggccaggacttcggcacgctgggcgcggaagcccagggcttgttcgtggataccgagcgctttatcgaagctgatgctcatggcggagacctttaggctgacctgctgttcgttagcagggttgtagcaaggtgcatgccaatcttgttaagccccctatatcaagggctttcggggagattgccggcggctatgccagaaaagcggcaagtgttttccgcgtggcgccagtaaagcggcaatgggcattgccacttttatttatcttgccgcaatacaaagatgggagggggcttgcccccgatggcggtggttcagttgataaatctatcactgacacactgctatcgggagcaagccccctcccacactcccacattgacttacttggcctggtagatgattcccgggctgcactgcaccatctggaaatggtccggcaggccgttcaaggcttcggaagcaccgaggaacagatacccgccgcgcttgagcgtgccgtggatgcgcaagaggatgtctttctttacttcggccgagaaatagatcagcacgttacgacagaacaccatgtcgaacttgcccaggctggcataactgtcgagcaggttgaacgagcggaattccacgcggttcttgatcggtgccttgatcgcccagcgccccgcccctttcggatcgaagtaacgctgcaggcgctcctgggacaggccgcggcccagcgccaggctgtcgtactcaccggtcttgcagttggtgagcatggtgccggacaggtccgtggcgacaatttgcgcgccggctttcaactggcccatattggtccgttcgaactcgtcgatggacatcgagatcgagtacggttcctgccccgaagagcacgccgccgaccagatacgcaagcgctggcccgggctggccttgatcgcctccggcagcactttgttcttgagcacttcaaaggggtaagtatcgcgaaaccataaggtttcgttggtggtcatggcatcgaccaccatctccttgagcccgctgcgcggctgcgcctggatccgctggaccaactcacccagggacttgatgccctgctgttccatcagcttgttgagacggctggataccaggtattgcttgttttcaccgagcaatatgccacaggctttttccaggaagacccggaactgttcgaaatccaaattacccgtagacaatggtaccgcctcttaaatcgtgtgaccgccaggggagaatccctcagctgtgatctgctgccttgatccggtcgactacccgggatgcgaggtcatcaggacggaatttggccaggaagtcatcagcaccgaccttcttgaccattgcctgattgaatacccccgacaacgaagtatgcaggatgatatgcaatttttgcatgcgtggatcgttgcgtatctcggccgtaagggtgtatccgtccatttccggcatctcgatgtcggaaatcatcatcaagaactcttcttctggcttcttgccttcgtccaccagcttgcgcaggtagtccagggcctggcgaccatcattgagcgccactacgtccacaccgacagtttgcagacaacgcgtgacctgcttgcgcgccactgaagagtcgtccacggtcagtacgcgcaaagacacggccttatgcgcggtctcggcatccaccacaccgacggagatggtttccgaggtcggcgctacttcggcgaggattttctccacgtcgatgatttccaccaactggttatcgacccgcgtcaccgccgtcaggtagtgatcgcgcccggtgcccttgggcggcgggtggatttcttcccagttcatattgacgatacgttccaccgagcgcaccaggaacccctgggtcttggtgttgtactcggtaatgatcacgaagggactctggcggtcttgcaaacctgaggaccccgtggccaatgccaggtcgagaatcggaatagtcgcgccacggatgttggccacgccacacacgaccggattggacttgggcatgatcgtcaacttggggcattgcagcacttcacgcactttaaacacgttgatgccatacaactgcttgccgtccaggcggaaaagcaacaactccaggcgattctgccctaccagctgtgtgcgctggtttactgaatccattacacctgccatgcccagactcctaaaactaggggtacgaagcgtacccaacactaaacggcacgagctttgctatttgttgttcatggatattaaaacgacagtttcccgacacttcggctgccaacgctatcgcagattgctctgcgccacgatggcgttgcttgccttggggctcagtgctgcgacccgtgccgacaacgttaccctgcctgatgtacttatcggcgtcacccaagggtttcttgagttcactgtagaagattatctggcaaccacacagacgccggggcgttatgaaatccaggtcaatcagttggacccgcgtttgcgcatgcccatgtgcgacagggaattgacagccaccctggaaagcccttctcaacccattggccgggtcacggtgaaagtacgttgtgaaggtgcctcgccgtggacagtattcgtgcctgcccaggtcaagctgttccgtgatgtggttgtcgttgcgcggccgctgaaacgcaccggtattatcagctttgaggatgtggccctgcgtgaacgggacatcagccagatcaaccagggctatatgacctcagtggaccaggctattgggcagcggctcacccgaccaatggttaccgatcaagtcatcacattggttcacctggaacaggccgaagtgattcgcaaaggtgaccaggtggtgatttccgccagcagcggcgggttgaatgtaagaatgccgggtgaagcgctgtccaacggcggcatgagcgaacagatccgtgtcaagaatctcaactccaaccgcgtcatcaaggcgcgcgtgaccgcccccgggcaagtcgaggtcgctttatagaacactggtagaggacgctgggttttcctacactgtgcacgagaagttccgtgtggagatttattgtcattcgcgcctaaagtttgtttgggtatggccgaaaacatggcaagcgtccaaatacccagaggttttttcaacatggtcattgatttcagtcgtttgaataacgccccggctttgccaggcagtacgcgcaccagcggtgccaaggacagcgtagaagccaagccacagcccctgcccgccaaggcagaacaggccagcgtcagccagagtggggaatcggttcacctgagcaatgaggctcaacagttgcagaaggtcactgactcgctgcgcgaccagccggttgtcaataaagcccgggtggccgagttgaaacaggccatcgccgatggcagctataaagtcgacagcaaccgtgtcgccagcaagctgctcaacttcgaagccgagcgctaggcaaaggcctgcgcagggcttttggacgcttaaaacccaaggccagccatgcaccacgacgaacatttgcttcaactgatcattgatgatctggcgccgacgcagcaattgctcgagctgctcaaagaagagtccctggccttgtacggccgggatatgcccttgctggaagaaatcctggcgcgcaaacagtcgctgatcgtgctgcttgaacagcatggcaagaagcgcagcgagatcctgatcagcctgggcctgccggccgatcacgatggcctcgcgcaactggccagtcattcatcggtcggcgaccagttgctgtcacaaagcaaggaactcaaccaattgctcgccctgtgccaggaagccaaccagctcaacggccagtcgatccagcttcaacaagccacgaccgccaatcagttacgcatactccacggcggcgaacctccggccctgtacaacgcccaaggctccacatcacgcctggtcaagccaagcactcgcagccaagcctgacgccggtttacagcgtggcctatccaaggtgcgctacatactggcaaaatgccggttcttgcgtgtagtcgtattttgcctggagatggaagaaccgtgttcaacgcccttaatgcggaagatgccccgcagccaccgaaggtgctcaccacgcctctggaaatcgccagcactttgcggatgctccaagacagccatgatcctttgatcatcaccttccacgagcgcagccaacgcttccaaagctatctggtggacgtttcccgcgatagcaagacgctggtactggatgaaatgattccccgtgacggtgaacgctacctggagaatggcgaaccctttcgtatcgaaggttttcacgatggtgtgcggattgcgtgggaaagcaacggcacactgagcctcagcgaaaaggacggccaccgcatctacagcggcaacatgcccgacgaggtggtctaccatcagcgccgtaatgcttttcgcgccgcattgaaactggcgcagttggtgaatatcgagttgggtggcgagaagctcaaggtgccagtcaacggtaagttgctggatatctccgccactggctgcaagcttcgcttcgaaggcgacatctccgagcgcctgcaactgggccaggtctacgaccgctttgtcgctgccctgccctttggcagcatgaccaccgccgtagaattgcgctacctgcacttcgaagacaagctcaacatcacgttcgccggcgtgcgcttccacaacatgagtggcttggtgcaacgccaagtggagcgctttgtgtatcagttgcagcgggaagctcggcgtttcgacaaagacgacgatttttaagctctaaacgctgaggcaaaaaaacgggcagatcctggtgggatctgcccgtttttcgttcaggggcgcgccctgctcaagtcatgaggatgttcgtccggggccaggggctcttttggctcttcgctagccggctcatccattgctgtttcaggctctggatcaggaacactgacttgcatctgctcctgcaccacctgctcatccacccgagggtccagggcagcgaccaacggcgaactggacatgctgtcgggcatcgccacgtgatgcagcggcgcgtcgtcgacctgatgcagattggtgaccgccttcggtcgaattcgccacaccaggatcaacgcacagaggctgaaaaacgcgtagagcatctggctgccgaatagcttcatgacgacacctgccaacaggggcccgacgctcgcacctatgccataggtcaccagcagcatggccgtcagcgaaacccgacggtcaccttcgacgtggtcgttggaaaaagccacagccaaggggtacaggcagaactgcaccagcgaacaaaagaaccccgtcacgaacagcacttccaagggcacctgagtcatgatcgccaggggcaatgccgttatcgccaggcacaaggcaaagcagcgaatcagcagtgctcggtcatagcggtccgacaaccagcccagaggccactgcacaagcaaaccggcgaaaatacagctacccatgaacaagccaacctgttcagtcgtcagcccctgctgggacgcgtagagcggcgccaaaccgtagaacgagcccacgatcaaccctgcgcccagcaccgtactgagcgactgcggcacacgcttgataaagaagcgaggctccatcggcgccgggtgcaatggtgccgggtgaatacgtcgggtcatggccaccggcaccaggcacagggcaaagcacaaggcgaccagcatcaacagctcgaggccaaggtgagggtgcatgaccaggatcaactggcctagcaccagccctagataagacgcgatcatgtagccactgaacactacgccgcgctgtttggcatccgcctgctcgttgagccaactttcaatgaccatgtactggcacatcatgcccaggcctacgatcatccgcagcacgatccaggcaggcaaccaatcgatcaaaccgtggcccagcaccgctgcgccgacgatcccagcgcaggtggcgtaggcacgaatatgcccgacccgggcaatcaggcggtggccgatcttgccacccaggaccaagccaaaatagttggcggccatcagcgcaccgacccacaggctgtcgacattgtctgccgcaaggcgcaaggccagataagtactgagcaggccggagccaatcagcatcatcaaggaagcgaaataaagggctcgaaaagatttccagatctggcgcatcggcgttccgagcggctccttgcagtgagagacagggctatcggcatgatagtccggggtgggcgggtccggacaggcggtattgtctgtttccggggattattttgcataagagctcagacgctgcaccggtgtctgcaggtacaccatagagataaatacatgacgcacctgctgtgaaccccgaaccgctgcaaggttcgactgaacttgggcagcattgcaaaaagtctcaatagtgcagcgcagaggagaaccagtaagggatatggaacaagctccgggcggcatttttcgaacgcccaaaacaaaaccccaactgctttcgcaattggggtttcggaatttaatcttgacgatgacctactctcacatggggaaaccccacactaccatcggcgatgcatcgtttcactactgagttcgggatgggatcaggtggttccaatgctctatggtcgtcaagaaattcgggtactgagtcgtggccagcaggcctcgcttcagcaaattgggtatgtgacagctgtcggtgctttgtgagcgtcgaactttcggttcatttcgtcttcacacaccgcaatctgatgctcgttagagtagtcaaattgcttgggtgttatatggtcaagcctcacgggcaattagtattggttagctcaacgcctcacagcgcttacacacccaacctatcaacgtcgtagtcttcgacggcccttcaggggactcaaggtcccagtgagatctcatcttgaggctagtttcccgcttagatgctttcagcggttatctattccgaacatagctacccggcaatgccactggcgtgacaaccggaacaccagaggttcgtccactccggtcctctcgtactaggagcagcccctctcaaatctcaaacgtccacggcagatagggaccgaactgtctcacgacgttctaaacccagctcgcgtaccactttaaatggcgaacagccatacccttgggaccggcttcagccccaggatgtgatgagccgacatcgaggtgccaaacaccgccgtcgatatgaactcttgggcggtatcagcctgttatccccggagtaccttttatccgttgagcgatggcccttccatacagaaccaccggatcactaagacctactttcgtacctgctcgacgtgtctgtctcgcagtcaagcgcgcttttgcctttatactctacgaccgatttccgaccggtctgagcgcaccttcgtactcctccgttactctttaggaggagaccgccccagtcaaactacccaccatacactgtcctcgatccggataacggacctgagttagaacctcaaagttgccagggtggtatttcaaggttggctccacgcagactggcgtccacgcttcaaagcctcccacctatcctacacaagcaaattcaaagtccagtgcaaagctatagtaaaggttcacggggtctttccgtctagccgcggatacactgcatcttcacagcgatttcaatttcactgagtctcgggtggagacagcgccgccatcgttacgccattcgtgcaggtcggaacttacccgacaaggaatttcgctaccttaggaccgttatagttacggccgccgtttaccggggcttcgatcaagagcttcgcgttagctaaccccatcaattaaccttccggcaccgggcaggcgtcacaccctatacgtccactttcgtgtttgcagagtgctgtgtttttaataaacagtcgcagcggcctggtatcttcgaccggcatgagcttacggagcaagtccttcaccctcaccggcgcaccttctcccgaagttacggtgccattttgcctagttccttcacccgagttctctcaagcgccttggtattctctacccaaccacctgtgtcggtttggggtacggttcctggttacctgaagcttagaagcttttcttggaagcatggcatcaaccacttcgtcatctaaaagatgactcgtcatcagctctcggccttaagatcccggatttacctaagatctcagcctaccaccttaaacttggacaaccaacgccaagctggcctagccttctccgtccctccatcgcaataaccagaagtacaggaatattaacctgttttccatcgactacgcttttcagcctcgccttagggaccgactaaccctgcgtcgattaacgttgcgcaggaaaccttggtctttcggcgtgggtgtttttcacacccattgtcgttactcatgtcagcattcgcacttctgatacctccagcaagcttctcaactcaccttcacaggcttacagaacgctcctctaccgcatcacttacgtgatacccgtagcttcggtgtatggtttgagccccgttacatcttccgcgcaggccgactcgactagtgagctattacgctttctttaaagggtggctgcttctaagccaacctcctagctgtctaagccttcccacatcgtttcccacttaaccataactttgggaccttagctgacggtctgggttgtttcccttttcacgacggacgttagcacccgccgtgtgtctcccatgctcggcacttgtaggtattcggagtttgcatcggtttggtaagtcgggatgaccccctagccgaaacagtgctctaccccctacagtgatacatgaggcgctacctaaatagctttcgaggagaaccagctatctccgagcttgattagcctttcactccgatccacaggtcatccgctaacttttcaacggtagtcggttcggtcctccagttagtgttacccaaccttcaacctgcccatggatagatcgcccggtttcgggtctattcccagcgactagacgccctattaagactcgctttcgctacgcctcccctattcggttaagctcgccactgaaaataagtcgctgacccattatacaaaaggtacgcagtcacccaacaaagtgggctcccactgcttgtacgcatacggtttcaggatctatttcactcccctctccggggttcttttcgcctttccctcacggtactagttcactatcggtcagtcagtagtatttagccttggaggatggtccccccatattcagacaaagtttctcgtgctccgtcctactcgatttcatgactaagagattttcgcgtacagggctatcacccactatggccgcactttccagagcgttccgctaatctcaaagccacttaagggctagtccccgttcgctcgccactactaagggaatctcggttgatttcttttcctcagggtacttagatgtttcagttcccctggttcgcctcttgcacctatgtattcagtacaagataaccatcttatgatggctgggttcccccattcagacatctccggatcaaagtctgtttgccgactccccgaagcttttcgcaggctaccacgtctttcatcgcctctgactgccaaggcatccaccgtatgcgcttcttcacttgaccatataaccccaagcaatctggttatactgtgaagacgacattcgccgaaaattcgaatttctcagttaagagaactcacaaattttaccttagcctgatccgttaccagtgaaagtaacgttcagtctatctttctatcacatacccaaatttttaaagaacgatctaatcaaagactagaaatcaacattcaccatcacaacgattggaatgctcatttctaagctttatacaaacagaagcagtagtggtggagccaaacgggatcgaaccgttgacctcctgcgtgcaaggcaggcgctctcccagctgagctatggccccgtatttctacaggcgtttcccacacaaaattggtgggtctgggcagattcgaactgccgacctcacccttatcaggggtgcgctctaaccaactgagctacagacccaatttcgggctgcttcttatcgtcttcttcaatgaatcaagcaattcgtgtgggaacttatggagcagctgatgtcgtcgattaaggaggtgatccagccgcaggttcccctacggctaccttgttacgacttcaccccagtcatgaatcacaccgtggtaaccgtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttctgggattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccattacgtgctggtaactaaggacaagggttgcgctcgttacgggacttaacccaacatctcacgacacgagctgacgacagccatgcagcacctgtctcaatgttcccgaaggcaccaatctatctctagaaagttcattggatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaagagctcaaggctcccaacggctagttgacatcgtttacggcgtggactaccagggtatctaatcctgtttgctccccacgctttcgcacctcagtgtcagtattagtccaggtggtcgccttcgccactggtgttccttcctatatctacgcatttcaccgctacacaggaaattccaccaccctctaccatactctagtcagtcagttttgaatgcagttcccaggttgagcccggggatttcacatccaacttaacaaaccacctacgcgcgctttacgcccagtaattccgattaacgcttgcaccctctgtattaccgcggctgctggcacagagttagccggtgcttattctgtcggtaacgtcaaaattgcagagtattaatctacaatccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattaccccaccaactagctaatccgacctaggctcatctgatagcgcaaggcccgaaggtcccctgctttctcccgtaggacgtatgcggtattagcgtccgtttccgaacgttatcccccactaccaggcagattcctaggcattactcacccgtccgccgctctcaagagaagcaagcttctctctaccgctcgacttgcatgtgttaggcctgccgccagcgttcaatctgagccatgatcaaactcttcagttcaaacatctttgggtttttaagaaaccctaaacttagctcagcaatcgttggttacatctttgatttctcgcggagtaacttgtgatgctgataatcttgttgactatcagtctgactccacaagcacccacacgaattgcttgattcagttgttaaagagcggttggttaagatctttcgtctcaaccgaggcgcgcattctacagcagcctcatttgctgtcaagtgattattttcagaagctttcgaagatttcttcaacaacttcaaccacttgcgctttcgatctctcgttagcgggaggcgaattctacaggtatcagcatgagcgtcaagccattaaatcaaaaaagatgaaattccttcggcactgtcgatttacgcccgatttgccagcccctctctatatagaagaaaacaggcaagctttggcgaggagtaagaatcttccaatcacccatctgcaaagccctgaacagctccccctcaatcacgtgacagccgatagacatcgactccaggcttgaaataaaccgaagctatatagaaggaaatgtctgagtgacaaatcggcgaataccgacaactgagggagctagcaagatggatggtgtcccagggccggttcgaacggccaaccttccccttaggagggggatgctctatccaattgagctactgggacgaatactgctgtcagcgcaaaaagccagcttagcgatgatcggcgagcatgttaacggccaaggttggttttgtcatgtcgtccgcagcctttttgattgtaggcggatacttttgggcattgccaactgcaagccaacctcacgccaccacgtatcggtcgtgcaaattgcactaccttcaaaacgccatacttgcaaactgcaagcccaagagagcgaacttaaagctaactgattgattttactgacataaaatattggcacggcatctgcaatagctcagttacaaaaaccaactgatccaggcatccacggagtacgtcaccatgaacagcgcccttctgctaggccttaatacagtggcattgactgccttggtgatgctccaattccaaccgcctaccgaagacactgcgcaaatcagccaagcaaccccgcattaccttcaacagcaacaacgccctcaactcgcagtgatgaacgcgacaccgcagtcacctgtcagattggcccaggacgcacaaaccgcgccagcctctgaacactgggttttctgagaacgccgccgatgtccaagcttgcctggctattactttgcctcacttgcgccgccacactgatcggtctggcctcaacgacccaggttaatcaaaccaccgcctttatcgtcagcgctgtgtttggcagtctgctgctcctgacgctcatcgtaggccgtcgaatcaaattcgaccctgtcctgcgctgatgcccctaccttatgtcgcctgacattagcaaacaagcaaactgccactagtcttaggattgcgggcaaaacgccatattccttatgggatgcgccctgcgacttggacgcgggactgtcatgggcgaagatcgcctaccctcatctgatcgcgaagagtttttaaccagtccgcaaaaacgcaaatcagtgctggcataaagcctgtaggcagttcaatatttgtcacagaattgacgccaatgaaatgtcaaatctgaggcatgatgcggcctctttgcaattcgggttgaactttggtcgtgagccttgtcttaacactcatcttgcggccaattccaaaaaccgctcccctgaactaaccggttaaatatatgcgcccattgaaacaggcaatttattccagccgtacggctgacaagttcgtcgtacgtctgccagacggaatgcgggaacgcattgccgaggtggctcgcaatcatcaccgcagcatgaactccgaaatcatcgcacgcctggaacagagccttattcaggaaggtgccttgggtgaagagctgagcatgcgcctggacagccccgagctgtcactgcacgaacgcgaactgctgcagcgttttcgtcagctctcccatcgccagcaaaatgctctggtctcgctgatcgcccacgacgtcgaggcagccgcagaagccaattgattggcgcttgaaagccgaagccagccatgtgctggcttttttttgcgcgaaatttggaagggcatgatgtgggcgggggcagacttgcccccgccggaaggaatcagagcaggaagatagtcgccagccccaggaagataaagaagccaccactgtcagtcatcgccgtgatcatcacgctggcccccatcgccggatcacgcccaagacgcgccaaggtcataggaatcagaacacccatgagcgccgcgagcaggaggtttagagtcatagcagcggtcatgacgacccccagggaccagctgtcatacagcaggtaggcgacgataccaataacccctccccagacgacgccattgatcagcgccaccgccagctctttgcgcatcaggcgtgaggtgttgccggtattaacctggtcaagggccatggcacgcacgatcatggtaatggtctggttgccggagttaccgccgatacccgctacgatcggcatcagcgccgccagcgccaccagtttctcgatggaaccctcgaacagaccgataactcgtgaggcgataaacgcagtgatcaagttgaccgccaaccaggcccaacggttacgcagcgagcgccataccgaggcaaatatatcttcctcttcacgcaggcccgccatgttgaggacttctgtttcgctttcctcacgaatcaggtcgaccatctcatcgatagtcaaacggccaatcagcttcccgttcttgtcgacaaccggcgcggagatcaagtcataacgctcaaacgcttgggcggcatcataagcatcctcatccggatggaagctcaccggatcactggccattacgtctgcgactttcttttcggggtcgttgaccaacagacgcttgatcggcagtacgcccttgagaatcccttcgtagtcgaccacaaacagtttgtcggtatgacctggcagctccttgagacggcgcaggtaacgtagcaccacttcaagactgacgtcttcacggatggtgaccatctcgaagtccatcagcgcgccaacttgatcctcgtcgtaagacagcgccgaacgcacgcgctcacgctgctgcgagtcgagcgcctccatcaactcatggacgacgtcacggggcagctcaggggccaggtcggcgagctcgtccgcatccatctcccgggcagcagccaggagctcatgatcgtccatgtcggcgatcagggtttcacgaacggaatcagagacttctagaaggatatcgccgtcgcgatcagccttcaccaactgccaaagagtcagtcgatcatccagtggcagcgcttcgagaatataggcaacgtcggcggagtgcaggtcatcgagcttgcgttgcaactcgaccaggttttgccggtgaaccaggttttcaacgcggtcgtgattcggaccttcctggcggtgcgtgaggtcttcgaccacgcgctggcgctgcagcagctcgatgacttgagccaggcgatcctgcaggctttcttgtgttttctttacttctacttcggtcataggcgaactccactcccagcagcggggcacgccggaaggatcaatcagtcaattcatgattggtaaaacggggtactgagtaactactgggtaagtccatggaggtattccacaagccccggcggagctgacgggcgcatgatacaccgcccggaagttttaaacgttaaaaaactggaaagaacaagtgcttgcgcgtcaaagctcagccttggctaacatccatgaactgcgacgccacagacgggagggaaaacacatgggtaggagaaaaagattgaatcaagggataaaacctacacaaaccccagacggcaaaaagcccgcactaggcgggctttttgtttgtatggtgcactcgacaggattcgaacctgtgaccgctcggttcgtagccgagtactctatccagctgagctacgagtgcagattgtgtttttagaccaggtcacaactggttgaaactgaattacctgcattactgcaactaactcttaaatggtgcactcgacaggattcgaacctgtgaccgctcggttcgtagccgagtactctatccagctgagctacgagtgcatttgttgccgcgcattataggccgttcaatctctatgtaaagctattttttcgagtattttcaacaacttaccgaaaaaaccagattgcaacgtactaagcaaataatggcggagaacgggggattcgaacccccgacacccttttgaggtgtactcccttagcaggggagcgccttcggccactcggccagctctccgcaacacggggcgtatattaaccacgttcttccccgtttgcaaacataaaaaacgataaaaattaaaggcttggttcttcgtccttctctttcttgatccgcaggtagatttcctcgcggtggaccgctacctctttcggagcgttaaccccaatacgtacttgattgcctttgacgccgagcacggtcacggtgatttcgccatcaccgataatcaggctttctgcgcaacgacgagtcagaatcagcatgcctttctcctcacgcatttcagttcaggaacaacagtctgcaaaaaaaaggcattcgacctacaaccgaaaggccatagccctacctgcctaagtattgtcgagcccacgcaaaagagcatgcgccccacaaaaaaatgaaaggcgcggtaaaaccgcgcctttctggctacacatcactcgccctgtcgggccggcgcgtccagctcaaaagcggtgtgcagcgcacgcacagccagctcgaggtacttctcttcgatcactaccgagactttgatctccgacgtggagatcatctggatattgatactttccttggccaacgcttcgaacatgcgactggcaacgccagcgtgggaacgcatgcccacgcccacgatcgagaccttggcgatcttggtatcacccaccacctcacgggcgccaatctcgctcgctgtgctctgcaggatccgctctgccgcatcgtactcgttgcggtgcacggtgaaggtgaaatcggtggtgttatcgtgcgaaacgttctgcacgatcatgtcgacttcgatgttcgcgccgctgatagggccgaggatcttgaaagccacgcctggagtgtctggcacgccacggatcgtcagcttggcttcatcgcgattgaaagcgatgccggaaatgatcggctgttccatggattcctcttcatcaatagtaatgagggtgcccggcccctccttgaagctgtgcaatacgcgcagcgggacgttgtacttgccggcgaactccaccgcacgaatctgcaacaccttggaacccaggctggccatttccagcatttcttcaaaggtaatcttgtccaggcgctgggccacaggcacaacccgcgggtcagtggtgtagacgccatccacatcggtatagatctggcattcgtcagcctttagcgctgccgccagagccacaccggtggtgtccgaaccgccacggccaagggtggtgatattgccttgctcatccacgccctggaaacccgctacaactaccacgcgccctgctttcagatcagtacgaattttctgatcgtcaatctgcagaatgcgcgccttggtatgcgcgctgtccgtaagaatgcgcacttggctaccagtgtaggacaccgccggcacgccacgcttgttcagcgccatggccaacagcccaatggtgacctgctcgcccgtggacacgatcacatccagctcacgcggcagcggctgctgatccccactgatggccttggccagttcgatcaggcgattggtctcgccactcatggccgacagcaccaccaccaggtcatcgccggcatcgcggaacttcttaaccttgtcggcgacctgctcgattctttcgacagaaccgaccgaggtacctccaaatttctgtacgatcaaagccatttccaagccgcctcagcccgtaaaggggcgcctaaaatccaatccacccgcactgaacaagcccgtgactacaccacaggccgataaacagtgccttaaatacctgcctcgacaaacggcacggccagggccagggccgcgtccagggccgccgcgtctacaccaccgccttgagccatgtccggacgaccaccgcccttgccgcccactgccgcggcggcttgcttcatcaaatcaccggctttgagttggccagtcaggtccttggttacaccggcaaccagaacgaccttatcctcatggacactgccgagcaggatcactgcgcggccgagcttgttcttcaactgatcgaccagggccaacagcgccttgccgtcctgaccgtccaggcgcgccgccaggactttgacatccttgacgtcaacggcagaggctgacatgtcgtcgcctgctgcactggccgccttggcctgcaactgctccagctgtttctccagcgcacggttgcgctccagcacggcggaaagcttgtcgatcaggttgtcgcggctgcccttgaccagggtggccgcttccttgagttgttcttcagccgcattgagataggccagtgccgcagcgccggtgaccgcttcaatacgacgtacgccggaggccacaccgccttcgctgacaattttcagcagggcaatatcgccggtacggttggcgtggataccgccacacagctccaccgagaagtcgcctcccatgctcagcacgcgcacgctgtcgccgtacttctcgccgaacagcgccatggcgcccttggccttagcagtctcgatatcggtctcttcggtttgcaccgcggtgttcttgcgaatttcagcgttgacgatgtcttccagggccttgatctgctcaggcttgatcgcttcgaagtgactgaagtcgaaacgcaggcgctggctgtcgaccaacgaccccttttgctggacgtgttcgcccaacacttggcgcaatgccgcgtgcagcaagtgagtggccgaatggttcaacgaggtggcatggcgcacatcggcgtccacttgggtttccacgggggaacctacggtgagactgcccgacgccaatacaccgtggtgcaggaacgcaccgccggtcttggtagtgtcgcgcacgtcgaagcgaccggagctcgccttgaggaacccacagtcaccgatctggccaccggactcggcatagaacggcgtctggtccaacaccaccacgccatcgtcgccttcattcaagacgtccacggactgaccgtccttatacagtgcaaccaccttggccgaaccgctggtggccttgtagccagtgaattcggtggccacatcgaccttgaccaggctgttgtaatccatgccgaaagagctggcggaacgcgcgcgcacacgctgggcttccatctcgcgctcgaaaccttcctcgtcgagggtcaggtcacgctcacgggcgatgtcgccggtcaagtccatcgggaagccgtaggtgtcatagagcttgaacaccacgtcgcctggcaccacggtgccttgcaggttggcgaggtcttgctcgaggattttcaggccctgttccagggtcttggcgaactgttcttcttcggccttgagcacgcgttcgatgtgcgcctggttctgcttgagttccgggaaggcttcgcccatctcggcgacgagggccgccacgatctggtagaagaagctgccattggcgcccagcttgttaccgtgacgacaggcgcgacggatgatgcgacgcagcacgtagccacggccttcgttggacggcagtacgccgtcggcaatcaggaagccgcaggaacggatgtggtcagccaccactttcagcgacgcctggtcttcattggcgcagccgatggccttggccgcggcagccagcaggctctggaacaggtcgatttcataattggagtgcacgtgctgcatcaccgcactgatccgctccaggcccatgccagtgtctaccgacggcgccggtagcggatgcaacacgccatcggcggtgcggttgaactgcatgaacacgttgttccagatttcgatgtagcggtcgccgtcttcttccggcgaacccggtgggccgccccagatgtcggcgccgtgatcgtagaagatctcggtgcaggggccgcaggggccggtgtcacccatggtccagaagttgtcggaggcatacggcgcacctttgttgtcgccgatacgcaccatgcgctcaggcggcacaccgacttgcttggtccagatgtcgtaggcctcgtcgtcagtggcgtagacggtgacccagagtttttccttcggcagcttcaatacgccggtcaggaaggtccaggcgaagttgatcgcgtcctgcttgaaataatcgccaaagctgaagttgccgagcatttcgaaaaaggtgtggtgacgggcggtgtagccgacattttccaggtcgttgtgcttaccaccggcgcgtacgcacttctggctgctgactgcgcgggtataggcgcgtttttcctggcccaggaaacagtccttgaactgattcatccccgcgttagtgaacagcagggttgggtcattgcttgggatcaatgagctggaggctacacgggtgtggccttgctcttcgaagaagcgaaggaaggcttcacggatttctgcgcttttcattaggttcttccacggaggctgcggccaaaggccagtgcgcaacatcatcagacggagcgacggcaaagggccgcattatatcggccctttgccggtggtacagcgtgtttatgtgatagaaacactcaattagacggcgtgcactgtcattttcgcgaaaactcgacgaatgtttgcacgacttgctcgatctgcgcccgactgacgtccaggtgagtgaccatgcgcagacgcggtgcggcgctcaacttgactccgcgctcggcagcaaaggccttcagggcctgggcccggtcaccgatttgcacgtagaccatattggtctgcaccggctccacggtgtaaccggccttgcgcagctcatcacccagccattgtgcgttggcatggtcgtcagccaggcgctgcacctgatgatccagggcatacagccccgccgccgccagggagccggcctgacgcatgccaccgccgaccatcttgcgcaggcgccgcgccttggcgattagcgcagtcgagccgcacaacacagagccgacgggagcaccgagccccttggacaggcacaccgacaccgaatcgaaatgctgggcaatctcccgcacatctacacccagcttgaccgcggcattgtagatacgtgcaccgtccagatgcaggcccaggccatgttcacgggtgaaggcgcgagctttggccaggtactccagcggcagcaccttgccctgcatagtgttttccagcgccagcaggcgcgtgcgggcaaagtggaagtcgtcgggcttgatggctgcgaacacatggtccagatcgagcgagccgtccgcctgcacttccaggggctgtggctggatcgaaccaagcaccgcggcaccgccgccttcgtatttgtaagtgtgggcctgctggccgacgatgtattcctcgccgcgctcacagtgagccatcaacgccagcaagttgctcatggtgccggtgggcacgaacagcgcagcggaaaaccccagacgcttggccaactcggcttccagacggttgacgctggggtcctcaccatagacgtcatcaccacttacggcgctggccatcgcgtcgagcatgccgggggtgggttgggtcacggtgtcgctgcgcaggtcgatcacggtcatgaagagggcctctaacggaatggataaatccttttgtgagtgattactgcgggcaacgccgcggaatatcaagccccacctgcattcaatcgaataccaaccaaacaaaccgatataggttatcgatacggcactcgtgcagtttttgaaaaaccatgttaaaaactctccgccgccagggttctggcggcaacgttctcagggcggggtgcaattccccaccggcggtaattgcacgcaatgtgtatagcccgcgagcgcttggcgcctcgaactgctcacgcaggacggcgacaaggtcagcagacccggtgtgatcccggggccgacggtcatagtccggatgaagagagaacgggattggcacctaagggccgcgcactgagctcatgcctgcatgacgccgttgttcgtacccttaaaaatcccattcgattcataacgccctgtttttttcttaaacaggagtcagaacatgcaacccaccgctatcgacagcaaaagcaaaaaccatcacggcgagcgcgtcgcgtttatccaggcctgctggcacaaggatattgttgaccaatcgcgcaaaggcttcctcgctgaaatgatcgcccagggctaccaggaatcggacatcgatttcttcgaagtcggcggcgcctttgaactgcccctgcacgccaagctgctggccaagaccggccgttacgccggcatcgttgccgccgccctggtggtggatggtggcatttatcgtcacgaattcgtcgcccaatcggtggtcagcgggctgatgcaggttcagctggaaaccgaagtgccagtgttctcggtgtccttgacgccgcatcacttccacgccggcagcgagcacaccacgttcttctatgagcacttcgtgcataagggccaggaagctgcgcgcacgtgcgccgataccctgcacaaggtgcgggcgattcgtcgtagtgagccgcgggctgtagcggtctaagcatcaccgcgaaaacaatatgggagggtgcttgaacccgatagcagagtgtcagtcagctcatctgtaactgatacaccgccatcgggagcaagccccctcccacatttggatccagttgggcttaagatttaagccaacccagcatccgtggcaggcacgataagaatcccggctcgcaagccgttcttcaccttggggttggggaagatgatgcgggcgccctcctcctcgatcacccagcgggtcttggccacgtcttcggccaacaggtagcccttgtccaacggcgagaagttttccacgtccgccggcaggtgcatcaggaacgcatcgctgtgcttgatgacttcacgggacacggcaaacaattgcaggccatccaggctgtcattctccggctcgttgccctcgatcatctgcttcaggcgcgtttccaggcgggacacgtccacgccctcgttctgcccgaacggtcgcgccttgcccagctccagggtgaaggcttcggcctccagctgttcgtaggtaaacgcggtgaaggtgatcgaggttttgttctgcagcaacaccgcttgcatgccggctgcgctcaggcgcgccagttcacggcgtgaatgctggcgcccctccttccacgggtaaagggcaaactgctcgatcttcgaaccacgaatcgcggtatgcaggtcgtaatgcaggcgtgaacggccgggctggctgaaaaaactgcgggccagctgctcaagctcggcggcacgcatggcttcggggccgatgtttttttcatgccggccgttgaacagccggttgacgtccagttcgaggtaacgctcaccgcgacgcatggcctcggggttgccgaacaggaacaaaatacgggtacggggcttgatctccccgcgggcaatgccatgcaacaggcggtcgagcaactcgatcggcgcggtttcgttgccatggatgccggacgacagcagcaggtcgctgccattgtcacgcgcctcaggtgggcgcacttcaagcgcgccgtcgctgagccagcgcatctgcacgccgtcgacagtcagttgaattttttgcgccggttcacgaccggcgagggtcagttcaagcagtttgccgagggcgagcataaacagcttccttagtggttgcagccaggaccatggacgtgatcgtcatcatcaccctcaacgtcggccggttccatttccagttgcaggctcatcaggttggtagccaatgggcgcatcagcaggttggcgtattcggcgtcgccctcttccacatccacaccgatcagcagttggccgcgaccgtcgtgctggatccagatctccttgccctgccacaccacggcaacgcgagtgcaggacgtttccagctgggtgccgtcggtgtcttcaaggatcagtttcagggtgtcggtggtcataaatagttctcagccgtacggcgttaattgatctggaaaggataaaccgagcccagtttaaggatttgcgtcagttcatccagtgccgtccggcactcaagcagcaactgcggatcagccaggtcggtttcgcgcaggctgtcgcggtagtgtttgtcgacccattgggtcagcgtgtcgtacaacggtgcggtcatgataacgcctggattcaccgctgccagctcggtttcgttcaatgccacgcgcagacgcaggcatgccggcccaccaccgttctgcatgctttgcttgaggtcgaagaccttgacctcgcggatcagcccaccggaggcggtcaagccctgcaggtattgccacacgcgctcgttggcgcggcactcttccggcacaatcaacagcatcgaaccgtcagggcgggtcagcaactggctgttgaacaggtaggaacgcaccgcgtcctcgacactgacctgggcacggggcacgcagacggactggaagttgccgcccagcttgcccaacttggcttgcagctcggcgagcatctgttcggtgttgaggaatgcgtcctcgtggtagaacagcacctcgccgttgcccaccgcgattacatcgttgtggaacacgccggcatcgatcaccgccgggttctgctgggcgtagaccacaccgtcatccttcaggccgtgcaggcgcgcgacggcctgggacgcttcaagggtctggcgcgccgggtacttctggggggccgggtagcgggtatcgaacgcgctgcggccaaacacgaaaaactcaacgccggcctcgccgtattcacggcagaaacgtgtgtggttggccgcgccctcatcgccgaactgcgccaccgccggcaaggcggcgtggtgggcgaagtgtttctgttcggcgaacatcgctcccagcacgcggctggtggtggggtgttcaatgctgcggtggtacttgcagttgaggttcgcggcggtgaaatgcacgcggccatctgccgtgtcggcgctcgggctgacggttgcggcgttggcgacccacatgctggatgccgagcaactggccaccagcaacggcatcgcgtgcttggccgcttgctggatcacctgggcgtcgctgccgctgaaaccgaggttgcgcaaggcggccacatccgggcgttcctgaggcgccaacacaccttgcacaaagcccatgtccatcagggctttcattttctgcaagccctgcaacgccgcctccttcggattggaagattgctggctgttgctctgggacgcgacgttgccgtaggacaacccgccgtagttatgggtcggccccactagaccgtcaaaattgacttcataggatttcatcggcgaggctccacgaacatctgtttttataggcatcaaattacttaaatacacgactgaaccggtatgggagggggcttgctcccgatagcggcagttcagtcacttgattcatcaactgatagatagctatcgggagcaagccccctcccacatttagatcagtgtaatgccgggggttagcgtggcaggaaccaccaagcttggcgtttcaagcgacgccaccgggtacgcgcaataatccgccgcgtaatacgcactggcgcgatggttgcccgacgaccctaccccaccaaatggcgccgtactggcggcgccggtcagttgcttgttccagttgacgatgccggcgcggctttccagccagaactgctggtaacgcgcttcggaatccgacaacaaaccagcggccaagccgtattgagtgttgttggcctcggcgatcgccgcggcaaaatcagcgtagcggatcacctgcaacagcgggccaaacagttcttcgtcttcgcgctcggtcacgccagtcacgtcgataatgcctggggtgagcagagccgcttgatcctgtggctgggtcatctccagcagcgccacggcaccattggccagcatcagttcctgcgcttccatcagcgctttggccgccgcaagggaaatcaccgagcccatgaacggtgccggttgctggtcgaatgcgcccacttcaatggtcgtgctgaccgccaccagccgcgccagcaatgcatcgccccaggcaccttccggcaccagcaaacgacgggcgcaggtgcaacgttggcctgccgagataaacgccgactggatgatggtgtagaccgctgcatccacatcggcgacctcgtccacgaccagcgggttgttaccacccatttccagggccaggatcttgtccgggcgccccgagaactgctggtgcagatgattgccggtgcggcttgagccagtgaagaacaggccgtcgatgccagggttggccgccagggcgataccggtttcccgcgcgccttgcagcaagttcagcacgcccgccggtaagccggcctcaacccagcattgcacggtcagctcggcgactttcggggtcagctcgctcggcttgaacagcacggtattgcccgccagcaacgccgggacaatatggccgttgggcaagtgcccgggaaaattgtaagggccaaacactgccaccacaccgtgaggtttgtggcgcaacacggctgtggcgtcgcccagggggccgctcttctcgccggtacgctcgcggtagctttgcaccgagatcgcgatcttgttggccatgctggtgacttcagtcgccgactcccacagcggcttgccggtttcctcgccgatacaacgggcgatttcatcggcgcggcttttcagggtagcggcgaacgtttccagcacactgatgcgctcttccagcgggcgcctggcccaggccgggaatgcctggcgcgcggcctgcacggcggactcgacctgttcgacggtggcgccattgccggcccacagcacctgctgggtcaccgggttgcgcgattcaaacagttcaccctggccggccagccagctacctgcgatatacaacgaattcattatttcgactcccgagcagcggacaacggaacagcacgcacttgatcccccaccaccagctgcaggcgcttggcggtctgcggatcgaccaccagggtgcctgcggccaggcgagctggagcggcggtaatacggcactcttcacgcttgcggttatgaatcaggaacggcgtggcatcgtcccccggcgtgccgatggccaataccagtgactggctgtcgcgcaccgcgcggattttgctggtctcacactccaccgccgggccggcgtcaaaaatgtcgacatagccctggtagctgaagccttcgctcttgagcatgctcagcgccggctcggtgtctggatgcaccttaccgatcacattgcgcgcgtcctcggaaagaaagcagctgtacaacggaaacttcggcatcagctcggcgataaacgctttgttgcccacgccggtgaggtagtcggcctggctgaactccatcttgaagaagtgccggcccaggctttcccagaacggcgaacgcccggcatcgttggacactccgcgcatctcggcaatgatcttgttgccgaacaactgcgggaactcagcgataaacaacatgcgcgccttggccagcatgcgaccgttgaggccattgcggtaatcggcgtgcaggaacaacgagcacaattcggaattgccggtgaggtcgttggccaggaacagcgtcggaatctcacggtagatattcagttcctgggacgcgctgacggtcaacccgacccggaagttgtaccagggttcacgcaggccaacggcccccgcaatggcggaaattcccaccacgcggccttcgtcgttttccagcacgaacaggtagtcggcatcgccgcgcccggcttcgccgcgaaaggttttttccgcccagccaacccgatgggtcaggcgctcttcattggccggcaaggtggtgaggccggtgccggtgctgcgcgccagatcaatcagggccggtaaatcgctgctgcgtacgggacgaacgatcatgctatctcctcgaacgggtcgctttgcagccacccgcgaaactctgtttataccggcgcttaaactgcaaccagacgcacactcgcgccttcgccgacgcccagggcttcggctgctgccaggtccaggatcaccggtttgcccggcgcatagtccagttccagcatcaccgcacggtaatcctgcaactgcgcattgctcaccaggtactggcgcccgacacccttggtcatctcgccgactttcaccggcaccacgcggctctgggcaatcgagcgaatgcccgaaacctttgcgtgcaaggtcgggcccccatcgaagatgtcgatgtagtggtcggtctcgaagccttcacgcataagaatatcgaaggtgatctgtgcacgcgggtgcacctggcccatggcttcctgcgctgcgtccggcagcagcggtacgtagatcgggtaatggggcatcagttcggcgaggaaggtacggcttttcagcccgcacaggcgctcggccgcggcgtagttgaggtcgaagaagttgcggccgatggcgtcccagaacggcgaatcaccgttctcgtcgctgtagccgacaatctcggtcaccaccgagtcagcaaagcgctcgggatggctggcgacaaacaacaagcggccacgggaattgagttccgaccacggcgaaccgaccagttcaggcaccacataaaaactggtgagcaggctgttgccggtgaggtcgtgacattgggaaagcacgtggatcttgttgtggatcttcagctcgcgggaggcgtgcacgaaggtttcgttacggaaactgtagaacggctcggagtaaccggccgaggcgacgatcgccgaacagccggcgagcttgccggtctcggtatcttcaagcacgaagaaataactctcttcaccgttgaagcttacctcggccgcgaaggaggcttcgctggcggcgatcttgtcgctcaagcgttccacatcatccggcaaggaggtgacaccaatcgggctgtccgcagccagacgctgtacctcgcccaggtcagccatttgcgcggggcgcatcaccagcatggtgtcactccttaactcgaaaaactcataggaaaaaaataccggacaggcctgaaaacaacacctatccccatgtagggctaattccaatgtgggagggggcttgctcccgatagcagtgtgtcagttgatgaatcaagtgactgatccaccgctatcgggagcaagccccctcccacatttgacccgatcaagccaatcaggcgtgcgtcaaagtttttacagcacgctcaaaacgatccagaccttcgttgatgtccgcctcttcgaccaccaggctcggcgcaaaacgcaccacgtccgggccggcttgcaggatcatcaggttttctttctcggcggcgttgaacacgtccttggccttgcccttgaacgcatcgctgagtacacaaccgatcagcaggcccatgccgcgcacttcggtgaagatgccgtactgcttgccgatctgctccaggcgcgccttgaacaggtcgtgcttggcgttgacgccagccagcacctcgggggtgttgatcacgtcgatcaccgcttcggccaccgcgcatgccagcgggttgccgccgtaggtggtgccgtgggtgccgaccaccaggtgcttggccaggtcttcacgggtgagcatggctgcaatcgggaacccgccgcccaggctcttggcgctggtgaggatatccggcaccacgccgtagtgctgataggcgaacaggtggccgctgcggcccatgccggtttgcacttcgtcgaataccagcagcgcgttgttggcgtcgcacagctcacgggcaccttgcaggtaagccagttcagccggcagcacaccgccttcaccctggatcggctccagcaccacggcgcaggtcttgtccgacaccgcggctttcaatgcggccaggtcgttataaggaacgtgggtgatcccggtaattttaggcccgaaaccgtcagagtacttcgactgaccgccgacgttcacggtgaacagggtacggccgtggaaactgttcagcgcggcgatgatctcgtacttttcagtgccgaaacgatcgaacgccactcgacgggcaagcttgaacgcggcctcattggcctcggcgccggagttgcagaagaacacacgctcggcaaaggtggcatcgatcagcttatgggccaggcgcagggccggctcattggtaaacacgttggacacatgccacagcttgttggcctgctcggtcagtgcaccgaccagcgccgggtgggcgtggcccaatacgttaaccgcgatgccgccggcaaagtcgatcagctcgcgaccggcctggtcccaaacacgcgaacctgcgccacgcacgggaatgaaggcggcaggtgcatagttgggcaccatgacctggtcgaaatcggcacgttgcaccggggcttgctcaacggacatcggagtctcctgaagaggaacgcctgcctggaactggcgggcgatgcagggattgtaaggacagttttcagcgccaccttgccgccaagcgacaacttcttatagcgccaaccccggttttacgcgggtttacggcaatgcgacatattgcgtcgcaatggcgcagtgtaaaccagcacagcctgtttcggcaggacgccccgaaacggatcacgccgcactccttgcaataacccagtagtccctgcgccgcctcgtgcatcgatttactggagctttactacgctcaaggattggcaccatgcctgactctgcagaacacacatcgcacaccagtccctcgttccaacccgacagtcactatgagccgctgaaaaacgcgattcctcgctggctgggcgaaacctctctgcgtcgtcgcgaggcgctgggccagttgccgcccagcgtgccgccagccttgcgcgatgcctccccggccagcaagggcgaattcaagcggctggccatcgcccactgggaggcgcaaaacaccgtcgaaaaagccttggccggcctgttgagcgccgaggactttgccgacccgatcctcaccctggccctcaagacccaattcggcctggaactggatgtgcggcaaacgtttctgcgcctgtatatcccacaaaccattcccggctttccaatccgttcaggggccgcccgcacctggaccgtgtccctgctggaagccgcgctgcacaacttcgaacacaaggaaacccaggccgatgcccacgaagccgagtcgaccttcatcacccgccccgacgccagaggccaattcaacaccttaccggcggtcaagcgcgtgctccctatcagtgcctttatccagctgtgccgcgatctcgacatcggcgccctgtacgagatgtacctgcaagagcaactgggcctgaacgaaccggtggctgaggccgtcttgcgcttgaaagttgtacgcagccagaaagccgaactgcaagccgccctgcattgggcgctgatctcaggtgacatccagcccggctaccagcgcttgatccaaggcctgctcgacggcgtcaccgggctgcgcttgcacgggcaactcgtgcgctatcacgatttgaaactgatggatgccgacctgcccggcatcatcgtcttcgcccccgacctggagcatgcccgcaccgcgacgccactggtggcctatgtgccgggtgaccccgagcacccgatcaagcaatacccctcgtcccaggcaatgcaaaaagaactggtgcgccaactgcgcgatgaacagtaccaacgctttttcagccggtttgtgcctcatgagcaacgcgggtatttcttcgccaacctcagccagttgctcggccaggtcacctggcacccgcatgaggccggcagcaaccagccaagctggcgccagaccccgaccgaccaccctcgcgtgcgttttgtcgccacccccggcggccatgacctatggcagcaccagtaccaacgcaagctcaaccaaatactcaacgacgcacgcagcaccgccgtcgccacggcaagcgctgatcgcaaggcacgctgggcgctatgggattcattcgtgaatatcgcatcgtcgatcctgaacgcggccgcgttgatcatcgcccctttcgtacccttcgccggtgagttgatgatgggctacatggtttatcaactgctggatgaggtattcgaaggcgtcatcgactgggccgaaggcttgggcaccgaggctgcggggcacctgttgggagtggtcgaggcactggtgcaattgggcgcctttgccgtgggcggtgagatcgccatcgcccagtttcgcaaggcgctgccacagaacgttatcgacttcattgaccgcttcaagccggtaaaactgcccaagggccagacccgctactggaaacccgacctcggcgcctacgagcacgccaccagcgtgccgcctggcacttatcgcgagccgaccggcctgtacccctaccagcgcaagaacctgctgacgctggatggcaaaacctacgcagtggaagaagacccggtgtcttccacgctgtacctgcaacacccgtcccgccccgatgcctatcgcccacgggtacgccacaacggccacggcgcctggcacacagagctggaaaaccccttgcagtggaaccgaaaaacactgttgcaacgcctggggcaccctgtggaggggctcagcgaagcgaccaggcgctggcgctgaacatcagtggcgtggacccggacgtgctgcgcaaaatgcatgtcaacggcgaggcgcccccggcactgctgatcgatacccttgaccggctgcgggtcgaccgagagattcaaagcctgatcgcaaggcttgccagcgatgaccccgcgcagtacagccgtgtcgacccgcaagcgatcctgcaattgctcaccagctacggcgattggccgcagacccgctgcctgcaatttatcgatggccaaggcaacaccgcctgggcttttggcgacgagcaactgcccgtcatccagatccccgaaagccagctgaacaacggtgacctgctcaaggccatcctcaacctgttgcccgccgaggaagccgccgaggcctatggtgccagtgttggcgatacgcgcctgagtctggaggcccgcgccagccatctgcgcaggaaactcgcggccactgccgaggaaaaacgcgcggggttattcgagtcccactatggcaccctgcaagccgcccataatccacgcgcccaacgcctgatcgatgccgcgcctgggctgcccgccaaggttgcgcaagccctgctggaccgcgccacggtcgaggaactgcaagcgctgggcagccagcacacgccattgcgcctgcggctactggcccgtagcgcgcaggccgaagtgcgcgtgtgccgtgcctttgaagccatgcacttcggcacaccaacctgggacagcgagcgcctggccttgcattcgttaaccaagctgccaggctggttgcagtcactgcgcctggaggtgcgcgactacagcgtcgatggcgcggtgcgtgaccggatcggccccccggaggcctcgcaggtgggcaccctggtacgcaacgagaatggccaatacacgccctacgtcgacggcgacgcgctggcccccgcgtccgacctgtactccgcgatcctgagcgccctgccggaggcacaacgcaacgccatccaagtggattcaagcgcgcaactgcgccagcatctgctacgccatcccatcatgcgtgacacgctacgcgatctgcttaccgccgatcccgtgcgcaaacccttctatgatccgcagaccatgaagttgctgggcggtatggacggctatcgcgcccaacccgagctgggcggcaggttgcccacagccagcgagcaattgggtgaactgtttcccgggctcgatgaggggcagatgcaggctgtgcttgaacatatgcaaacactgccaggcggcgcgcccaaccagctcgccctgctgcgcgcagagcgccaggtactgcgtgacaccctgcaggcctggcaggcagccatcccagcgcaaatgcctgccgagcaacgcttttatgaaacgcaaacgcgccggctgattaccgaccagatcgaacagtgctggcgccgggaaaccgagcgggatgaatacttcatggacagcgaactggacggttttaccctaaggcttcacgccccggagttgaccaacctgcccgagctgagcacagcccttcgtcatgtgtcactgctgtcgctggcgggaggcagcagcctagaaggtgtcgaaggcttcttgcgcggttttccctggctgcgccgcctggagctgcgcaatatcccgctgggcgatctgccctccccgatccgcgcgatgcacaggctcaacagcctgaccctgagcgactgcaacattaccctgaacgagcaaagcctggcgcatttgaacgcgataaatggcttgaactccctggacctgcaccgcaaccccctggggttgataccggatgtcgagggcatgcccgacctgacgctgctcgacctgtcggacacacagatcgagcgtctgcccaatggcctgctgagccgcccccttctaaaagccgtatggctgaacgacaaccgtatcaccgagttaccccaagagctgttcagcctgacgcccgatatcgcacatggttttgacctgtccggcaacccgctggaacctgcagccctggaacagatcaagcgctatgcccagaactacaatgagtcattcacagcccaggcgcccagcgcagaacgcaccagggccatacagctttacccgacctttctggatgccgaagccgatcattttctctttcgcctgcccggcaccatggccgacattgccccgaccctgactcgcctggaggctgagtatgcgcaactgggcaccgacctgcagcagtgggccctggacataccggctcgccacccggtcctcgacattaacctcgatgaacaaaccgccgccgaagagcaactggcacgccagcgcttcaaaagcttgctggaagatgcctggcgccgcgaaagcgagcaggacgaggaaaacctggatgatcaattcacccattcagtggtgatcgagaccaccaccatgggcccgttgccgcaactgcacgccaggtttgatcatgtgacctccctggaactcatcggcaacggcctcaccaatggtgtcgaggggaccctgcgctgcttccccaaactgcagaccctgatactcagccggtgcaccctgggcaagatccccgacgccatcgcccaaatgcccaacctcacgaccctgagcctggagaactgcgagatcaccctgacgccggcggacacggatgtactgggcaacgcgcccaatcttgagttcctgagcctgagaaacaaccggttggtagtcacgccggatgtcagtgccctgaaccatttgggcgcactttacctgggtaacacccagatcaacgaagttccccgagggctgttccaactccccgagctgtatacgatagacctgagcaataacctgatcagcgacattccggcggcactgctggagtccacaacgccctatagcgacgaatgtgatttcagcggcaaccccttgtcaccccagagcctggaccatttgcgccagtactacgtacgcgccgacaatgattttcacgtagctgaggcgacagtggatgagcaaggcgtccccctggtggtagaaccgccgccgccaatggaggagtgatcaaccgcgttcggaaggcaccgaggacaactcgaaggggctgctgctgcgccgctggttacgatcttcacgcggggtggcgccgaagaagttgcgataggcgctggagaagtgcgggccggaggagaagccgcaggataggccgatctggatgatcgacttgctggtttgcatgagcatctggcgggccttgttcaggcgcagttccaggtagtactggctggggacgcgattgaggtattgcttgaagattcgctcaagttgtcgtcgtgacacgcatacgtgctgggcgatttcgtcggtggtcaaaggttcttcgatattcgcctccatcagcagcaccgcctgggtcagcttcgggtggctggagcccaggcggttttgcagcgggatgcgctggcgctcaccgccctcgcggatacgctccaccaccagttcttccgacaccgcaccggccagctcggcgccgtggtcacgggccagcaccgcaagcagcaggtcgagtaccgacatgccaccgcaggcggtcaggcgatcacggtcccagtcgaacagatggctggtagcgatgaccttggggaagcgctcggcaaaatcgtcctgccagcgccagtgcacggcggcgcggtagccgtcgagcaaccccagttgggccagcgggtagacaccggccgacaaaccaccgatcacacacccggcccggaccagctgcttgagtgcagtgctgagctgggacgcaatgacggtggggggttcgtccgccagcaggaacagcttctggaaaccttcgagcttaccggcccatgcctcgccgggcagttgccaggcacccggggtagccggctcggcgagcaaaaaagacagctcgtagaccacgtccggatgcacccgctgggcgacgcgcaaggcctcctcagccagcgcaagcgtgagtgcttttgtgctgggccaaatcaggaaaccaattttgtgggcggtcatggagtgctatccgaagcgaaaacagtgaaagaagcgtggggcaatgctagcccgtaaaccaacacaaatctcaaaaacaatgacgacctgctctcctgtaggagcgagcttgctcgcgaaaaaccttagaacgccgccgggtatcaggcttcccgcgttatcgttgacgatcttcgcgagcaagctgttctggtcaagtttttccggacaccgattacggtggtcaagccgcctgctgctccatggctattggagacaggtagttattgtagctgtggagcctaattcggttataccgcatgaagaagctggtcatatcctgcctggcttcttcaactgtcgtataacccttggtgggcacccactctgacttgagtgtcccgaagaaacgctctgttggcgcgttgtcccagcactgtcctctgcggctcatgctttgcgttatcccatgttccagcagctcggactgaaagcgctgactggtgtattggcagccttgatccgaatgaaacatcaagcccccatgtttgcctcgaacctccaccgccattcttagcgccttgctaaccaggttggcgtcgttgatcagggaaaacgcccagccaatgattcggcgggcgaacagatcaatgaccgctgccaagtgataccagcgtttcccaaccatcaggctagtaacatcgccgcaccagacctgattgattgcggttggctcaaagttacgctcaagcaggttcttggccacaaatgcttcgacgcctctagagcgatattgatggcggcggcgctgcctgctggccagatttgcctccgccatgagttttccggccaaatgccgtcccaccttgacctgctgggccttcaagtgctgagagatcatccgcgcgcctgcacttccccggctttcgtcatgcagttgcacgacttttgctctgagcgcgtcacgcttggtattgggcgctgagcgacgcttaagccagtcgtaaaacgcgctacgggaaacgcccagcgcactgcaaagcaggcaggtcggatatgaactcgactccctcagctcctcgatcaggaaaaacgatcgggatccgacatcaagagagccgtagccttttttaagatttcagcctcggtctccagacgcttgaccttggctcgcagctgctgcagctctcgctgttcttcgctgattgccttggtaccggccactggctgccctttctgacgctctttacgaacctgatcaacccaacggcgcagagccgtagggccaacctccatcgatgcacagacgtcgggaactgagcagttatcatcaagaaccatgcttgcagcacgttgcttgaactcgcgggtataggtttttcgttcttgcatggaacctcctgaatgggcgaatcatatcgcccttaagaggtgtccgggatcattaggccagttcagctcgctcctacagggttgagtggcagtcttgattatttcaagctgccggagaggaactgctgcaaccgctcggactgcgggttcaccagtacttcccgcgggttgccgcgctcttcaacaatgcctttatgcaagaacaccagctggttcgacacttcacgggcaaagcccatctcatgggtcaccaccaccatggtgcggccttcctgggccaggtcctgcatgaccttgagcacttcgcccaccaactcagggtccagcgccgaagtgggctcatcgaacagcatcacctccggctccatcgccagggcacgggcgatcgccacgcgctgttgctcgccgccggacatatgcccagggaacgcatccttgcgatggcccaccccgaccttggccaagtagtgctcggccttttcgcgggcgtctttcttcgacatgccaagcacatgcacaggcgcttccatcacgttttcaagcgcggtcatgtgcgaccacaggttgaaatgctggaacaccatggacaggcgcgaacgcatgcgttgcagttgcttggggtcggccgccttcatcgcgccgtccttattagccaccagtttcagctcttcgttattgagcagaatcttgccggcatggggctgctccagcaggttgatgcagcgcaaaaaggtacttttgcccgagccactggagccgatgatgctgatcacatcaccggccgcggcggccagggacacacctttgagcacttcatgactgccatagcgtttatgcaggtcttggacttcaagtttgtacatgcggtcggttctcacaaaaacaggtggtcagtcgttgagcaagcgcccgtgacgcagcgcttcgcgccccgccaccttggccagccagaaacccgcttgggcataacgcagccgttcaacggcaaacaatacccctgaggtacccgcgcaaatgatgctgacgcggtcttccagggggtcaatcacttcaaaaatcggctcgccgctttccacccagtcaccggccttacgcaggtagctgatcaccccggcgtggggtgcaaagagcaattcggtgccttcgaagggcacgccctcacagggttcgtgttgcggcgcaggccactcacccttgatcaggccctgttcggcgaggaacgccaggatgccttcggcgtggaagatggcctcatcgcggccggtgtcggcctggccgcccagttccaaggtcgtggccaggcacgccaacggaatctgcgcttcggggaacgcccgggacaaacgcagccaaggcaacgagcacgcctcatcaaacgagctgccaccggagtcttccgccaacaggccgacctttacattcaaatgtgccgacaacgagcgccactgcggccagtgctggggcaatgcgtacatgtgcagcgcggcttcggcatcgcaatgcaggtcgagcactatgtcggcggtacaggcgtggctgagcaggatgcgctgcatgccttgcaactggctgctcggttcgggcaaggcgctgagcgtatcgctcatggcctggcggatcatgcgtacgttggcgtggggatcatcccccagtttgccgtcgagcaaggccgcaacgggctcgctcaactcgacaaaatcacggttgaaattcttgccgctgccgacctcgaaacgcccctggtgactgccttgcagcaactggcccaggcccatgggattggcgaccggcaccagctcgatcacgccattgagggcgccctggcgctcgagttcgtcaaggcgttttttcagctcccaggcggcgcgcatgccgggcaattcatcggcgtgcaggctggcctggatataggccttgcgctcgccgctgccgaagcggaacacgctcagctggcgctcgcagcccagatgcccccagggcaacagatgatcgatacgttccatatcagtgcttccgtggagccaggtagctcagccagcggcgctcggccaacttgaacaggcgcaccagaataaaggtcaggcacaggtagaacacaccagcggtgatataggcttcgaacggcagatagtactgcgcgttcaccgtgcgcgcggcgccagtgatgtcgatcaaggtcacgatggaggccaggctggtggtctgcaacatcatgatcacttcgttgctgtattgcggcagggcgcgacgcagggccgacggcaacaggatgcggcgatacagcttgtagcgcgacatgcccatggccttggccgcttcgatctcaccgttaggcgtggcctttaggctgccggcaatgatctcggcggtgtaggcgctggtgttgatcgcaaaggccagacacgcgcagaaggtcgcgctggacagcagcggccacaggaagctctcgcgtactgtttcgaactgcgccaggccgtagtagatcaaaaacagctgcaccagcatcggcgtgccacggatcacgtaggtgtagagccaggccgcgccgttgacgatcggctgcttggacacgcgcatcaggcccaggggcaaggccgcaagcaaaccgaagaacagcgagatggcgagcagtttcagggtggtcagcaagccgccaacgtacagcggcatggcctcccagatgacgttgtagtcgaagatcatagatcagccgcccttacgcctaccgagtagcgcttctcaagatgacgcaaggccagcaacgacacgctggtgatcaccaggtacatcgccgccactgcgaggaagaaggtaaaaggctcgcgggtggcatcggccgcctgcttggccttgaacatcatgtcttgcaggcccaccaccgaaatcagcgcggtggccttagtcaggaccagccagttgttggtgaaaccggggatcgccagccggatcatctgcggcaccatcacccggaagaacacctggaaactgctcatgccatacgcaaggcctgcctcggcctggcccttgggaatggccatgaaggcgccgcggaaggtttccgagaggtaggcgccaaagatgaaacccagggtgccgataccggcggccaaggggttcaagtcgatatagtcgtcatagccgagcaacggcgcgacgcggttaagcaagtcctgaccgccgtagaaaatcagcaggatcagcaccaggtcggggatcccgcggatcaccgtggagtacaggtcacccagccaagccaaccagcgcaccggcgacaggcgtaacgcgaccccgatcagacccagaacaatggccaaggccatggacgacaaggcgagctgaagcgtcaaccatgcgccatcgaggataacggccccgtagcctttcaacatgattcaggtcctcgaaaagggggatgaaaaaatggcgcaaacttcaggatgactgttgcttgcgccatttcggacagacagctgcgactatttacttggcatcagcgccgtagatatcgaagtcgaagtacttgtcctggattttcttgtattcgccgttggcacgaatcgcggcaatagctgcgttgatgcggtcaaggttttccttgtcgcctttgcgcactgcgataccaatgccgtcgccgaagtatttggcgtcggtgaactgtgggcccacgaacgcgtagcctttgccggccggggttttcaggaaaccgtcctgcagcagggtagcgtcagccacggtgccgtcgagacgaccggcttccacgtccaggtagatttcgttctgcgagctataaggcacgaccgtagcgcctttgggggccaggacttccttggcgaaacgatcgtggatcgaaccgcgctgcacgccgatcttcttgcctttcaattcatccaggctgtcgctgaccgtggtgccttccttcatcgccaggcgcgctggggtcaggtagtagcggttggtgaagtccacggatttcttgcggtcgtcagtgatggacatggacgacaggatagcgtcgatcttgcgcactttcagcgctgggatcaggccatcgaactcttgctcgacccaggtgcacttgaccttcatctctgcgcacagggcgttgccgatgtcgtagtcaaaaccgacgatgctgccatccggcgccttcgaggcaaacggagggtaagccgcttcgataccaattttcagtggcttgccttcggcgaaagcctgcatggacagcacggacagcgccagggcgcccaacagcacgagtttcttcatcttgggactccatcggtatagggcaaaaacagcagtatgagccatggcccacgatgcggcgaaggtgtaaccgaatagcggtgctgcgtcctgcgcaggcgacacctgcgacgacgagcgagtgatcggcattctaacgacagcccggaagccgatatttcctcaatgcgacaacaatttacagaagcactgagaaagcggttccagcacattgacagcctctggattttatgcagagacaaaagatattaaacctgatgatgctgcaaattgcgggcctattattcgcaaacccttctagcacggcaagagtggcgtttaatcttatttatcagggtgtctaaaacgcagtttttaggagcgcaggcgtggcgcaatgcctcaggtttggccggggggttacacatttgcgcctggcggtaacattctgaaacgtcccagaggaaaaaccgatatttattggcttggtggttatgcggtctgacataccaccaacgagtctcgacatggaatacattcaaatgtgggagggggcttgaagatctcattaaaaagccccactcggctcacaccgaatggggctgtgtcccaccaactgcgccttacgcgacgttcatggtcttgtgcgtttcaatcaaatgcgccaccacccctggatcggccagggtggagatatcccccaacccgtcatactccgccgtggcgatcttgcgcagaatgcgccgcatgattttccccgaacgcgtcttcggcaagcccggcgcccactggatcacatccggcgaagcaatcgggccgatttccttgcgcacccagttcttcagttccaggcgcaactgctcgctcggctcctcgccgccgatcagagtgacgtacacatagatgccctgccccttgatgtcatggggcacacccaccaccgccgcttcggcgactttcgggtgagcgaccatggcgctttcgatctcggcggtgcccatgcgatggccggacacgttcaacacgtcatccacacgcccggtgatccagtagtaaccatcctcgtcacgacgggcaccgtcaccggtgaagtacatgccacggaaggtcttgaaataggtatcgacgaagcggtcgtggtcgccgtacagcgtacgcgcctggcccggccacgaatcgaggatcaccagattgccttcggcggcgccttcgatcaggttgcccaggttatccaccaatgccggcaccacgccaaagaacgggcgtgccgcagaacccggcttgagcgcatgggcgcccggcagcgggctcatcatgttgccgccggtttcagtctgccaccaggtgtcgacgatcgggcaacgggattggccgacgttcttgtagtaccagtcccaggcttccgggttgatgggctcgcccaccgaaccgagcaggcgcaggctgctgccgtcggcgccctcacaggcggcggtaccggaagccatcattgcgcggatcgcggtcggcgcggtgtagaggatgttgaccttgtgcttgtcgacaatcttcgccacccgggtgatgtccggatagttcggcacgccttcgaacagcagggtggtcgcgccattggccagggggccgtagacgatataggtgtggccagtgacccagccgacatcggcggtgcaccagtagatttcgcctgggcggtagtcgaacacacgctcgtgggtcagggctgcatacagcaagtagccgccggtggtgtgctgtacgcctttaggcttgccggttgagccagaggtatagaggatgaacagcgcttcttctgcgcccatctctttgggcgcgcacacggtgcccgccactttcatcaggtcttcgtaccagatgtcgcgatgctggttccacttgatcgcaccgttggtgcgcttgcacacgatgaccttctggatgctgctggtttccgggttggtcagggcgtcgtcgacgttggccttgagcggaatcttcttaccggcgcgaataccttcgtcagcggtgattaccaccttcgacttacagtcgatgatgcgaccggccaaggcttccggggaaaaaccgccgaacaccaccgaatggatcgcaccgatgcgggtacaggccagcatggcgaccacggcttcggggatcatcggcatatagatagtcaccacgtcgccgcgatgcacatcctggccacgcagggcgttggcaaacttgcagacttcttcatgcaactcgcggtaggtgatattgcggctctcggcagggtcatcgccctcccagatgatcgcgatctggtcgccacgttcggcgaggtgacggtccaggcaattgtaggaaacgttcagggtgccatcggcaaaccatttgatgtcgacatggtggtcgtcgaacgaggtctgcttcaccgcggtgaaaggcttgacccagtcaaggcgcttggcttgctcacgccagaagccatcggggttgaccaccgactgctggtacatggccttgtaggttgcctcgtcggtcagcgtgttggctgctacttcggggcgaacggggtacagggaagccgcactcatctttcttacctcggtgacatagttgttgttgtatggcccctgttgtagccggggtgggcctatagaaccattcgacgatggtagtaacaagaccctacaaattgccctgctatgccggtttaccgctctggcccgcagcctgtggcgctttgcgggtgactgaaaaaactttgatcgaccgattgttacaaaaaccgtcaaaggtgtttatcaaaagcacgggtatatgaatataacccgcaggcttagaatcacttccgccaaccaaggcactgtgattaacaacgtaacagcccccacgaaggcacgttaatccgaacttcccaacttttaagttacacacgcggcctcacaagggccccgtgacccctttcgccctgaagaaggtaataaagaaatgaaagctctattagttatggccctcagcagcttgtgcgccaccgccgccctggccgacgaggccccgactgagctggctggccagaatgcaccgatcgttgaggactacacctatagcactcacttggatgtggccaaagtattatccatgagcaacatcccggaagtatgcgaagttgtaccggtgaagatggaatatgaagattcacaaggtcatcggcatattcttaattatcacgtgatgggcaatggttgctctaacggataacagcgattcaagttggaagcttattcgccgcaagaaatcgttcttgcggcaaaggctcgattcctgacacccccgcgatcaaactgtgggagggggcttgctcccgataacgtcagccgtcatacccgccttataaagccctacctgtgcccctgccctcccccctacaaaaaccccctcaccacccgtcaaaaatttccaaccccagcaaagccttgcaaacactcgctctggccgaaaaccacgtcattttggcccgcccaagtgaccatccgccgcaacacaaacccaaatttttccctataatacgcgggtaaatcgggcctgcaatatccctttacacagggatgaagagccagacctgaggcatcccgcgcgagcttgcacctactgctgcgcccctcaagcctcacgcagagcacccgtagccctattccgtttaatgcgtgcgctagctgcaacaaacgattccttaagatccaccgcggcctttgggccgtgtgaacacccaaccatccggtttcacacggacacctttgagccctcacgcaggagacgacacgtcatgctgagctgggacgaattcgacaaagaagaagaaggcgaagtagccgccaaaggcgccaacgccggccacgccaccgaagccaacatggaccgcctcgatggtgccggcgccgccgccgccatcgaagcccgcgccgtcactgccagtgattcggccgccatcgtgcgcgccaaggctgccctggacaaactcgacgtcgccgaaggcctcgccgagctggaaggctccgctgcccgcgtcgccgtcgacgaaaagcgcatgatcaactgccgcgccgacctcaaccagctcgtacccttcaagtacgactgggcctggcagaaatacctcgacggctgcgccaaccactggatgccgcaagaggtcaacatgaccgccgacatcgccctgtggaaaaaccccgaaggcctgaccgacgacgaacgccgcatcgtcatgcgcaacctcggcttcttctccaccgccgactcgttggtcgccaacaatctggtgctggccgtgtaccgcctgatcaccaacccggagtgccgccagtacatcctgcgccaggccttcgaagaggcgatccacacccacgcctaccagtactgcatcgaatcgctggccatggatgaaggcgagatcttcaacatgtaccacgagattccatcggtcgccaaaaaggcagcctggggcctgaagtacacccgctcgatctccgatccgaagttcgaaaccggcactgtcgacaccgacaaggaactgctgcgcaacctggtcgcctactactgcgtactggaaggcatcttcttctactgcggcttcacccagatcctgtccatgggccgccgcaacaaaatgaccggcgtggccgagcagttccagtacatcctgcgcgacgagtcgatgcacctgaacttcggtatcgatgtgatcaaccagatcaaaatcgaaaacccgcacttgtgggatgccgagatgaaggaagaagcgacccagatgattttgcaggggacgcagctggagattgaatacgctcgtgacaccatgccgcgcggtgtgttgggcatgaatgcggcgatgatggaggattacctcaagttcattgctaaccgtcgtttgtcgcagattggcttgaaggaagagtacccaggcacgactaacccgttcccgtggatgagcgagatcatggacttgaagaaagagaaaaacttcttcgaaacccgcgtgatcgagtatcagacgggtggggcgttgagctgggattgattcctgagccgaacaacaccataaagccctgacttgctcagggcttttttatgcacgttcaattgccactttttgaagcacatcacgtcaagcacctttcccagaagggttcggatcgcatcaccaatgctgtagccttgtgccccaactgtcatcagcgttgtcaccggtcgagtgatcgggacaccttcaccgaagggctttacgccaaaatcggaagattggcacgggagtagactcctgctgtcacacctgatgcatgcacaaaaaatactagataggaccgaggccaacccgtgaacccagacatgctcgaagccggccccgttgacgccaaagtactctccgtctttgacttcgacggcaccctcacccaccacgacagtttcgtgcccttcctcaagtttgcctttggccccggtgagttttatggccggatggtcaagctggcggtaccggggctgcgctttttggtgcggcagatcagccgggatgagttgaaagcgcagttgatccgcacctttatgaccggggtggagaagagctgggtgcagcagaaggccgaggagtattgccagcgcaattgggcgcggttgatgcgcccggctggggtgttgtcggtggagcaggagttgggctcgggggcggtggtgacgttgtgctcggcgtcgccggcgttggtgttgcagccgtttgccgatcggcttgggatcaagttgattgggactgagcttgaggtggtcgacggggtgttgaccggcaagctcaccgggaataattgccgttgtgagaacaaggtgctgcggcttgaggcggtgtatggggatttgggcgagtatcggctgcgggcctggggcgatacgcggggggatcgggagttgttggcggcagcgcaggatgcgcattttcggcattttcatgcgaagaagaaaaagcggacccggttgcagcggtgatgcgggtgggtggggttggcggggggaccgaagcgatcccatcggagcctcgctaaagctcgacacctcccacatttgatctttggcggggcttagatcggcgcctttaggtccacgcccaaggctgttgcgaaggcttttaccatcgggcttctcggcgcgttgtggcgcaggatcaggttgaacacggtgctcaggtggacctgctccgggcacagtgcgcgcaggcgcccttcccttaccagtggcgcggcgtagtgttccggcaggaagccaaggaagcggccggtgaggatcaggatggcgacggcttcaacctgggaggcagaggctgactggctgtcgtagttgacgaaggtggccttttcgcgatggatggcataccgatgattcaccacctcatagtggcgcaagacttcgggcgtaatatcgctcgcagtgaacagcgggtgtcctacggcgcagtaggcgtgggccttttcttcgtagagcgggaagtagtcgaactcttcacggcgctggtacacgggaacgatgccgacgatcaggcggccttcgacgacgccgcgttcaacttcgtccagttgcgaggcatgtaggcgtaatcttatttttggcgattgccgatgtaagttccccaaagcggcaatcagcggggaattaacgtcagatacggtgttatcaataacgccgacactaaggtcgccaatcagctcattttgagccgaactaagcttgtcgcgaaaactgtccaccgaggtgaataactcgatggacgcttgatacaccaacttgccttcttcggtcagcccgaagccttcccggccccgtgtacacaggcgcatgccgatgcgaatctcgaggtcggagatctgtttgctgatcgccgccaggcccacattcagttcgttttgcgcggcgctgaaaccaccggcttcgaccacggccataaatacccgcagcagtttgaagtccaaaccactcagttgcaggggcggccttgtgccgggtttgggtggcaggtttccagaagtggaaagtggagtttccataatacgcgttgacctcaagtgccatattcaacaggcttcaacccaatccttgaacatagccaggcggcgataatgaacataaacatccgcccttggcaaccatgaatacggcgcgtcagacgctggttctgcatcgctgaaattctgttgttactgcctccgactcttctaaaaacaagcgtgaggaacacccatgtcccagcccaccgaccgcctttggggcgctcgtttcaagaccggtccgtctgccgccttggcggcgttatcccgttgccctgagcgctatttccgcctgacaccctacgatttggccggctcccgtgcccatgcccgggagttgcagcgcgcagggttgctggatgagtcggagaccctgcggaccctcgaagccctggaccgtatcggtgatgatttcgccgccggccgcctgcatccgaccctggatgacgaggacgtgcacacctttatcgaacgtgtattgaccgagcgcctgggagccctgggcggcaagttgcgcgccggacgttcgcgcaatgaccagacggccaacgatttgcgccttttcctacgcgaccatgcgcgcaccatcaccaccgaggtgttgggtttgcagcaagcgttggtggcgcaggccgagcagcatatcgagagtatctgccccggctttacccacttgcagcaggcgcaaccgattgtattcgcccatcacttgctggcccatgcgcagtcgatgttgcgggatgtacagcgcttggtggattgggatgcgcgaacggcgttgtcgcccttgggcgcggcggcgatggccggctcggcgattgcacgccagccagagaattcggctaaggaaatgggctacaccgggccgtgcgaaaactccatcgacgcggtggccagccgtgatcatgtggcggaattcctgtttgtggcgggcatgctcggggtgaatatttcacggctgtcggaggagttttgcctgtggtcgtcgcgccagtttcgctgggtggtgttggatgatgcctacgctaccggcagttcgatcatgccgcagaagaagaatccggatattgccgagttggcacggggcaaggccggccgcttgattggcaacctgaccgggttgatgtcgacgcttaaatccttgccgctgtcgtacaaccgcgatttgagtgaagacaagcacagtgtgctggacagtgtggacaccttgctgctggtgttaccggctatggccgggatggtggcgaccatgaaggtgcaggtcgacgagctgcggcgtcaggcgccgatgggttttaccttggcgacggaagtggcggattggttggcgaaccgtggcgtgcccttcaaagaggcgcacgagattaccggcgccttggtgcaagcctgtgagaagcatgaaattgagttgtgggaagcctcaccggcgatgttggctgaggtggatgcgcggcttacgcccgaagtgcgcgactgcttgaccttagaggcggcgattgcggcgcgcagtggctggggtgggacggcgccggagcgggttcgcgagcagattgggcggttgaaggtggcgttggcggctcagcaggaatgggttgagcgttatcagggattcaggatttaaggcagagagatttgtggtgtttgggctggcgctttcgcgagcaagcccgctcccacatttggaccgcgttacagcagttagagcgttaatagttttggagaatcaccatgaaccaaaccccggccgagcgcttggaaatagagcgcaaattgtccgagaaccagttcgatatcacccagtacgaacacgtgccgcggcgttattacgggcggatgttttttgccacgttgatcgtgatcgtattggttgcgctgttacgcgcattcgccaacggccagatcgaatggtcttacatcgggcaatttctgacgtctgaggcgatcctgtggggcctggccaataccatcatcatgtcgatcctggcgatggcgttgggcgtggtgatcggtgtgatcacggcaatcatgcgcatgtcggccaacccgatcctgcgctacgtggctatcacctacacctggctgtttcgcggcacgccgctgattctgcagttgctgctgtggttcaacctggcgctgattttcccggtgatcgcgattcccggcctgttcagcatcgacaccgtcgacctgatgacgccgttcgtggccgccctgctcggtttgagtatcaaccagggcgcgtatacagccgaggtggtgcgcgccggtttgctgtcggtggataccggccagtacgaagccgccaagtccatcggcatgccgagcctgcaggcgctgcgcaggatcattctgccgcaggccatgcgggtgatcattcctccggtaggcaacgagttcatcagcatggtgaaaatgaccagcctggccagcgtgatccagtattcagagctgctgcacaacgcgcaaaacatctactacgccaatgcccgagtcatggagctgctgatggtggcaggtatctggtacctggcggtggtgaccgttctttcatttggtcaaagccgcctcgagcgtcgttttgcccgcggcgccggcaagcgttcgtaagcctgggttgaggagatttgccccatgagaagcatcgtcaaggccgtcaacctgaacaagtattacgaccagtatcacgcgctgcgtgacatcaatatcgaagtcgagcaaggcgaggtgatgtgcatcatcggcccatccggctcgggtaaaagcacgttgctgcgctgcgtcaaccagttggaaaaaatcgacaagggcggcctgtgggtcgatggcgagctggtcggttaccgggtggtgggcaacaagctgcatgagatgaatgaagtgcagatcgcccgccaacgcctggcgaccggcatggtgttccagcgcttcaatttgttcccgcacatgaccgtgttgcaaaacatcatcgaaggcccgtgccaggtgctcaagcgctcacccaaggaagccatcgaagatgccctggagctgctggcccgcgtcggcctggcggacaagcgcaatgcctacccagtggagttgtccggcgggcagcagcaacgcgtggcgattgcccgtgcgctggcgatgcgccccaagctgatgttgtttgacgaacccacgtcagccctcgacccggaactggtaggcgaagtgctgtcggtgatgcgcgatttggccaccaccggcatgaccatgatcgtggtcacccatgagttgggctttgcccgcgaagtctccaaccgcatggtgtttatggacgccggccagattgtggaggccggcagcccggaagaaattctaataagtccacaaaacccgcgtacccaaagctttatttctgccgttcgcacttaactaaaaaactaacgagaacgcccccatgaaaaagatatttattccttctttgctcgccggcctgatggcttccaccactgtgttcgcagccttgccccaggccatcaaggacaagggcgaaatcagcgcggccatcgtgccgaactacccgccgatggatttcaaggacccggccaccaacaaactcacaggcctggactttgacctgggcaacgccctcgccgagcgcctgggggtaaagatcaagtggcaggaaaccggcttcgagcagatgctcagcggcctgaccaccaagcgcgtcgacatcgtgttgtcgggcatgaccgacacggccgagcgtcagaaggccgtgaccttcatcgactacttcaccagcggcccgcagctctacaccctggccaaacgtgaagaactcaaggaactgaccgacctgtgcggtaaaaaagtcggcaccagccgccgtacgacctggccgtcggaaattaccgcgtggagcaaggcaaactgcgaagcagcgggtaagccggcgattgtggtgatcggcactgaaggctcggcggatgcgcgggcgcagttgcagcagaaccgtttggatgcggcgatgcagggcagcgagaccattccttatctgatgtcgctggataaggggaagtacaagccggtgggtcaggcgatttccaagcaattcaccgggcttgggattgagaagagcaataccgagttggtcacggcgatcagtgaggcattacaggggatgattgacgatgggacctacggcaagatcctgaagaagtgggatctggagcagggtgcggtggaaaaaatcaccatcaattccggccagtaaaccacggtcaaaaaatgtgggagggggcttgctcccgatagcaatggttcagtcacctgacgcttgtctgatgtatcgccatcgggagcaagccccctcccacatttgacccgtattgtctttgagtaataactaggacgctctccccatcgtggccacctattccctggtaatccgccgcctgctgatctgctcggtgaccatcgtggtcagccgcgccatgaccagcccgttgctggccctctggctgagcacacgcctgggcctcgaccagcaggacatcggcctgttgatgggcaccgccgtgttcatcgccacgttgctgggtttgtacggcggctacatcatcgaccgcctggaaaagcgcaagctgctgatcctggccatgctctccagctccatcggttttctgttgctgacctttgccagcaacctctacctcaccaccctgaccctggtgatcactgaagccgcgtcggcgctgttcctgatcggctccaaggcgatcatcagcgagaacctgccggtaggtgatcgcgccaaggtattttccctgcgctacaccctgaccaacgtcggctacgcaaccggcccgatgctgggtgtggtgatcgccggacagttaccctgggcgcctttcctgatcgccagcgccattgcctttggcagcctgttcctgatgatcggcattgcaccgacccaacgggatgacagccataaacctcagagtttcctcagcaccctgcacacgttgcgcaacgaccgcacattgatactgttcactggcggcagcttgttgagcaccattgtccatggccgctacaccctgtatctgtcacagtttttgctggtggcctacaaacctgagcaggcgttgaaaattctgtctgcggtgctggcctgcaacgcgataacggtgattttgatgcagtatcagatcggccggttcctcaagcgtgagcagttgcgccattggatcgtgctgggcaccttgctgtttatcggcgggttgatggggttcagccaggccgacagcctggtcacctggtgcctggcgatgttcgtgttcaccttgggtgaaatgatcatctacccttctgagttcctgtttatcgacaccattgcgccggatgcgctacggggcagttactacggcgcacaaaacctggcagcgttcggtggagcgatgagtccggtgatttgtggctatttgctgatcaacgctgcaccgaccagcatgttctacgcgctggcggcactcaccgccatgggcggcaccctgtgtttcttgagcgggcggcgcgtatcaggttcttgctgatatttagctgggatcccgctattaatagcgaaacttctcacggacccgagcccatgaaattcgacacggcctacagcctgagtcttgatgacaaattgtcgatctacgatgttcgagagctgaatttcgacgaaaccgccgatttcgattccgacaaggacagcttcctctgccccaacgacgtctgccgcgccgcgttcgatgcaaacaatgtgttgagtaccttcaacgccaagaacgtcaactacctgcgcacgccgcacttcaagaacaaacccggcacccggcatatcgacggttgccgctatgccagcagccaaaaaaacgcgacaggtgaaaatgacgacgaacgcgaggacaatttcccatcggaatttgtactgacacgccgtcagtaccaacgtaaaacgcctgttgtcggcatcgatgaaagcgtcccacaagagccaacgaaagcgcctttaaaccgttttacgacatcccacaacgacggcgacacaaccccggacaaaaccagcgtgttcgcccacccggtggagtgctatgtatcgaacatcgatgacaaggacaagctcaaggccatgcccttgaagatcggtgagcacacggcgacctactgggcgtttttcaagaaaatcgaatacctgcaagacaacaagggcttgatctactggggcaagatcaaggaaatcaaagactacaccagcagctttcgcatcgatttcgaaaagaaggtgtggctcgacaagaagccgtactcggtcaacgtctacctgagcaaaaagctcatcgagggctatcgcaagcgcagcgcattcctggagcagatcaaggcggcggccagcagcgaacggccgctgtattgcttcttctacggggttacgccgcaactcaagcaggtgcccagcaagaaaaaccccgagcaaacgttcggggtattcagcgcgaatatcgagaacctggatcacttgatcatccgggaggcgccagggctggagtgacggcggctggaaggcctgcgaaatcgtccagatgatgagcggtataaacaactgtacaaaaacacagtatagttgcgcctcaaccgtcgaacctggagaacccccatgtcctctctggcaatgagctctttcgtagaacagcagatcgtgctgcaccaattcaccgccaaacactgcgcgcaggcccgcctcatgctgggctggagccgcgaagaactggcccgccaggcgggcgtggcggtagaggcgattcaacaattggaaggccacggcgacatcgatgatcaaacccgtttgatcctggcgtttcgcctcgaggctgaagggctggtatttttccccggtttcgcgccgggatggggcatgactgcgcgccggtttgacacaccagcagccgaccccacaccccgaggcctcatgtctcggttgctgggcacaacaacggcaacaactgactcagcaacgcctcaaccgaatggtgcgtagagtcgagccgcagcaccgggcaacgcaatggtttcaaccaggtttcgtgccggcgcaggctgcgtaggctgtgattgccagcatcgtaacgcgccgcccaggcgaggaatgcgacgctgttttggtgacggctgccaccttccaggatctgctcgccgtagcgctccacctcgcgcagtcgcaagcggtgcaagcgaacctcagggtccaggcgcaggaacactacgtgggtgaactgcgggatcatggcgtcgccccagccgcacaaggagccagacagcacccaactttcatggcctacagtgtgttcctgcagtagctgaatgcgttcgtcccggggtcgggcgatggtgaagggttccggggtttgctgccagtaatagaaatccgagtcgaaataggcaatgttcaaatgttcagccagggccttgcccaaggtagtagtgccggctcccgcagcgccgaggatgtggattctgtaactgtccatggctttcccccctggcatggagtgtagccggtggccgcgtcatgcctgcgatggcgaaacggagaaattgaagttaccccttaggcaacctctgcgggcatcagccagcagaggtggattcaaactcacgcgtcagtggcgcagacctcaacagtttcatctgcgcctatcggggccggcgtgaagggagcccctggcagaaaagccggtttctggatcgcttgcgaggctagctcataaccataggcgactgagagcaaggtggcttcgctgttgcccgaaccataaaaatagagtgcggtcggcatgccttcatcatccattccagacggaatcgacaggcctggatagccggctgccgcactgaagaaataattatgggataggaagttcgacaccatggcgtcgagtttgtgttcctttattggatcgtcgacggttttctgaaagatgggaaggatctcctcccacaacttgtcgcgctgttccgaagtcgtttccaggttgttgatcagttccaacagcttctggtcaggctcaccgggctgctggttgcgcttgataaaagcaatcagctccgaaagtgatttgacaggcaaaccttctcgcccagccaggtagtcttccagttgttgcttgacctctgcgaacagcgcttcggtgtaacgctcgtaggtctcatcagcgacaccctcctccaacggcctcaccggcaccaggatcgcaccttggtccttcaacacatcgagcgccttttcgtaatgcttgcgatctgcgcgtttggccgggtccttggcctcctcctcggacaattcaggcaaaggcgtgtagccaattcgcttacctttcagggcgtcggcatgcaggccatcggtataggcattggttccggtcattgcgttgagcgcttccgccgcatcacagacattacgggtgaaagtaccgatcgcatccaggcgtgtactggtcatgacgccctcggtactgagcagtcctaccgttgttttcagaccaaagacgccgttgtaggctgctgggctgataatcgacccgttggtttccaaccccaaggccaaaggcacatgcccttgggcaacagcgactgctgaacccgaactagagcccgccacctgccctcccaggcgatgcgggttcagcgtctggccgccgcgggaactccacccatcagccggcgactcagagcgaaagttggacaactcgctcatattggttttacccacaatcactaccccggccttcaacaaattgtcgacaaccttggcgtttctagttgcaggcgctccaaccaaggccttcgagcctgcgctggtctgcatgcgatcattggtttcaaatacatccttgagcgctatcggtacgccgtgcaaatgcccacgcacgtggccgttggcacgctcctgatcacgcgccttcgcctcacggagagcatccgggtttgtttccaaaaacgcgttgccgccctgtagcccacgatcaatgttggctatttgcttgagcgaatctttcaacagcgactgcgcggtgacaccgcttccctgggccatttccactgacatttgacaggcgctcttaaagccttgcggtgggtttgaaagctcctggaacaagcctgtcccccatccgcctgccgacacgggtccgatcatgaagtgcctctctacgtgactgagtatgagggttatcggtcgataaccccacaccagtctaagaagcgccgcctgcgcactgtttcaggcgaatcctgccacgccgtcctatcattccccgtctggcgtaggctccgatagaacctttggacgtaggtcgcggtaagcgcgcaacagggccgtcaagcgatcacccgcccaacgggcgccgtaaaaccagactttcgatccatcctccaatgtttcacagatactgggatacccgcttctgcacgcgttatgaaacccagcattcggatcgtttgacaccaaggcatcaagacgaaggccagccaccagctcgtcaatttcgcgacccgcctggccgctgtcgctgtcgcgctgcacgtctaccgccacccattgcgcaccggcctggcgcaaggtgtcgaagactcggcgcaaggctgcactgtgttcgacgagttcagcctgcttgccctgcacataacgttcggcgtagccgagacgataccccgccagctccagtgaagcggtgaatgtggtgttattcaataccaggggaacctccaccatcaccggttcagtagggtctatgccactgatggcgataagggatagcgcggggtcacgcaccgggtttatctggggggccagggcgttataccctggcacaagtgcagcgcccgtgcgttgcccggcaccaaaaacgatagaaaccggagcggcgttgaacaatggggcagtaacgtcggcagcgttgacgggcacgagtgaaggctggccgatggcgcaaggcaaacccatcttccaaagtttcttacaatggctatccatcgaaatatcctccccgaaataaaatttccggagatcatcgcaccctcgtctgacgcttgtcgcagggctgaaaccctctgaaaagctcttttccttaatccacttggctcagcctggtgcccgctcctgcacaagttgaggctccacctccaaccaccaggcatgcccacgctcgggcaggttcaagcggaacgcctgccccatcgccggggtagtgatcgatacgttgcgttcccaggccagggccatgatgcggtcgaagggttcgtgccaggcgtggaatgccaggtcgaaggtgccgttgtgaatcggcagcagccagcgccccttgaggtcgatatgcgcctgcagcgtttgctccggctgcatgtgtacgtggggccaatcgacgttgtaagcgccagtttccatcagggtcaggtcaaacggaccgtattgctcgccgatgcgtttgaaaccgtcgaagtagccggtgtcgccactgaaaaaaattcggcgcgcatcgtcgatcattacccaggagcaccacagtgtctggttgctatcaaacaggccacgtccggaaaagtgctgcgccggggtggcgataaaacgaatgccgtccacctcggtgccctgccaccaatccagctggcggactttgctggcgtctactccccatttgatcagcgtatcgccgacgcccaggggtgccaggaagtagtttgtcttgtcggccaattggaccacagccttatggtcgagatggtcgtaatggttgtgggaaagaataaccgcctcaaggggtggcaactcttcaaggctgatgggcggttggtggaaacgcttggggccggcccaactgaatggcgaggcacgctcggcgaataccgggtcagtgacccagaatttaccgcgcattttcagcaatacggtcgaatgcccgaggcgatacacgctgtgatcaggggcggccaacaactgttcacgggtcaggggctgcaccggaatctgccccaccggccgtgtagtacgcggcttgttgaacagcatgttccagaaaatacgcagggtcttgcccaagccgccgtgctgcaccggggcgtcattgctgaaatgcccctggccctgcgcggcaggcttgagcgccacaggcgcagggtcgagacggtttgaaatcgtggccattacagagtgactcctacggtccgctcaagaattacactgcacagtgtagtttctagattgcaacaaaagccggagcaagtaaactgccgagtgtaatttccattttgagtcgaatgctatccatgactgctcccaagcgcctcaccgagcgtaaacgcgaagccatcgtggctgcggcgatcgccgaatttcgcgagaacggcttcgaggtcaccagcatggacaaaatcgccgccactgccggtgtttccaagcgcactgtgtacaaccacttccccagcaaggaagagctgttcgccgagattctccaccagctatgggccagcagcgttgcgcaactggatgtgaactacgccagcgaccgccctttgcgcgatcaactgcgcaggttgctggaagcaaaaatgaagatgatgtcggacaccaacttcctcgacctggcacgtgtggctatcgctgccaccatccattcgccggaccgcgcgcaagacatggtcaaccgcctgagcgcgcgagaggaaggctttacccaatgggtacgcgccgcccatgacgacggccgcctcacctgtaccgacccggctttcgctgcccaccagatccagagcctgctcaaggctttcgcattctggccgcagataaccctcggccagcccaccctcgacgctgccgcccaagccggtgtcatcgagtcggccatcgacctgttcctcgccggctacgaagtcagcgcgccacgtgcgcactaagtcctgttgcatgggcgacattccaagtcgtatttggcgcattcacccgctgttttgcgcaaatggcctagaaggacactgattattcccacaggaataatcgacaatcgctcgcattttcccatcagcggttccgcccgctgacgcatgcgactgtacccgcacaaaacagctgacccaggacactatggaaaacagacgaggcaaagggctttcatttgccaggcgtatctacaagccaaggattatcggccttggcatcggcagcatcagcgtggttggcgcgttgtaccccttgtccatgcccgcttgggtctgggcgttgctgttgttcaatggcttggcctgggcgcatgtggcgtaccagctatcaactcgctcgccgttcccctaccaggccgagcaacgcaacctgttgtatgactcgttggccggcggtttctgggcggccgccacccagttctcaccactgacaaccgtcaccatcctgtcgatgatggccatgaacaatgtcgccgccggcggcaaacgcctgttcctgctcgggctgctggcgcaggcggccggtatcgcggtggcctggggcctgttcgggatcaagttcgaccccggtgtcagcctcattgaggtctacacctgcttgccgatgctgacgctctacccgatggccatcggcatggtctgctatcagctggcgattaaactgtcggaccataaacgcgccctcagcgccctgagccgcatcgatagtcttaccggcctgctcaaccatggttcgtggaaagacctgctcaatctcaaattccataaatgccagcagcaacaaggccaggcgaccatcgccttgatcgatatcgatcacttcaaaaacatcaatgacatccacggccacaccgtcggggatacggtactgcgccagttgagccacgagctgcgccaacacctgcgggcagacgaactggccggccgctatggaggcgatgagttctgtgtgatccttccgaggatgccgctggaagaagcggcgcaagtcatggagcgactccgcgaaactttcggtaactatcgccatccgcaaatccctgagctgcgcgtcagcctgagcattggcctggcggacttccattcctctttcaacgatgcggtcgcgtggctcaacgccgcggatctcgcgctgtatgccgccaaagacagcggccgcgaccgcgtcaagaccagcgactggctagccacctatccagcctgagttatccgataacacctcgtccgaatctaacgccgcccacctgccgcaatagcataatgccgccattggtcgcctgcccaataatggtcctgcccaacgggcgaacttcttggcaggctgattactctgagaccgttgttcccccccctctgtcagcaccaggaagctggcaatgagcaagtcaaccgtacggcccggagccctacggggtcaggcgcaaatacatggatatcgcatatgcttgcatgcccgagctctctaacatgctattcaacgcccacaagaaaaccatcaacgccctgcaacaccgtattgcccaacaagccagcctgctggacgcgatcgaacgctccatggccgtcatcgaattcgacctgcaaggcaacgtgctgcgggccaatgacaacttcctcgagaccatgggttatcgcgccgaacaaatcctggaccagccccatcggatgttctgcacgcccgcattcgcccgcagcgccgagtacaaccagctgtggacgcacttgcgcaacggccaattccagtcgggcaccttcgaacgggtgggcgccaatggcgcatcggtgtggttggaagccagctataacccggtacgggatgaagccggtcgcgtgattaaagtggtgaagtacgccatggacgtcaccccgcgcctgcaggccgaaagtgaggccaacgccaagcttgcagccatcgaccgcgccatggcgatgatcgagttcaacctcgacggcaccatcatcagcgccaacgcgaatttcctgcagcgcatgggttacagcctggcgcagatccagggcaagcatcaccgcctgttctgcaaaccggagctggccaacagtgccgcctacgccgagttctggaatcgcctgaaccagggcgagctgttcaacggccagttcgagcgagtggataaaaacggccaggtggtgtggctcgaagccaactataacccggtgtacgacgccagcgggcgcttgtgcaaagtggtgaagtttgcctcggatgtgaccgcccgcgtgcaacaacatgccgctgatgcacagagcgcggcacaggcttatcacctgtctttgaacacccaggacatggccgaaaaaggcgccgaagtgattcagaaaacggccagcggcatgcgcgaaatagctcaggatatcgacacctcttcgcaactgatcgccaaactcggcgagcgctcgcagcagatcaccgccatcgtcaataccattcgtggcattgccgaccagaccaacctgctggcgctcaacgccgccattgaagccgcccgcgccggcgagcaaggccgtggctttgccgtggtcgccgatgaagtaaggcaactggcggcgcgcaccagtggctccactgcggagatttccgggatgatcgccatgatccaggaagaaacccgccaagccatcgacagcatggacgccactcgcgaccgcgcggctcagggcgtagacctggccaaccaggcgggcacggtgatcctgcagattcgcgaaggcaccggcgaagcggtgcaggcggtgagcgcctttgccaatgagcggggcaatcgctgaccggttattcatgtgtgtgcctggggggctcggtctatagtgttggctgtctttacgccaaggatccgagcccgccatgaccccagacaagccagacgccgcccccactgaccacctgcgtttccaccgaggtcacgcgcacctggcaccgaccttcggcaacgacacttttgccctcaaggccgaggcctttgcgcgcttttttggcaccccgaccttcctcggcgcacaaaccgcgatcgtggtgttgtgggtggtgctgaacatgaccggcgtcactcactttgacgtctaccccttcatcctgctcaacctggccttcagcctgcaatcggcctacgcggcgccgctgatcctgctcgcgcagacccgccaggccgcccgggacaaagcccagtccgacgccgacgcgcaacaccgcgaagccctcgccaccgccaataccgaacgccaggcccaggcagcacaaaccaccaagcaactgatggaactgttggagcagaacacccggttgacggaaatgaccaagcaactgaccgagcgcatcgaaaccctgacgtgtgaaatgcatgaacagtttgtgcgtaaagcctaagctcgcaacccgcgcacatgccgccccaactcatcaaacagcgtcaccaccgaacgcaacgcccggcaatccgggcgcgtcaacagccacagcgcggtgtcgtgccccgccaacgcagggcccagtggtagcaagccatcgcccattagaaaatccggcaacgccgccacgcccagcccggcacgcaccagttcagtcaccgactgcatgctgttgcagcggtaactggggcgcacgcccggcaaatgctcacggcgccaggccacggtggggtggtcgggcaaaaagtcatccggtgcgatccaggccaggtcggccagatcctgccctgcatgccgacgggcgtagtcagcgctggcacacacttggtacgtcacggtccccaggcaacgtccgaccagatgctccggcggcttgctggtcaggcgcagggcgatatccgcatcacgccggctgaggttggcgaagtcattggatgtgctcagttccagggtcaacgctggataggccggcatgaactgcgccagggccggcagcagcaagccttgtaataccgcgtcggtgcaggtcaggcgcacggtgccgctgattacctcgccgccctgctccacccctatgcgcgcagcctccagtgcgagttctgcccgttcggcctgttgcgccaggttgctcaccaggctggtgggcaagtaaccggcgcggcttttttcaaacagggtctggcccagtgccgcctccagccgccgcaccgcacggaataccgtggacacgtctaccctcaacaacgcagccgcccgcaccagggtgccgccacgcaccagggcaaggatcaatgacaggtcggggtagtcgatttgatagtgcgtggctgcattgagcatatgggcaaacgccaatattgattgcgtgaacgccaatctatagtgcgtatcagcccactacaagccaagggacgtacacgatgacaacccccgctctgcacctcgccctgatcggtgactacaaccctgatgtgatcgcccaccaggctatcccgctggctctgcagcaggccgccgccgcactggacctgagcgtccatgtgcaatggctcgacaccgacacactcacctgcacctctgccctgcacgggtttgacggcttctggtgcgtaccggccagcccctatcgcgacaccgagggcgcactgcgggcgatccgttttgcccgcgagcaaaaacgccctttcctcggcacttgcggtggctttcaacatgccgtgctggaatatgcacgcaacgtactcggctgggcagatgccgagcatggcgagctggccccggatgcagaacgcgccgtcatcgcgccactgaactgctccctggtagaggtgaacgacaccgtgcgcctgtccccttacacgcacattgcccaagcctacgccagcgtggacatccacgaaggttatcgatgccgctacggcatcaatccaacgtttgccgacgcgctgctggcaggcaacctgattcccagcggtcatgattcggcgggcgacctgcgtgcggtggagttgctcgaccatccgttcttcgtcgccaccctgttccagcccgaacgcgccgcgctgaagggcatccccccacccttggcactggctttgctcaaagcttgccgaggggtatcggcatgatcgccaagacacccgccccgccttattacgcggtaattttcagctcactgcgtaccgacgccgacctgggttatggcgaggccgccgcacgcatgctggaactggcacagcagcaacctgggtttctcggcgtggagtcggcacgggaagaggggttgggcgtcaccgtgtcctactgggccagcgaggcagcgatcctggcgtggaagcaacaggccgaacatcgacaggtacgtgagcaaggacgcgccacctggtacacagcgtttcatacacgggtgtgcaaggtggagcgggcctactcattctcaaattgagaggtttccatccggtaaaagcgcccgggcaggttgatcggtcagctcaccaaactgcgcaacgcactgatctgcgggatctccacccgacgcatgtacacccgcaacggttcggtgatgttgatgcggtcatcgatattctgatccagcagcaactgtatgcgtgcacggcacagggtcatggtgtggtcggcggcgggcagccagacgaattcggcggtagggataatgccgtcatcggccacgtccatgccgaaggcatcttcgctgaaacgcacgatgtactggccggtcttgcgattgaggccgacaaagccatggagttggtcggcggcttggcagataagctcggaagtgatgcgcatggtaaacctcactgaaaagtcccacagggactggaaagatggtttacacgcgtggcaaaaaataccgccctctagtggggcagctacggccaagaatactgcaatgtccccaaaaaaaaccgacaaaattggactgcgcgcacgttaatgtcggtttggtgatagcgcctttcgcaatcaattgttaaaaaggacgtcttctcaaagctacctccacgaaaggacttcgcatatgcctgtcacgtttaccaagagcgccttgctgctggcgttgatgctcggcctcggccaggctcaggctgccgacccagtcagcccggctgaattggcgacaaacgaaggcattccctaccctgccgtaatcgctcaccgtggcgcttcctacgacgcgccggagtccaccgccgccgcctacaaagttgcacgcgacctgggcgccgactatttggaactggacctgcaacgcagcaaggacggcgtgctgtttgccctgcacgacaacaacctgcagcgcaccaccgacgtggccaccaagttccccgagcgcaaagatgcgccagccaacgaattcacctggaaagaactgcaaagcctcgacgccggcagctggttcaacgcggcctacccggaccgcgcgcgtccaggcttcgtcggcctgaaaatcctcagcctggacgacatcatcaagatcgccgaaggcaacccgtcgcacaaacccgggctttacatcgagaccaaggagcccaagcaattcccgggcatcgaagccgacctgaaaaacaagctgctggacaagggctggctgagctccgccggctccaagctgggcaagagcaacaccggtgtcggccagggcaagggccgcgtggtactgcagaccttcgaggtttccagcctcaaggagctgcagaaggaaatgccgaacacgccgaagatcctgctgttgtgggtcggcgaaggcagcatcgaacccaaatccaaagtgaccttcgccgaatccggtgaaccgaccaaggccgcctactacgccaagcaagagccgaaggatgccgccgagttcgaaaaatgggtcgaccaagccaagagcctcggcgccatcggcaccggcccgtcggctgagctgaccgaccacggcgaccagagctataccgacctggtgaaacctgaaatgaacaagctgacccacgacaagggcctgctggtgcatgtgtacaccgtggatgagccggtggacttcgacaaagtgatgaaggctggcgtcgacggtatttttaccaaccgcgccgccgaactgttgaagttctacaagcgctggccgtcgtccagcgtgcaggacctgctcaacgaccataagtactgagtgaagcccgaatggtcaggccgcctgtggttggggcgtgaccacgggctggtgctcggcgagctggggcgcaccacgccccatgcacactacgcacaccaattgatgttctgccccggcgcaccgatcacggtcagccttgatggtcatgtcaccacggcccatcgcctgtttattccttcgcgtcacaaccacgccatccttgagacagagggtgaggtgtgggcgttgtatgccgagcccatgatctttgacatccagccattgcagcaactgctggcagacggcgatttatccccgcaggccctgctcaggctgccccgacgacgccttgacgacccacgtatcgaacgcgcactcgccgcccttgatcagcaactggtcggcaaggtatcggcccaggcgttagccgcagcggcgcatctgtcattgagccaactggagcgtctgttcaccgatcaactgggtgttcccatacgtcgcctcgtattgtggcggcggttgcgcattgccctgcaactggcccttaccggcagcacactgactgaggcagctcatggcgcggggtttgctgattcggcgcatttttcgcggacgatgaagcacttgttcggggtgacggcgggcgcgtccttgcgccaactgcaagtacagttcctaacgtaggtcgcctggcagcggcggctccttggccaggcgaactgccaggaacgggtcacgcaactgagccgcataggccacggggaattgcggccgactgccaatacccaaatcccccggccctatgcgatagcctttgcgataaaacgccgtgcccagcagccaatcccacaaattgaagaaaaggccgaaattcacatcccctgcacggccgtatttcatgtggtggaaccgatgcaccggcgcccaggcgaatacccagcgcagcggccccaggcgcatatccacattggaatgttgcagcagcaactgaacggcgatggccagggccaacaactgcgcgacctccagcgggatccccagcatgatcagtggcagcaggccagccgttgcttccagcaactggtgcaaaggatgtttcatcaaaccattgaaaccataaagccgctgcacgctgtgatgcaccgcgtgcaaccgccacagaggcgcgatgcggtggctggcgtaatgcatcaaggtgatcccggcatcggccaggaagatcgccatcaacagttgctcccacagcggccagcctcgtggccatagcccctcgaatgccagcagcgccgtaaggcccggcaggaccaacaaacccacaacattcaagctttcgttgatcaacgcatgcaacgtatcgcgccagcgatcgccaaggctgcgattccactgtggctcgtagggcagccatagttccaccacaaacgacaccgccaccgccaccgcgaatatcaccagtagccatcggggctggtaaagcccccatccgacaaaccccaacaagcatgcgggcgcatagagccaactgactaaccgtttcatccgagtctcccttttttggtgaggcctcagcatgaaatcctgcatccgtcttggattgaataaactgcgcaactgtttgaaataattaagcgtgagttaagttgcacgggataacctgaggccacttaaacagctcaacccagaaggacacaccatgaaaactctgactgcctttttcgctgccactgccctgaccttgaccgccggcctggcccaggccgatgttcgtccggatcatatcgaaggcctgctcaagtccggtgcggtgatgcctttcgacaaactcaacgctgccgccgtggctaaacacgccggtgccactatcaacgacaccgagctggaccacaacaacagcggcgtgctggtctacgaagttgaactgaccgataccgccggcaagcaatttgaagtgaagctcgacgccaagaccggcgctgtgctggaagacaagctcgatacttgagaccacgctctacaaaacaagcgccaccttcgggtggcgcttttttttgcgcagtacgaaaccgtcacataaccgtcatcccaccttgcaatgattcgcgcctgggtgcctgtgaaacgtcctacaggccctttctctgcgagccgccatgaaccacagcatcggccacgcccatcaggatcccgacctgtttggcctgctttacggtttccgttttcgccctggcgaaaaaggtcagcagattgactcagccgccgccctcgctgccttgcagcagccgcaaaacccggaagagttcctgtggctgcacctgaacctggcccacgctgcctgcgagcgctggatgcaggcgcacctgtcgctgccggaggagtttttcgaagcgctgcatgaaggctcgcgctccacacggattgaacatgtggattcggctttgctggccgtggtcaacgacgtggtgttcaacttcagcagcatggtctcgtcggatatttccacgctgtgggtgtgtgcccgcagccgcttgctggtcagtgcgcgcctgcaaccgttgcactcagtggataaattgcgctcgtcggtgaaagccggtgaacactttcgctcgcccctggaactgctggtgcacctgctgcgggaccaaggcgaagtgctgacccagatcgtgcgcaagaccagtatcagcgtcgaccatatcgaagatcagttgctgtcttcgcgcctatctaccaatcgcgccgaactgggcgccgcacgccgggtgctggtacgcctgcaacgcctgctggcgctggaaccgggctcgctgctgcgcctgctcaaccgcccgccgcaatggctgcaaaaggaagacgtgaaggagttgcgcaaatccaccgaggaatttgcgctgatcatcaacgacctgacggccctgggcgaacgcatcaagctgttgcaggaggaaatcgccgccaacctcaatgagcaaagcaaccgcacgctgttcactctgacggtggtaacggtgctggcgctgccgatcaatatcatcgccggcttttttggcatgaatgtgggtggggtgccgctgtcccaagacccggaaggtttctggatattggttgcgctggtcgcgacttttaccttgattgccgggcgctgggcgttccgaaagcgcaaagactactgacctgaaatgcggtcaaaatgtgggagggggcttgctcccgatagcggtgggtccgtcaataatttattaactgacactgcgccatcgggagcaagccccctcccacattggttcttctgcgtttggtagaccggcggtgcactcaatttccgaaaacactgacctgccgcagcatcgctgtaatattttgcaatgatcattaaggccatcctcctcacactggatgctccggcatggccaccccttccctgactgcctccccccacgcttcaccctcctccaaaccccggctggacacaaaaccaggcttgttgacggtgatcatgttcttcgccgtacttgccatgggtctgttgttcaccgcttacagcctgatgcacgatatgcacgaaatgggcgcccagctcactacctggacgccgttcctgttgctcggcgtggcgctgttgatcgccttgggttttgaattcgtcaacggtttccacgacaccgccaatgcggtggcgacggtgatctacaccaactcgttgccgccgcagtttgcggtggtgtggtcgggctttttcaactttctcggagtgttgctttccagtggcgcggtggcgttcggcatcattgccctgctgccggtggagctgattctgcaggtgggttcctccgccggtttcgccatgatcttcgccttactgatcgccgcgatcctgtggaacctgggcacctggtggctggggctgccggcctcgtcgtcccacaccctgatcggctcgatcatcggcgtcggcgtggccaatgccctgatgcacgggcgcgacggcaccagcggtgtggattggagccaggcgatcaagatcggctatgccttgctgttgtcgccgttgatcggcttcgcgtttgccgccttgctgttactggccctgcgcgccttcgtgaaaaaccgcgcgctgtacaaggcacccaaaggcgacacgccgccgccctggtggattcgcggcatgctgatcgccacctgcactggtgtgtcgttcgcccacggctccaacgatgggcaaaaaggcatgggcctgatcatgctgatcctggtgggcactttgccgatggcctacgcgctgaaccgcaccatgccggccgaccagtcgctgcagttcgcagcggtcgcggaagtcactcaggttgcactggtcaaagcagcaccgcagccggcaacgggtgactctcgcgccaccttgtcgacctacgtgcgcaccaaggaagccacgccggaactggtgcccgccctcgccgccctcaccggccatatcggcgaagaagtgaaaagctatggctccctcgccgccgtaccggccgaagccgtcggcaacgtgcgtaacgacatgtacctgaccagcgaaaccattcgcctgatggacaagggcaaggtcggcaacttcgacgccgatacccaaggcaagctgcaactgttcaagcaacagatcgacaacgccacgcgctttatcccgctgtgggtgaagatcgccgtggccattgccctgggcctgggcaccatggtcggctggcggcgcatcgtggtgacggtgggcgagaagatcggcaagacccacctgacttacgcccagggcgcgtcggccgagacggtggcgatgctgaccatcggcgcggcggatatgttcgggctgccggtatcgacaacccatgtgctgtcttcgggtgtggccggaacgatggtggccaacggcggggggttgcagatgaagaccatccgcaatttgctgatggcgtgggtgctgaccttgccggcggcgattttactgtcgggtagcctgtactggctgttcacccaactgttctgacacacacacagaaggtcaaaatgtggggggcttgctctctgtaggagcgagctcgctcgcgaaaaacgccaacgataacgcgtgttttctgaatgaacacggcaactgtgagtttttcgcgagcaagctcgctcctacaggtagtagggcgtgcccccccttggttttgtgcttcttcagggtgtaaagagtccagccatcgccttcaggcgcttcttgtagacccgccgcgcctccaacgcttgctccagtgtcaccgccacaaaccccgcccgctggttaggctgcatctgcccgatcaaatccaggtcggcgctgatcaccgtgccaatcatcgcgtagccaccgcccgacaccgcatcgcggtgcagcacaatgggttcaagcccggcaggcacttgaatcgagccaatcgggtagcaactgtcgacgatgttcgatgggtcggaaccggcgccaaacggctgctcccgcggctgaaaactcaacgcgctgccgcccttgaagcgatagccaatgcgatccgcctcagagccgaccgtccacggttcggcaaaaaaactgcttttcgccccgtcggtcaaacgctcgtaatacaggcccggcaccacgcgcaaggtcacatcgccgcccaccgaacgacgcaacgccatcggcaagctgttacccgcacgtccattaccgctggccttgccgatgggcaactggtcaccctcctgcaagcgccgcccgtgaaacccaccgagggcgccaagggtataagtggagcgactgccgagcaccaacggcacgtcgatgcctccggcaacggcgaggtaagtacgcgcgccggccttgggaaactcaaagcgcagcacctgcccggcacgcacggcgaaggcggtgtcctggtgcacaacttcaccgtccaggcgcggcgacatcaaggcgccgctcaacgccaccaacgcgtcctgctggaactccagctcaggcccgatcagcgtgcattccaggccagccgcacccacggggttacccaccaggtggttggccgcgctcagcgcgtactggtccagcgcccccgagggcggaatgcccaggtggtaatagccttcgcggccgaggtcctgcacggaggtggcgaggccgggtttgaggaccttgatcatgccagcgcctcctgcagggttttcggatagccgatggggtcgtcaagaaacgcatcgagggaaaactccaccgggcggatgcgcaaatcgaaacgccctgcttccacctcggcgacggccaggtcgtaagcctcacggtccatcggcttgaactgcacgatatcgccgggccggaaaaacaccatgtgttccttgaggtacgccagttgctgggccgggtcgtagatcggtgcaggggtgacgccaaacatctggtagccccccgcgccgcgcaccgagtagatacacccaaagcagccgccatggcccagggtcaacttgggcgtgtcggtgcgtggccgcaggtacttgggcacttgcaattgccgctcgcgctcgaccatttggaacatgaacggcaagcccgcgacaaagccgaccatcgacacaaaccacggtgcgccactgtgggcggcgataaacgcgtccacgtcggccaggccattgatgcgtgcggcgtactccaggtcagtgccgctggggtcttggtggcggtcacgaaagcgcatcagggtttcgtgggtccaggggtcgttatagagcaccgggatttcgatgatgcgcgtgtgcaaggtgcgctcggtcacggcctgggcctcggcgctttgtaccgcgtcgagcagtacatggggcgcgatgcggtcggggtcaaaacgaatctggaacgatgcattggccaggcacacatccagcacgccttccagtgccatacgctccacggcgcgggttaccgccatgcccttgaaaaaggcctgcagggacatgctgtcgctgacctcggcaaacaggtgttcatcagcgccgaagctgtagcggatgggggacatttcagccatgtctgttcctcttagaatcattgtagaaaggcaggcaaaaaagtgatgaggcgttcttattggggtggcctgacgtcgatgcccgcacggtccaagacttctcgggtcgcttccacaagttccagggcaccaggggtgtcgctgtgcaggcagatggagtcgaattcgatgaacaggtcttcgccttccacggtacgtacaagcccggtctgacaggcacgcaggacacgcgctgcgacagtggcagggtccagcgcccgaacctggcgggtaaagacgatggagccgctcaaatcgtactcacggtcggcatagaactcgcgtaccacaggctggcccagttccttggcaatgcgccagatcaccgagttgggcatgcaatacagcaacagcgtcggctcgagaacctgcaggttctgcaccagcagccgtgcggcttcttcatcgcgagccaggtgcatgtagagcgcgccatggggcttgatatgttgcaagtggacgccttgggcacgagcaatttcgcgcagggcgccgagctggtagagcatgtcgtccaccaactcctgggccggtgcattgatatgccgacgaccgaaacccaccaggtcacgaaagcccgggtgcgcgccgatggccacccccagttgcctggcgcgctcgacggtgcggcgcatggtgccggggtcgccggcgtgaaagccggtggcgatgttggccgagctgatataggccatcagttctgcatccacgccgtcgccgatggtccaggggccaaagccttcgcccatgtctgaattgaaatccactgcctgcatcgaggttgctccgccaaaggtgatgccaggaaagtaggctggggcttgaccccttgggaagatctattatcagatgacccatcttctgaaaatcagatatcacccatgtccctcaccttgcgccaggttcgctacttcgtcgccactgcggaaataggccagatttcccaggcagcaattcacctgaatatttcccaatcagcggtgactacggcgatcaaggaattggaagccatgctcggcgtacagctgttcgtgcgctcggcccagggtatgaacctcactgacgccgggcggcattttctcaaccgcgcctacgtgattgtgcgcagcgtggatgatgccctcaacagcccgttaccggactaccgcgccagcggcgtattgcgcgtagcggccagctacacggtgctgggttatttcctgccgcaccatctgcagcgcatggaacattggcatccggacgtgaccatcgaagtgttcgagcaggaacgccaggccatcgaacacggcctgcttgacggccagttcgacatggccgtggtgctcaccgccaacctcacccacgcggatatcgtctctgaaatcctattcaactccgaacgccgcctatggctgcccagccatcacccattgtgcgaacgcggtgccgtgagcctggcggatgtggcgcaagaaccgtacatcctgctgaccgtcgatgaggccgaacacagcgccatgcgctattgggaacaggccgggcaaacacccaaggtgcgcctgcgcaccagctctgtagaggcggtacgcagcatggttgccaatggcagcggcgtggcgatcctgtcggacctggtacaccggccctggtccctggaaggcaagcgtatcgagacactgaccgtgaccgacccggtgacgcccatgagcgtcggcctggcctggcaccgcgagcgcgcattcaccccggcgatgcaggcgttccgcgattacttccacgatgcattcctggcgccgcagcagttgtcggcgcgccgttaaagatgggcttgcagggtggcagtcagccagtccatgaacacccgcacccgcagcggcaaatgccgctggccggcgtacagtaaatacacgtccagaggcggtgcctggtaatccggcagcaccgccaccaagtcgccgctggccaatagatcgcggatccccagttggggcacctgggtaatgccaaacccacccaggcacgccgactggtacgcatcggtgctgttgacggtcacccttcctgccatcggcaaccgttgcaccttgttgcccaccatgtattcaaaccctgccgagcgtgcgcccaggggccgtacgtaatgcaccaactggtgatttgccaggtcagccagagtctgcggcacgccataacgttgcaggtacaccgggctcacgcagttgaccatcggcatgctgcacacccgtcgcgccaccacggtttgatcgggctgggccccgacgcgcacaacacagtcgaaaccttcggcgatcaggtccacctggcgatccgagccgctgatctccatgtcgataagaggatggcgtgccatgaatgtgggcaagttcggcaggatcaagccccgcgccatgacattgggcatgtctacccgtatgcgcccggccaattgggcttcgtcctggcggaacaaaccttccagctcttccatatgcgccagcagatccttgctgcgctcgtacaacacacgaccatcctgggtcgcctgcaccttgcgtgtggtgcgttgcagcagccgcgcaccgagcagttcctccaacgcctgcacgtgctcagacaccgtagagcgcggcaggcccaggctctggccggcctgggtaaaactcgacaactcagtgacgcgcacgaaggtgcgcagtaactcaagcttgttcatgagattgttcgccttatccggccagtgattccgatatccgcctgtttatcacgttatggccggacaaatacactcagtcccactgaccccacctgaggactgcaccatgacccgtaaaatcgcacttattaccggcgccagccgcggcctgggcaaaagcgccgcactgcacctggctgcgcaaggcgtagacatcatcggcacttaccacagcgcagcggccgaagcccaagcggtgattgcccaagtgcaggcattgggtggccgcgccgccatgctgcaactggacgtcagccaaagcgcaggcttcgatggcttcgtcgcccaggtcggcgcgctgctcaaggaggttttcgcccaggatcacttcaacttcctgatcaacaacgccgggatcggtgcccacgccagctttgccgagaccaccgaagcacagttcgaccagttggtggcgatccacttgaaggcgccgtttttcctcacgcagaaactgctgccgctgatcagcgatggtgggcgcatcatcaatatttccagcggcctggcgcggttcagcctgccgggctatgccgcgtacgcgtcgatgaagggcgccattgaagtgctgtcgcgctaccaggccaaggagctgggcccacgcggtattaccgtgaacaccctggcaccgggcgcgattgccactgacttcggcggcggcgcagtgcgcgataacaccgatctgaatacgatggtcgccaacaataccgccctgggccgtgtcggcttgccggacgatattggcggggcgatttcgagcttgctggccgatggcagcaactggatcaccggccagcggatcgaggcgtcgggggggatgttcctgtaggcagcggcgcctattgggtgactggggttttgttgacgattttttcacgcagtacgtcataaccccagtgatacacataggtatacggcaggaagaacaacagcacgccgatgtcgagtatgaacgcctccagcaggctgatcttcatcaaggcggcaatcaacggcaccgccatcagaatcaggccgccttcgaacagcagcgcgtgcaccacccgggtccacccgtcgttggccagctgcaagcgtgttctgaggcggtcgaacaggctgttgaaaataacgttccagctcagggccagcaggctgatgcccagggtcacggcgcccatctccagcgccggcctgccggtgatccacaccagcaacggcgtacagatcaacaaggccagcccttcgaacccaagggcttgtaaaacacgttcagtaatggatttggtagggttcatgacccggctccgtgagtgacgagggttgccatgatcaggctttgactcgatacttcataaccaataaccatcgatcaaggcgatagtcatggcgtcccatgaagtgctccaggcgttcgtccaggccgcaacccaaggttcgttttccgccgcggcgcgcaagctgggcaagagccagtccaccgtcagcgcggcggtggccagccttgagatagacttggatgtagtgctgtttgaccgcagcagccgcaaaccgaccttgaccccggcaggccatgtactgctgcaacgcgccgagcaggtgctggaggccagcagccgcctggaattgacggcgagccaattggccacggggttggaaccgaagctgaccatcgctatgtcagacacctaccaatcgcagcgcttcgaaaccaccatcatcgcgtttgccgaacgttatccggacctggaactggaatggctgattgccgagtgcgatgacctgatcgaccttgtacaaagtggccgagcgcaaatcgcatttatcgagcagcaggaggagtacccgccggacttgacccattcgccggtcgaggaacgtaccgaaacggccctgttcgtttccccccagcatgccttggccaggctggaaaaggttgaccagcaggcattgaaacagcatcgggaattgcgcctggcgagcatcgtcaaaccctatgacaatcgcgctgccgggcgggtctggtcggcagccagttacctgatgctgatggaaatggcgcagttgggtttcggctgggcgcccctgccacgctggctagtggaacgttttggcaatggcagcctgcaggaactgagggtgcgtggctggccgcggtcggtgacggtggatgcgttgtggtcgcgccagcatccgccggggccggcggggagttggttgctggggcagatgctcgaatgagccagtgagaacaatgatgtccaaatgtgggagggggcttgctcccgatagctgagtgtcagtcagctaatttttacctgacacaccgcaatcgggggcaagccccctcccacatttggagcttcattgtctgggggatttgagttcggtcaggcgtcgctccaggaagcgtttttccggggtttgctgggtcagcgacagggctttttcgtaagctgcacgggcctctccaacccgtcccaactgccggcagaattccccccgcgccgaatgcgccaagtggtaatcctgcaactcaccgcgttgcaaaatgctgtccaccaatgtcaatccagccgtcggtccctgttccatcgccaccgctaccgcacggttcaactcgaccaccggcgatggcatggccctgagcaatacatcgtagagcccgacaatctgccgccaatcagtctgctcggcactcggcgcctcggcgtgcaccgccgcaatcgctgcttgcaggcaatatggcccgaagcgtcgcgtggtcagcgcctgctccaccaatgcgcagccttcagccatcaaggacgtatcccacagcccacgatcctgagcatccaacagcaccaattcaccattggccgaggtgcgtgccgggcggcgcgattcgtgcagcaacatcaacgccagcaagcccatgacttccggctccggtagcaactccatcagcaagcggcccaggcgaatggcctccgcggtcaagtcttcacgggtgagatcggtgcctgtggaggccgagtagccttcgttgaacaccaggtaaatcacccgcagcacgctgtccaggcgctcgggcaactcgccacgggacggcacttgataggggattttcgcttcacggatcttgcccttggcacgcacgatgcgctgggcgatggtggtgggtgtggcgagaaacgcgtgggcaatggcctcggtactcaggtcgcagatctcgcgcaaggtcagcgccgcctgggcatcgggcgccaacgccgggtggcagcaggtgaagatcaggcgcaggcgatcgtcttccacgtcttcatcactccactgcgccgcttccagtgtgtcggcctgctcttgcagcaacggggtaaaccgcgcctggcgacgtagacggtcgatggctttgaagcgaccggttgataccagccaggcccgtggattatccggcacaccgtcctcgggccagcgctgcacggcaacgaaaaatgcctcgtgcagcgcctcttcggccaggtcgaaatcacccagcacacgaatcagcgttgcaagcacacgccgtgactcgctgcggtaaaccgcttcgacctggccattgagcgtcattaagctagtttcaattcacgtacggggcgtacttccacactgccgacccgggctgccgggatgccgccggctacctggagcgcttcgttgaggtccctggcttcgatcaggtagaagccggcgagctgctccttggtttcggcaaatggcccgtcggtgatcgacaccttgccattgcgcatgcgcacggtggtggcagtattgaccggctgcagcggctcggcggcgagcatgcgtccgctggcctggacggcctcggcgtaggcaagacactccgggtccttggggctgtcgggcgaggtgtgtaacagctgttcgtcgctgtagatcaggcacaggtatttcatgatgttctccgttttcggcctcctgactatagttcgcagtgctcaaggtttcaggtcgaacagcgccgtgccgctttgcatatcgaacggcgtcgaccagtgctcatgcaccactttccattggccatcgatacgctggtaagcggcggtgacgcgcatccagcaggtcttgagtacaccatccggaccggtgccaccgcagtgcgccagccagtgggcgaaggcgctgtcctgggcctgaatgatgcgcaactcatgaaactcaaaaacgcctgggcccgggcaatgttccatgcacgtcttccagtgtgcacgataggcctccctgcccttgaattgcagcgcgccaaccgcatcgaatgcgacgatatcgtcggcgtaaaagctgacaatcttgtcgatatcctgggataccacggcttgtttccattgctcgatcagagtgttgattgcagtgctcatggcgatgactcctgggttgtaaaatcacggaagacatccttagtcgaatggccctcgggcaaatcgacaggccatggaaaaataatttaccccgccacaaacccgatagactgcagccttcattgcagccgttcggataatccgatgcaaacccgccttgttgcctatgaggcgctcaatgctgtgcaacaacagcaagtcagcgccatcgaagttcatcctgaacaactgccgttttgcggcgatatgtattgcgccctcaatacgctgctggtcaacccgagccctggcgtcaaaggttttgcgctgttggccgatgatatccccgtggcctttctcctactcaagcgcccaccctgcctgccccattgggccgatgaacactgcgccacactgcatgcgttgcaagtagatcggcatcagcaagggcgtgggttcggcaaggcgtgtttgcaggcactgccaaccctggcgcttgaggtgtggccgcagatcaaagggttggagttgtctgtggacacgcacaacccggcggcaatggggctgtatctgggggctggatgggtggacagcggcgaagcgtacaagggacaggttgggtatgagcgccggttgagttggatcttcaattcataacggtaatgtcacgcaaacacgacgttgacgcgtgcctgtcgtgtttacatgacatcggcgagcgtcagccccgctctccaaccggcaaccagatctccaccgctcccgtgccctttctcgcgtcaaaatctgcgctatagcgctcgaaatccgcgcccatcaccttgtagcccgagtgcggcagccattcgaacataatgcgctcgtaggtttgctcaagcgcctgcaccggcccgtaatgcgggaacaccgcatagttgagcggcgggatttcgatgaactcaaagttgctcggcacatcgcccttgcctgggacttctaccccggccatgtaatcaaactcgccgtggtgggggttgtggcaaacgccgtaggtcacgcggccaacgcgcttcttgatgtctttaatgcacgtgtcaaacaactcccataacttggggatatcgcccacggtggccttcgaataacgcccttgtacaccggcgatcaccagggctttgccggcttccatgcgtggctccaacggttgttttgtctgctgatccatacgaacagtctccttcttatgagggaacaaacccgcatcgagtataggggcatatcccggtcgcgctccatgtacaattttttcccgcgccatctggacaacacgccatcatcgcccgtattgtctgccccgcaggccaccgcagtggccgacgtcgctcggacggttccgggcgcttacgtactctcgaggcaacaatggccgaccaaggttcgccgcgccgctttgcgcgcatagatcgactccccccttacgttttcaatatcactgccgagctgaagatggctgcgcgtcggcgcggcgaagacatcatcgacttgagcatgggtaaccccgacggcgccacgccaccgcacattgtggaaaaaatggtcaccgtcgcccagcgtgaagacacccacggctactccacctccaaaggcatcccgcgcctgcgccgggcgatttcgcgctggtacaaggaccgttatgaagtggatatcgaccccgagtcggaagccatcgtcaccatcggttccaaagagggtctggcgcacctgatgctggccaccctggaccagggcgacaccgtgttggtgcccaaccccagctacccgattcatatctacggtgcggtgattgccggtgcccaggtacgttcggtgccgctggtgccgggcgtggacttcttcgatgagctggaacgggcgattcgtggctcgatccccaagccgaagatgatgatcctcggtttcccgtccaaccccaccgcgcagtgcgtggagctggatttcttcgaacgggtcatcgccctggccaaacagtacgacgtgctcgtggttcacgacctggcctacgccgacatcgtctacgacggctggaaagccccgtcgatcatgcaagtgccgggcgccaaggacatcgcggtggagtttttcaccctgtccaagagctacaacatggccggctggcgcatcgggttcatggtgggcaacccggaactggtcaacgccttggcgcggatcaagagctaccatgactacggcaccttcaccccgctgcaggtggcggcgattgcggcgctggaaggcgaccagcagtgcgtcaaagacatcgccgagcagtaccgccagcgccgcaatgtgctggtcaaggggctgcatgaactgggctggatggtggagaacccgaaggcgtcgatgtatgtctgggcgaagattcccgagcagtacgccgccatgggctcgctggaatttgccaagaaactgctgctggaggccaaggtgtgtgtatcgcctgggattggctttggcgagtatggcgatgatcacgtgcgctttgcgctgatcgaaaaccaggaccggatccgccaggcagtgcgggggattcgtggcatgttcagggcggatgggctagtacccaaagccagcgtctaactcggtcaaaatgtgggagggggcttgctcccgatagcagtggttcagtcgatacatctggtgactgatccaccgccatcgggagcaagccccctcccacatttgattgggttttcaccccagactgtgcggtgtggcttacaccaccaacgacagcaacatgatgaagatcagcgccacgatcgacagaatggtctccatcgccgtccaggtcttgaacgtctcggccacggtcatgttgaagtactgcttgaccagccagaacccggcatcgttgacgtgcgacaggatcaacgaccccgcccccgtcgccagcaccagcaactcgcggttaacccccgggatcatccccaccaccggcaccacaatgcccgcgccggtaatggtcgcgacggtcgctgaacccgtggcaatccgaatcaccgccgccaccagccatgccagcaggatcgggttgatctgcgcgttcacggccatatggccgatcacgtcacccacgccgctcgtgaccagcatctgcttgaagccaccaccggcaccgatgatcaggatgatcgccgcggtcggcgcaaggctggcgtcgagcagcttgaggatctgcttggaatggatgccctggcgatggccaaaggtgtacagcgacaacaacaaggccagcaacagcgcggtgatcgggtggccgatcatgtccatccagttgcgcaccacattgccttcggcaaaggcgatgtcggcgaaggttttcagcagcatcaggaacaccggcagcagcacggtgaccagggtgatgctgaagctcggcaggtttttgttttcaggctcgcgggccagttgatcgaccagctcctgggacgggttgcccgggatgtacttggcgataaaagtaccgaagatcgggccggcgatgatggccgtcggcagcgcaacaatcaggccgtacaggattgtcttgccgatgtccgcaccgaacacgccaatagccagcaacgggcccgggtgcggcggcaccaggccgtgcaccgccgagaggccggcgagcagcgggataccaatcttgatcagcgacacaccggtacgccgcgccacgataaacaccagcgggatcagcaatacaaagccgatctcgaagaacagcgggatgcccaccaggaacgcggcgaacatcatggcccactgaaccttctctttgccgaaggcgcggatcagggtctgggcgatctggtcggcaccgccggattcggccatcatcttgccgagcatcgtgcccagcgcgaggatgatgccgacaaagccgagtaccccgccgaaaccgtcctggaatgccttgatgatcttgtccacgggcatgcccgaggtcaggccgaggaagccggccgcgatgatcagtgcaatgaacgggtgcaccttgaacttggtgatcagaacgatcaacccgatgatagtgaccactgcatctagcagcaggtaagactcgtgggacatgccaaacatggggggtctctcctgtttgttgttgttattaaagcgggtgttgaatttcctgccggggatagcgctatcttttccggcaaaaaattaatgagttggttcaaagccgtgcttgagccaccaggcgttggtctgctcggccagttcctcaacgctgtcttcactggcgttgagcgccagggtcagcggctcgcccttgggcgactccagggtggcgaactggctgtcgatcaggctggccggcatgaaatggccgggccggtgggacacacggtcggcggcgacttcacgggtcagctccaggaatacaaagcccaggcccggcgcggcttcgcgcaggtggtcgcggtatttctttttcagggccgaacaggtgagcaccggatgctcgcccgctttgagcgaacggcgcagttcatcgcacaggatgtcgagccagccggcgcggtcgtcgtcgttaagggggtggccggcgctcatcttttcgatgttcgcggcggggtgaaagctgtcgccttcaatggcagtggcgccgttcaggcggcacagggcttcgctgacgctggacttgccacagccggaaacacccatgatgaccagggcggtaacaggttgactcatgaaacacctcaggacgcagatagcgctacctttgcacagcataaggctagtgcaaaaacaggcttttcccgcgccgacttgtcatttttatggagtgacgcgtgcatctgctccaatcattcgaaccggatcaggcaaccctaggttcaataatttgcagccctttggagacagcgctaccttagtgcctcgatttttgtttggcaagccgcctgatgacctccaagaacgataaaaatacccgcacgacgggccgccctaccctcaatgaagttgcacggctggccggggtcagcccgatcaccgcctcacgcgccctgcgcggtatcagcagcgtcgccaccgaactggtggaaaaagtccagcaggccgccgccgaactcagctacgtggtcaaccccgctgcccgtgccctggcctcggcccagagccattcggtggtggtgctggtgccatcgttgtccaacctgctgtttatcgaaaccctggaagctatccatcaggtactgcggcccaagggctttgaagtgctgatcggcaactctcattattcgcgtgatgaagaagaaaacctgctgcgcaactacatgtcttaccagccacgggggttgctgttgaccggattcgaccgcaccgaaagcgcgcgacgaatggtcgagaccagcaatgtgccgtgcgtgtacatgatggatctggaccccaatgccggggtgaactgcgtgggtttctcacagttggcagcaggcgagacggcggcggcgcatttgctgtcccgggggcgtaagcgcctggcctacattggcgcgcagttggatcagcgcacgttgttgcgcggtgaaggtttccgccgcgccttgcagcaggcgggcatgtacgacccggcgctggagcttttgacaccccgcccctcctcagtgggcctgggcggcgaactgttcctgcaattgctggcagagcatccggatgtggatgcgatcttcttcggtaacgacgacctggcccagggcgccctgctcgaagccctgcgccatggcatcaaggtgcctgaacgcgtggcagtgctgggcttcaacgacttgcctgcatcgtcattcatggtgccgcgcctgagcagcatcagcacgccacgagaagccattggccgcagggcggcggagcatttgttgaccatcatggcgggcaacaagatcgccaagccggtggtggatatggggtttgagttgcaggtgcgggagagcacctgacccgctcgttcccacgctctgcgtgggaacgatcagaagtctgcctgtgttaatggcggctgtgcgtaggacactttcgggtgcgccggctttgagtgtccaccggtctactaacctgcgtacagctgccaccctcgtttaactcgctgctcggcaaggccatggaccagcacacaccacgctgctgagaccttactcggtccaaatgtgggagggggcttgctcccgattgcagtgggtcagctatctgtaagttgactgacccaccgctatcgggagcaagccccctcccacattttttaaccatgcccgcttgcgccctgctagattgaccactttccatcgccagggaagaaccatgggacattcactgaaaatcttgggccgcacttcctccatcaacgtgcgcaaagtgttgtggacctgccaggaactgggcatcgactatgtgcgcgaggactggggcatcggcttcaagcccactcagtccaccgaattcctcgccctgaaccccaacgcgcaaatacctgtgctgatcgacgaccacggcgtgctgtgggagtccaacaccatctgccgctacctcgtcggcctttaccaacgccacgacctgctgcctgtcgaaccggcgccacgggcccgtgtcgagcagtggattgactggcaagccacggaactcaaccgcgcctggagcgatgcctttaccgccctggtacgcaataacccggacggcctcgacgctgcgcagatcgccgccgcggtgcaggtatggaacgacaagatggggattctcgaacagcagctggccaagaccggagcctatgtggccggcgaggaattctccctcgccgacattttgatcggcctctcggtacaccgctggcaggcaacccccatgcagcgtccgccctacccagccattgccgcctactatcagcggctcagccagcacgccggtttcaagaccttcgccctcgacggccacaactaagcacagggaccccacgtgaacggactcaacgtactactcaccggcgcctgcggcagaatcggcaagacatttttccaagcctcgcaagaccgctaccgcttcaccctcaccgaccgcatcgcgccggatttcgacctgggtggacaccgcttcgtacacgccgacctcagcgataaatccagcctggcgaccctgctcgaaggcatcgacgtgatcgtgcatctgtcgggcatcccccacgccagtgcctcgttcgacgaattgctgcccaacaacatcctcgccaccacctacctcttcgaagccgccgtggctgccggcgtgcagcgcctggtgttcgccagcagcgcacaaaccatcgaaggctatccggtcgaccggcagatcacccccggcatgcaggtgatgcccgccaacctgtatggcgtgagcaaatgctatggcgaggcgttgtgtggctactacgcggccaagacgccgctgtcgaccatcgccctgcgcatcggcgcttttgaattccccgaaacccacgacctgaacaacgcccgcgacctcagcgcgtggctcagcccgcgggatgccgtgcagctgctgcaacgctcagtggaaaccgtcggcgtgaagcacctgattgcccacggcatttccaacaaccgcttcaagcgtctggatttgagcgaaaccacacgtgtgctgggctaccaaccgttggacgacgcgttccaggtattcgaaattcccgtcacttactgagttttcaccatgcctgcacacgccaccaaagacggcctcgacccgctccgcgccgcccatatcagcgcacgcatcgaccgcctgcccgccgtggccaccatctggcgcctggtggcgctgctgtctatcgggggttttttcgagctgtatgacctgttccagaccgcctatatcagccccggcctgatcagcgacggcattttccataccggcagccagggcgtgtttggcttctcggaccaggccgcgttcgcctcggcgaccttcctcggcctgttcctcggtgccagcctgctcagccccatcgccgaccgcttcgggcgccgggcgatcttcacctttgcattgatctggtacaccgtcgccacggtgctgatgggtattcaaacctccgccctgggcatcatctgcatgcgctttctggtgggcatcggcctgggcatcgaactggtgactatcgatgcctacctctcggaactggtgcccaagcgcatgcgcagttcggcgtttgcctttgcgtttttcattcagtttctgtcggtgcccgccgtggccttgatgtcgtggtggctggtgccccaggcgccgttcggcatctccggctggcgctgggtggtgttgagcagcgcggtgtttgcgctgtttatctggcaattgcgcaagcgcctgcctgaatcgccgcgctggctggcacagaagggccgtttcgaagaagccggtgcgatcatggacaacctggaaacacgctgcctgaaagatcacggcaagcccttggatgagccggagcccgaagccgtcagcgttcaaggcagcgggcgttttgccgatatctggcaaccaccgtaccggcgccgcgccttgatgctgatcgtgttccatgtgttccaggccatcggttttttcggcttcggcaattggttgccggcgctgctgtcgggccagggtgtcagcgtgacccacagcttgatgtacgcctttatcatcaccctcgcctacccgctggggccgttgctgtttgtgaaggtggccaaccgctttgaaaacaaatggcagatcgtcggttccgccatgggcgcgatgatcttcggcagcctgttcgccctgcaaaccagcgcattggggctggtgtcctgcggggtgatgatcaccttctgcaatgcctggctgagcttcagttatcactcgtaccagagcgaattgttccccaccaatatccgcgcacgggccgtggggttctgctattcgttcagccgcctatctacggtgttcagcagcctgttgatcggctttattctcgaacacctgggcacgccaggggtgttggcgtttatcgccagcagcatgctgatcgtgatgatcaccatcagctggttcgggccgcgtacgcgtaacctggcgctggaaaatatcgcccactgacggcaatgcttggccgccagcggcagcatgcttgccgcggcagccaagccattctcagtaaacattggggtttgcacacacggcacgctatttgctccagctgtggcaccgaccatttgcacaggtgaccgatcatgctggttaacaacaacacccaagccatgtcgaccgtccaacagatcaagcgacccgacatggaccccgccaacgccgccgccagcgcgttgtacagtggtgcccttcagactgcgcagcagaacatcacagtgccagttgcgcagaaggaactggacaaggccagcgatcgcattgacgaagcgtttgccaagacccgtgtgcagctgcaagccactgcgccgaacagcgatgtgccggccaccagtgtcgccggttcagcacgcagtgagttcaccgattacatgaccaagaccccggccgagcgcattcgtgatcagttgctcaaagaacgcggcctgacactggagcaactgaacgccctgccggtggaagagcaaaatgcctttgccaaggcagtgtccgagcggctccagcaacagcaacagcagcaggttgcagcaaagacggctgacccacaggcgcagacggtgaaagagaccctggctgcgatctagtcgcgcagggaatccatgacctgatgccgacttgtaggcgctattggggctttaagacgacttgctgcacatcgacctttttcgggatcaggccgttggcaaaaaacaggtccgccgtgcgctgctgattggcgacgtcgatcgcctgcaaaggacggatcggcgcgggcgagcgatgctcgaagtagcttttgaccaccgccggtggcaggccaagggtgccggccatcaatgcaatgctttcatcgggttggtcgagtgatagtcgctgcgccttgccgagggtctggataatggtggcaatggcctggggatgttgctgggcgaacgggccgttgaccacaaagaaactgccagccgggttaagaccctgaccatcacccagcacgcgagcggagccgtcgaccaccgcggccgagtagtacgggtcccaaatcacccaggcatcgaccttgccttgttcgaaggcagcacggccgtcggaaggtgaaaggtacaccacgttaacgtccttccattgcaagccggcgcgcagcaggctcttgaggaacaggttgtgcgcgctggaccccttgagcaacgccacgcgcttgcccttgagctcggcgacgttctgcaccgtgctggccttggggaccagcacggcttcggtcttgccgtcgttgggctcgacggcaaagtactgcaagtcgatgccagccgcctgggcaaagatcggcgggatgtcgccgatattgccgatatccaggctgcccgcattgagcgcctcgatcaacggcgggccgccgaggaattcggtccattgcacctgggtgccgggcagcgcggcttcgaatagcttgtgctcgcgggcgagcaccatgcttaccgaacttttctggtagccgattcgcagggtgggaggttcggcggcgagcgcaggctgggccaggacggtgagcgccagcagtgaaccacctagcaggtttttcagttttttcatggttgcctcatggtcgtgatcgtgggcgagttggccgtgtgcagtgagtcaggcgtggtgttcattccaggcgcaaccgcaggcgaccgttaagcgcgcgggccatgtaatcactgaccgagcgcggggaaattcccaattcggcggcgatcgcgggatacgtcaggccattgagtcgggacaacaggaacgtcgccctgaccttggccggcaggccgtcgagccactggtcgacgactttcagcgcctcgcacgtctgggccaggttttcgggggacggcacgctgaaggcttcatcgttatccaggacatcgagataggcgcgctccaggtcacgtcgccgccatagctgatacatcaggcgctgggcaatggtagtgagcaaggcgcgaggctggcggatcggggcgacgtcgagtgcgctcaggagctggacaaaggtgtcggcggcgatgtcttcggcgtgtgcacgggaatcgagttgacgatacaggcggctgcacagccaggcgtaatggctgcggaacagtgcgcccacgtagtcgcggtgagaggtgtcggcgccggacatagtggctcctgtcgagtaggttgcgcgttatgtccggtgttccggtggagcgatcctagcaaagccgcttattctttaataatattaaaaatgcattttaatatatatttattgaatattcgtgtaaccaaggcttgcggcttgccgttggtaatccaacaacacctgatagtcgtcctcgctggcggggagcacggcttgcacaccgagggtttgcaccacctgcggcaggtcttgcaacgccaggttcatggcttcgcgaacctgctcctgctgcacatcgctcaagcccagcgggccgatatagggcaaggtcgggctcgacgcgctgcgggtaacgatgcgcaaacccgcgacctcttcgggcgcgaaacgcgccaggtagtcataggtaatgctgtcgatggcggcgaggtcagcgcggtcttcgcgcagccagcgcaggctctcacggtgggcgccgctgatggcgatgctggcgaagaaacgcccatcgcgctgcaacggtgccaggcagtggcgcagtaggttcatgccactgttggagtcgtggccgttgatcaccccgcggctgttgtaaaactgcgccagcatagtacgtgggttgtcagcgcggctcagcaacaggctgcagtgttcgccattgctgctatggggtagctcgtagcgggggcgaccgataacgcgtacctggccgcgcagttgggtcatcagcgggtagccgcaggtttgggcgaccagcaattcaggcgccagccacaggctcggcaagtcgaggtggtcggcgttgagacgacgcaggcccaggcgttcaaggatgcgcgcaagccactgttgattggcccgctcgatgggctccggcgcgacatacatgcgcaactcggcgtagtgcttactcatgggcatatctcaggcaaaagggtgccgagggctgtcgatggccttgaggccgtggcgactgatcaactggccgtagccctgcaccaggaacccaccgctacgcgccagccattgctcgcgacgggcgcgatataccgtgggtagcaggtaccagggaagtttgggcaggtcgtggtgcaccaggtgcagattgttgttgaggaacaaccaacgccagggccaggacgcttcattgagcaccgtgcgttgttccggccggggatgcgggcggtgttcatagtaggaacggatcgacgccaaggacatggccggtacgctgaccagcagcaggtaatgccacaccggcagaacgctgtaatgggtgataaaccccagcatcaacagggtcacgacgccgtgggccaaccacatcggccaaacctctggcaggcgttgccattgatcgtgcaccaaccggctgatggccaagggtgccgccagcagcaagcgaccgactaccgtcttggtcaaccaatgcacgctgcgttgcaagcgcgagctggcgtcccactgctgttggttaaggtagcggctttcggggtcgatgccgggcagggtcaggtcttcgtcgtggtgatgcaacaggtggctgtcgcggtacagggtgtaggggtaccacacggcaaacggcgcgtagccgagcagtttgttcaccaacgggaaacgggtgggatggccgtgcagcaactcgtgttgcagcgacagccaaagggtcaccaacgggatcagcaacagagtgctgcaccataggcccagccagtggctggcaagcaacacaccgaaccagccgatatacacgccgagcaacaacagccaggtgggccattcggtcttcgcggtaaaacttgcagccagggcctggatttcccggcggtgggtcaggtcaaggtagttggccatcggcagctcagagcaggtgtttcccactctgtgccgcgaagcgcgcaaatcttgcagatcctttggttctaagcttgtaactcagtgaccgaacaggccggtctcggacttcttggctttcttgtccgcgcgtttttcatcggcggtctttgccggttttttcttcgcggctttctttgaatccatacctttggccatgatgcatgctcaactgaaaggggatgtagcactgggtataccacctattgcccggcagaaggcgcttataatccccgccccctgacattgctggccaaaagaccatgcccgaactgcacatcgaaccgctggcagagcctctgtggccactgttgaacaagttttaccgcagccacaattcctcgatgaaggccctcaagggtggacgcttgtgggtggcacgcgacagcgagatcgtggccggtttgtgcttgagcccggtgatgggtgggcagtggctgacgggggtgtttgtcgacccggcctatcgcggccagggattggcggcacgcttgattgagcaggcggtagccggagtggagggtacggtgtggctgctgtgccatccggatctggaggggctgtatcagcgtatggggttcagccaggaaacggtattgccgcaatcgctcagtgagcgcttggtgcgctacaaacgcaacaagccgatgattgccatggggttctcaatcatctgaatgatgccgggcaaaaatgtgggaggggcggtgcaacgattcgactcgcccactcccacattgggatctcaggtagcctggtgtttattcgtcagctgttggggccatttccgggaacatgacttcgataaacccgaatttgctgaaatcggtgatccgcgatgggtataaccggccaatcaaatgatcgcactcatgctgtaccactcgcgcgtggaagccatcggcaaatcgtacaatcggttcgcctttgggatcgaaaccttcgtagcgaatttgctggtaacggtccaccgctccacgtaaacccggcacagacaggcaaccttcgtagccctcttccagcaccgggctcaacggggtaatcagcgggttgatcaggatggtctgcgccaccggcggcgcgtccgggtagcgctcgctggcttcgaaaccaaagatcaccagctgcaggtcaacgccaatctgcggcgcggccaggccaactccacctacatgttccatggtctggaacatgtcgtcgatcagttgccacagctgcgggctgtcgaacatttccggcggcaccggcgaggcgatacgcagcaggcgctcgtcgcccattttcaggatttcacggatcatcgctctggcacttcatcaggggtgggcttggagtggtcccggcctaggcccgagacgtgctgtttttcactggtgtcactgggttcgtcgaattccttttcaccgggctccttgccttcggcggacatgtgttcgatcacggcattcatctccgcgcccagcagcaacacggcggcggaaatatagaagtacaggagcaggacgataatcgcgccgatactgccatacatggcgttgtagtcggcgaatgtcttgacgtaatagccaaagccaagggaagccacgatccacaccaccacggccaataccgagcctggagtgataaagcgaaacttctgctccacgtcaggcatcacgtagtacataagcgccacggcgaacatcagcaggatcacgatcaacggccagcgcagaatagtccacaaggtgaccacgaattcctgcatgccgatctgcccggcgagccattccatgacctgcgggccaagcaccatcaacgccgcggcggccagcaacatgccggcgatacccacggtgtagaaaatcgacagggggaagcgcttccagatcggccgcccctcgaccacgtcgtaggccgcgttcatcgcactcatcatcaggcgtacgcccgcagaggcggtccacagcgcgatgacaatacccaccgagagcaggccgcccttggactgctgcaactggtcgatcaccgggttgacctgctccagcgcctggggaggcaacaccagttccgattgcagtcgcagccaggtaaagaagtccggcaggtgcaggaaaccgatcagggcaatgaggaacagcaggaagggaaacagtgagaacagcatctggtaagccagtgccgaggcgtaggtaggcatctcgtcatcgacgaattccttgacggtgcgtaccagcaccttgtgcagcttgagaccttcgagtaccggaaaaatcatagcgtctcctttcgccgcaaagaggttgagttcgtgggcgactcaagggccgttttctacatcaaagtagcccatttggcgactttgaaacaatttccaaagtttagttgcaaccgctcacataaaaacggccatccgtggatggccgcagggctgcgagagaccagccggcgaaacaggattatttggtggctttctttaccgcgtccttggtatcgccgaccgctttctgcacttcgcctttcttctcttgaaccacgccttcagcgcgcaacttgtcgttgccggtgactttgccgacaccttgcttgacgttgccgactgcttcgttagccaaaccttttgccttatccgatgcactgctcatggtatttctcctggaacaatcgagggtttcggtcattacgtagaggttgacccggggccatgtggcagagtttcaattattttcggcaggcatttcatcgcaggccgcaggtttggctttatgttttgcccccaacccacgagaatgcccggcacattcaggctacacggctgaataacagatcccgtaggaaggttatgaaactcaataaagcgcaggccattgcccgtagaaaccaggaactgggcggtgccgtactcggcgtcaacaactgccacttcaccgacctggaccgcaaacgcaacatctggtggttcgacctgccagtggcgcggattgccgtgggccagtacgagtggatccacctgttgatgcacaacgccgagaccgaccagttgctgcacctcaaggtgccgaccgtgttcctgcgcgaaaaactcgaaggcctggtggtgcgtaatgccggcaagcgcaagccggagattaccctggagctgagcgccgacaaagattcgttcctcaaggatgtgcgcccggcgggtgcgggcgtgagcttcgcgcagttcgcgctgtaacctggcaggtaaagggccgtgggcgagagcgttacgccctcgcaccttcgctccttttcaggcggttgccacggaccggctggcaatacgctgggccagggcgatggcgaacaggcaaaacaacgccatgaccaaaattcccagcatcagtcccatcgccgtgctggtgtgcccctcagagaaaaagtacagcgccaatgcagcaccggccatcttgatagccccctgcagtgcactcccggtgccggcgtgtttggcctggccatgcaaactgatccccaacagcagcggtgaggacaacccacagccaagggcgaccaaaaagccgtacaccactatcgccggcgccgtgaccaggttgaatgcctggagcaccagcggcgcaagcgctgccaaccccgtcagcgcaaccagggacgccatcaggatccgctcaggcgagtagcgattcaagaaacgcttggtcaggtaagaccccaggacaatacccgcagagtagccaacgaatagcaggccgttctcctggctctccagatggaactgcagctgataaataaacggactcgcggtgaaatagccgatggtgatcgcaaacagcaccgcggaaaccaggctgtagaccatgaagttgaagtcccgtagcagcaccttgaagccctcgagccgcttggcaggcacaccgtggagtggagcggtttcaaccaatgtagctttgataaacaccgcgccaagcagcgtgatcaaggtgagggcgtagaagttgtattgccagggtagcgctgcagtaataaagccacccagcacgggcgcaatcgctggcgaaacctgggacgccatggaaaaaaccgtcagtgacttggacagttcggttttatccttgaacgtatcgctcaagattgcccggcttattacggggcaaccgccagcaccgatgccggtcaacaaacgaaatagatagagcgcctggatactgtctgccgtcgacgtcaagtaattgcccaaggcgccaagggccagggacaccataatcaccggcacccgcccttttctatcggagatcggcccatacaccagttgcgacagtgcaaagcccgcaagatagaaaaccaccaggctttgggactgtgcgtccgtcaccgaaaatacccgtgcgatttcgggcaaggccgggttgtacaggtcgattgaaaacaatcccaataccaggatcaggcaggagttggtgatgaccatttttgaattcacaacaggctcctcacagtaaggggtgatctttcaggcgtgagctgtattcgctgttgggcgtggtatgtcgcccgtcgcacttgatttcaatgagatgaggccgagccgcgctcatgatgctttcaatacaatcgtgcaatgcctctggggtactgacgcatgtcgcgctcacgcccaggctctcggcaaacaggcaccagttgtagtcagggatttgcgtcagcgcaggcaagttatctttgttattgaagtaacttgccgaatacgacctgttgttgaaaacgacaaagacgatattcaacccatgtttggcggcggtggacagctcaagcccttgcatcaacatgcagccgtcaccggtaaccaccatggtcttgccatgggcacgggcgaaacttgcacctatgcccgcagggatactccagcccatcgggcccagggtggttgccgataaataagcgctggggccgcgggcggtccaatagtgaccgaagaacgagcgatgcgatcccgagtcgacacacaccacgccatcactggggaaatacgactgcagcacggggatataggccgcgggatggtctgcgatattgcctgtggccttggcatcgaccggataatgcaaaggcacccgctgaagatcattcgaccacttggaacgactttcctgtgtggcggccagctcctctgcatgaacctcgcaaaccaggcgcaagaacccatcccccgtcgccaccacgccgtgatcgatatcgagaaaacgccccaggtaatccgggctctcgtccacctggatagcaccacatgccggccttaactcatgggaccacagcatggtgctccattgagtggtgtcgagccccagtaaaatcacgccatccacaccgttcttgaaggcttcaatggcgcgtttatttcctgaataaccgtaaaccccgagtgcattggggtggtcttccggaaacaggcctttggcgctcaaggtggtggcgaccgggatcgaaaaacgatcggaaaacgccacgagcgcggctgccaccttggcgttcttgcaacgcagccccgcgagaatgacgagattggtcgagcgcttgaagactgccttgatcgcagcacttttgatcttttcgacggcaagcgcttgattgctccacgactccagtacgcttggagcgatatcaacgcgagtcatggacttttcatacagcgcttctttgctgacagccaggtaagtcgggcctttttccacgcccctcaatagccggaccgattcgcgcagaaaggccggcaagggttgcccggccttgacttcaagggcactgcgggtgatgggtttgaacacatcgcacagattaacgcccgtttggctgccgtcctggagcacgttctgcatttccagggaggaagcaatctggcctgacagcagcaagaccggttggtgatcggtataggcagacgctatcccagttaacgcattggtgactcccgggccgccgatgaccaggcacaccccgattttttcactggcccgggcataaccttccgccatataagacgcacctgtttcgcaggcagtgacgaccggctcaatctccagcgttccggaaccatcattgggataacaacgcataaaagcattgatcagtttgccgggcaccatgaagaagtgcgtgacgccaaaagactgaagttggcgaagaatgtaatgtgcaccggtttcgccagtactttgcaagtccattgcaatcccctgttcagatttcaataaaagcgatgctttcgcgcttcatcttcaatacggcatcctgagaaaaagaggatgggtatcgcacattgggcatatcggcaaaatacggcttagggctattcggcaaatagtcggacacgtgcagactgcgttctgcccgtgcgcgcaagtaggtaatataggaagcgttatgtttggtcgacgcggagacagtccattgaatggccaacttcgtcgccacgggtgtttcatcgggtgcgctgctgcggtgagtaactcgattatcccaaatgaccaagtcgccagccttactcatgacggtgcgctcaaaggccgcagggtcggcaagcctgagtttgacttcatccttgctgagtttatgcgaaccgggtaataacgtgataccgccgcccgcgacagagtcattatcttgaagataataggcacactgcaaaaactcaggagatgcactgggctcaattacttcttcaggcagaaaataagcatcgttatgccaaggtatataaacactttcacgcaccgtaaaattgggcaacaaagagaaatccgactggaatatctccttgatagcgtcgacggctcggggctcgaacagcgcgttgatcatgtcactgaattgtagaaaggccgttggcagcagcgtgctttgctgagtctgcgccaaactgcgagtataagtctcacgcaatgtggccacttgatcgctggaaagaactttcggaataacgacatacccttcttgttgaagcttttctcgataattcatgttttatagtccgttataaagagggtaacccggtcaccctcactttatttcatggatgatcaatcagacttcaacatgtttggctgctgtcgaagactcttcaaatgacacgcccaggcgttcaaactcctggaagaagtccggaaaggaacagtgaacatcctgatagccatccaactcgttgatctgttggcaccgcagggaggcgacaaacagcgacatgaagattcgatggtcaccccaggccgacaacactgcgtcaccggcgtaactcggttctccacgaataacgaagccgtcgtaaacgccgtttttaaataacggctctatggccacgcccatttttaccagctcagtcaccatcgcttcgatgcgtggcgacttgtgcaagcgggtaatggagccgccagtgaccttgaactcgccttgcacataagcacctatcgccgccagcgttggcacaatattaggataatcactcgcatcaaaatgatattcgcctttcaattcggccaagttattaataatgcgcacttcattggtagcgtcattaaattcgacctttacccccagcgcctcggccaccttaagaattgcacgctccccctgcaaactcttgctgttcatgtttttcagggtcaacgtaccggggaatattattccagccgcaatcaagtaggacgaggaagtgtaatcaccgactatcgtgtagtttgcactctggtactgacctgggtataccttgatccgcgaatagtccgcgttcacctcaaaggcaatccccgctgtaccgagtgtttccagggtttgcttgatatacgacagcgacagaatttcaccacggatattgaccaccgtaggttgtttggccagaggcgcgcagaaaagaatagcggtgatgaattgcgaactgatgttgccctcaatcgtgcattccccaccctgatagccaccccaattgacgataggcgccttgccactgtggttgatgcatgaaatgtgtgcgcccagcccttccagcgctacaaacaagggctccatgacacgtccgcgcagtacatcatccccggtaataacggccggggtcgttgtaaagcaggtcagcgcggcaaacactcgaaataccaacccggaacccagcgcgtcgatcactttcttttcgggcttgatcaagccgccggtgcccgtcaccactaaccgtcctggttgttcctcaatcactgcgccgatactacgacaggcctttttcattgtttcggtttcgagacaacgaaggtcgttgtaaatataggaagttcctgatgccaagctcgcggcaataattgcccgctgcgtttcaggttttgaggaggggatggtagcgatgttgccgatcgatgcagtaggaaagactttcaagcgtttttgggtcgacatgcgttgctccctaagacagtagatccaacgtgatcggcgagtgggcataacactcaccggctaggctgaaacatcttgttacaaccgcttaaaaacctaacctagggattggaacgtttcaaataacaaaaaggaataagattggatccaatctatgacgtattttattttattctttattttcagtgcattacgaaccacaaaaaaaagacaaaacccataaaaaaaccgccattgcaggcggtttaaaattggaaatcttgaataaggccgatggcacaacgacacatattgctattcattagaagataccagggtatgctccaccatcaataaggaggttctgccccgtcatataggcagcctgatgactgcataaaaatgcgcacaatgcagcgaactcagcggggtcaccaaagcgccccatgggaatgctcgccagacgacttccagccaccgcgtcgaaggtttttcctgaacgctctgctgtcgcttgaagcgtgtgctccaggcgttgcgtcttgaacgctccaggtaaaatattattgatcgtggtgttttttgcagcgaagtccttttggcgtgccaggccggcaacgaagcctgtgagcccacaccgcaccgatgttgaaagccccaaggcatccaggggcgacttgaccgcaccagacgttatattaatgatgcggccgaagcctcgacttgccattgcgtcgatcaccaactttatcagctcgataggcgccaacatatttgtgtcaattgctgaacgccactcgtcacctgtccattcgcgaaagtttcccggcttgggccccccggcattattaatcaaaatatcaacttgcggcgcggcatcgaccaatgattggcgaatcgatggatccgtaatatctccgataaccgagatgacttcgacctccggatttctttgcttcaagcgttgcgtggcggcttgcaagtcaaccgcgcctcgcgcgttgatcacgatgtttacaccttcgtccgcaagcgcctgcgcacagctataacccaagcctttactggccgcacaaacgactgcccatttgcctcgaatccctaagtccatcatcactcctcgatcagtggttcatcttgcaaacccgggtattaaaaacccgcacttgtccattcgatatcacagatgtccgcagagaaacaagcagggtatttcgcctatagagaagcaaaaaaatacccctcagtgaggggtattgttcaagtgcggcaggacgcttgactgagctattttttaacgcccagttttttcaactcttcatcacgcagttcgcgacgcaggatcttgcccacgttggtggtcggcagtgcatcgcggaactccacggccttgggcaccttgtagccggtgacgttggcgcgcatgtgctccatgacttggtccttggtcagggtggcccctggcttgaccacgatgaagagcttgatgtgctccccggatttctcatccggtacgccgatggctgcgcattgcagtacccccggcaaaccggccagcacgtcctccagctcgttggggtagacgttgaagccggagaccaggatcatgtctttcttgcggtcgacaatgcgcatatagccatcgggctggatgatcgcgatgtcgccagtcttcaaccagccttcactgtcgagcatctcggccgtggcgtcttcgcgctgccagtagcccttcatcacttgcgggcccttgacgcacagctcgccggtttcgcccagcgccagctcggtaccgtcgtcggcgatgactttgcacaccgtggacggcaccggaatgccgatggtaccgatctggatattctggatcgggttgaccgtggccaccgggctggtttcggtcatgccgtagccttcgcagatgctgcagccggtcaccgccttccagcgctctgccgctgccagttgcaacgccatgccgcccgacagggtgactttcagcgctgagaaatccagcttgcggaagccttcgttgttgcacagcgctacaaacagcgtgttgaggccgacaaaaccgctgaacttccacttcgacagttccttgaccatcgccggcaggtcacgcgggttgctgatcaggatgttgtggttgccgatcagcatcatcgccatgcaatgaaaggtgaacgcatagatgtgatacagcggcagcggcgtgatcaggatctcgcaaccttcattgaggttcgagcccatcagcgccttgcactgcagcatgttggcgacgaggttgcgatgggtcagcatcgcgcccttggccacgccggtggtgccgccggtgtattgcaacaccgccacatcgctgctggccggactggcgtcgttgaccgcctggccatgccccttggccagcacgtcgttgaacttgatcgcctggggcaagtgataggccgggaccatcttcttcacgtacttgatcacgctgttgatcagcagacgcttgaacggcgacagcaggtcggcaacttcggtgacgatcacatgcttgacggcggtcttgggcacgaccttttcagccaggtgcgccatgttggccaggcagaccagagccttggccccggagtcattgaattgatgttccatttcccgcgcggtgtacagcggattggtgttgaccacgatcaggccggcacggatggcaccaaacacggcgaccgggtattgcaggacgttgggcagttgcacggcgattcgatcgccgggcttcaagtcggtatgctgttgcaggtacgcggcgaaggcgccggacaattcgtacagttcaccgtaggtgattgtcttgcccaggttgctgaaagccggtttgttggcgaagcgctggcaggactgcttcagtaccgcctgaatattcggatactcgtctggattgatttgtgcagcaatcccggcggggtacttatccttccaaaagtcttcattcatggaagcccactcctcagcgacgcgaattcatcatcgcatttgatgcgattattattggtgtatgtctttttaaggtgaatctggcgctttcaagcaggccgagacgtcacaaagcgcgccgagagtagcagctttgccaagggccgcctagagccaaaagagggccctacagtcataaacatgactcaagaacatctaatggtcatttttagagcaaagattctatatcgctgaaatccgctctggaatgggcctcacgggtgacaaataacaattgtgggaggaggctagctcccgatagcggtgggccagtcaattaaccaggtgactgacactgcgcaatcgggggcaagccccctcccacattttgaccctatttcaattcaggctatgtcgcgtagctcccgccgcagaatcttgcccaccggcgtcatcggcaacgactccctcagcacaatatgcttgggcaccttgtagcccgtgaagttggtcttgcagtacgccttcaactcctcaaggctcaccccctgggcccgtgccaccacgaacaatttcaccgcctcacccgtacgctcatccggcacgccgatcaccgcgcagttggctacggccgggtgggccatcaccacgtcttcgatttcgttggggtacacgttgaaacccgagacgatgatcaaatccttcttgcgatccacaatactgacgtagccatcggtatcgatcaccgcaatgtcgccggtcttgagccagccttcggcgtccagggtctcggcggtggcgaccggttgctgccaatagcccttcatcacctgcggcccttggatgcacagctcgccgcgttcgcccagcggcagttcgtgcccctcatcatcaatgactttcattgccgtaccgggcaccggaatgcccacggtgcccaggcgtgccaggccgccgtaggggttggtgctggccaccggtgaggtttccgtgaggccgtagccttcgccaatggagcagccggtcaacgccttccagcgttcagccgtggccttgaccagggcggtgccgccggaattggtgatcttgaggtgggagaaatccaggttcttgaagtcagggtgatccatcagcgccacaaacagggtgttgagccccaagaggcaagaaaatcgccactgcttgagttccttgataaaaccgccaatgtctcgagggttggtaatcagcacattgtggttgcctgacaccatcatgcacatgcagttcgcggtgaatgcgtagatgtggtacagcggcagcggggcaatcatcacctcctgcccttccttgaccagcgggtggccgtcctcgcccagttgcgacatgcatgcgcgcacttgctgcatgttcgccaccaggttgccgtgggtgagcatcgcgcccttggcaaggccagtggtgccaccggtgtattgcagcacggcgatatcgtccaggctcaccggatgccgcgtcacgccaagccccgcgcccatgcgcaaggcgcgcttgaacgacaccgcccgtggcaggtggtaggccgggaccatcttcttcaccttgtcgacgacggtattgaccagccaacccttggcggcgggcatgaagtcgcccatcctggcttcgatcaggtagtcgatctcggtgtcggtgcaaacctcctgtacccgcgaaccgaacaggttgaggtagaccagcgcccgcacgcccgcgtccttgaactggtgacgcatttcgcgcggagtgtacagcgggttggtattgaccacgatcagcccggcgcgcagagcgccgaataccgccaccgggtaatgcagcacgttgggcatctgcaccgcgatacgctcgccaggcttaaggtcggtgtgctgctgcaggtaaccggcaaacgccgcactctggcgctcaagctcagcgtaggtcagggtaatgcccatgttgctgaacgccggacggtcggcaaaagtcttgcaggaacgctcgaagacctcgatcaccgacttgtaggtgctgaggtcgatggcattggggacgcccgccgcgcgtttgtcattccagaaatcaggttgcattattcttgtcctcttacctgaatgtgtccggccgctctatccatttataagaagcggagccttggggacgttagcagctatggctaaacaggcaaatatgcttaatcgtgtcattgattgtatgaatcttgcggctaacgtgtaggcagatactgcgtccctctgccaatgagcgatacactgcaatgattctgagcaaatggagtcgccatgaaccacagcaccttctggctgaccgcgaacgaccgcagccgcctgtacgtcaatcaatggatacccgacgggctgcccaaggccgtgctgatgctcgcccatggcatggccgagcatagtggtcgttatgctcgcctggccgaagccctgtgcagcgcaggctatggcgtgtatgcgctggaccagcgcggccatggccgtactgctgacgagggtaccttggggctctacgccgaaaaggatggctggaacaaggtggtgggcgacctggccagcctcaaccagcacattggccagcaacaacctggcctgccgattattttgcttggccacagcatgggcagctacatcgcccagggttatctgctgcaccacagtgccagcctgcatggagcgattctcagcggttcgaatttccagccggtggcgttgtacaccgcagcgcggttgatcgctcgtatcgaacgcctgcgccagggtgcgcgcggccgcagtgcgctgatcgagttcctgtcgttcggctcgttcaacaaagcgttcaagcccacccgcacggcattcgactggctcagccgcgaccctgatgaagtcgacaagtacatcaacgacccactgtgcggcttccgttgcaccaaccagctgtggatcgacctgctcggcggcttgcagcaaatcagtaaagcgtccaatctcgcccagatcgacccgggcctgccgatcctggtgataggcggcgaatgtgatccggtgagcgaaggcaagcgtctcaaggatctggcccatgccctgcgtgaagccggctgccagaacgtgcagttgaatctctacccgcaggcgcggcacgaagtgttcaacgaaaccaaccgcgctgaagtcacagcggatgtattgacctggctcgaccaggccctggccctgcgcaggccggcccgctgcgaataatttttcgtttaaaatcagttaattaattaccgcttagccacaggatgcagctttagatgacccaggtaaccaacaccccgtatgaagccctcgaagtcggtcagacggccagctacagcaagttggtagaagagcgcgatatccagctgttcgccgccatgtccggcgaccacaaccccgtgcacctggatgccgaatacgctaaggcgaccatgttcaaggagcgtattgcccacggcatgttcagcggcgcgttgatcagtgcagccgtggcctgcgagctgcctgggccgggcactatctacatcggccagcagatgaccttccaaaagccggtcaagatcggcgacaccctgaccgtgcgcctggaaatcctcgaaaagttgccaaagtttcgtgtgcgcattgccactcgggtgttcaaccagcgtgatgaactggtggtggatggcgaagcggagattctggcgccgcgcaaacagcaggttgtgaccctgactgagttgccgccgatcagcatcggctgaggctgactgcaattttagaatctgcaaaatgcaaaaatgtgggagggggcttgcccccgatggcggtaaatcagtcacctattgagtgattgactcaccgcaatcgggagcaagccccctcccacagtcgttacagtgcaggtcttacgactgagcgcgagcctggttacgcagggctttcacttggtcgtggttgcgctgtacgccatggtactgacgctctaccaggtcacgaatgcccagcaggttgtgcttgttgatcttctcgatcgcttcacggtaagccttgagtgcgtggtcttcaccgcgctcagcttcgttcagcacggcctcttcgtctttgccggtaaccatcgacttcacgtcgacccaaccacggtgcagagcaccggccacgctgccggaatcttccggatcgccgcccagggcacgcactgcagttttcagttcagcggcggcagttgcgcaatcagcggagcgcttggcgaacagggccttgagttctggatgcttgatatcttcagcacattccttgaaacccttttggccgtcgatgctggtctcgatcaggtcgttaagtacggagatcgattctttattgatgtcagtcatttttcaattccttatacgggttagaaggttgtcttggttattgcagtgcccgtgccaggtttttaaaaacaaaaataatgttaaatttcaataagttacgatttattgaaccatctgtattgacgttatttgcatgatctgtcatttggccttcatgcagaatgcctgtattttcgaagacgtcgcctcaactgcatgatgcttatgaaccccgaaaaactcgaattgctgatcacccgtgaaatgcccttcggcaaatacaagggccggatcatcgccgacttgcccgggccttacctgaactggttcgcccgcgaaggtttcccgcacggtgaattgggcggcttgctggccctgatgcaggaaatcgaccacaacggcttgtctgaactgctcgaaccgctgcgtgctaaacacggtaaacccgcccctcgtcattaagagactcgccatgccaaggaatgctgataacgaaccccactggcgcgccatcgccgagcgctttgacctggagcctgggccgatcaacctggaaaatggttatttcgggcgcatgagccgtgcagtacaggcgcagtaccttgaacacatcagctatatcaaccgcagcaactcggtgtatgtgcgccagcgctttgagcagggtgaaaatatccagatccgccgccaattggccgcactgatcgatgtcgatccgcaggcgctcgccttcacccgcaacgccaccgaagccttgcaatcgctgatccgcaactacaaccgcctgcaaccaggcgatcaggtattgatcagtgatttggagtacgacacggtcaagggggccatgcgctggcttgcaagcgtccgtggcgtggaggtgatcgaggtatcacacacccatccggccagcttcgacagcctggtacggacttatcgcgaagcgttcttgcagtacccgcgcatcaagctgatggccctgacccatgtcacccatcgcaccggcctggtaatgcccgttgcagccattgccggggcggcacgtgaacaggctatcgatgtgatcctcgacggcgcgcacgcgcttggccagatcgagttcaacctggccgaactgggcattcaattcgccggtttcaacctgcataaatggatcggcgcgccgctgaccctgggctttatgtatatcgccccggaacgcctggccgatatcgatccggacatgggcgagtttcactacccggccacagatgtgcgcgcgcgtacgtcctacagcacgccgaattttcccgcgctgatgaccttgccattagtgtttgaagaacatcgacaattgggcggcgctgccgccaagggcgcacgggtgaattacctgcgcgatctgtgggtaagccaggtaaggccattgccggggatcgaagtgctgacgccggatgatccgcgactgtattgcgggatcacagcgttcaagttcatcgggcgggatcagcaggtgatggtggacaggttgctcaaggaacacgatctgtttgtcaccacgcgcacgggggctgcgtttggcacctgtatccgggtgacgccggggttgctgacgtcggcagtggatatcggcgtactggtcaacgccattaccgagctaagcaaagattaaactgtgggagggggcttgctccggattgcggtgtgtcagttaccagacgctgtggctgatctaccgctatcgggagcaagccccctcccacagtttttcggtgagcctgaagattttctacgggcaaaaaaaagcggcgcaccgaccaagtgcaccgcaaaaatgccgttaaagcacagcaacaacgattcggtaaatcaactcaatccagcagcgccagcgcctcggcggtgacttcctggatgcgcgcccagtcgccgttcttgatccactcagggtcaagcatccagctaccgcccacgcacatcacgtttttcaacgccatgtagctcttgatattggccgggccgacgccgccggtcgggcagaacttcacttcgccaaacgggccgccaagggccttgatggccgcgacgccgccgctgacttcggctgggaacagcttgaagcggcgataacccaggccatagccttccatgatgcccgaagcgttgctgatcccaggcagcagcgggatcgggctgtgtaccgaggcttccagcaggtcgcgggtgatgccgggggtaacgataaattgcgagccggccacttcagccgcttcgagcatatggcggtcaagcacggtgccggcgccggtgcacagctcaggacgctgttcacgcaatacctgaatggccttgaggccaaattccgaacgcaaggtcacttccaatgcggtcaaaccgccggctgccagggcgtcggccagcggcaggatgtcctgttcgcgggcaatagtgatcaccggcaggatccgcgccttggcgcagaggctgtcgatcaaggcaactttatccgccatggacacggtcggttgagggcttttcatagcggctgatccttggctcatgggcaccagtaaatctctagagtaggttgcaaaaacgcgcgaatcggcatggcagcaacatcgtcactggccagggcggcgctcaaggtggtcaatttcgaactgccggaaatcgacagcacggtgtagttggccgtggccagcaaggcgcgactcatggtcaggcgctgatgtggcacggtgggcgccagcatcggccagcaacggcgggttccgtcggccttaagcgcctcgcccaggttcggactgttggggaacagcgatgcggtgtggccgtcatcgcccatgcccaataccagcacatcaatagctggcaattcggccagcaggcgatcagcctgctcggcagcgtcttcaagattagcggcagcgctgtacagactgatgaacctggccttggccgccgggccttgcagcaggtgttgctttaacaggccggcgttgctgtcggcgtgctctaccggcacccagcgttcatcagccagggtgacggtgaccttggaccagtccaggccctgcttggccaggttctggaaaaacgccacagggctgcggccaccggacaccaccaaggtcgcctcgccacgggcactgatggccgcgcgcagttgctcggccacgtcattggccaggccatcggccagcagcacaggcgtacgatactcatgggcagtcacgccctgaggcagtttcaattcagatatcgccataccacgacctcccatcccgcgtgatcagtgcaatcgagctcatcggcccccaggaccccgccgcatacggcttgggcgcatcgccggacttcttccagccggcgatcaactggtcgcaccacttccacgcggcttcgatttcatctttgcgaacaaacaggttctgattgccgcgcattacttccaacagcaaacgctcgtaggcatcggggatccgtgcgctgcgataggtgtcggaaaaattcagttgcagtggcccgctgcgcagttgcatgcccttgtccaggccttgctccttggtcatcactcgtaaggaaataccttcgtccggctgcaggcggatgatcagcttgttgctgatctgcaggcgctgctcgggagcgaagatgtagtgggacggttccttgaaatggatgacgatctgcgacagcttttgcggcatgcgcttgccggtgcgcaggtagaacggcaccccggcccaacgccagttgcggatatcggcacgcagggcgacgaaagtctcggtgtcgctctgggtgttggaattgtcttcttccaggtagcccggcacggctttgccggcgctgtagccggcgatgtactggccgcgcaccacctgggtggtcaggccctcggggctgatcggcgccagggccttgagcaccttgaccttctcgtcacggatgctgtcggcggacaggtcggccggcgggtccatggcaatcaggcaaagcagttgcaacaagtggttctggatcatgtcccgcagctggccagccttgtcgaagtagccccaacggccttcgatgccgacctgctcggccacggtaatttccacatgggagatgtagttctggttccactgggtttcgaacaggctattggcgaaacgcagggcgatcaggttctggacggtctctttgcccaggtagtggtcgatgcgataggtgcggttttccgggaaaaactgcgccacggcgtcgttgaccttgcgcgaggactccaggtccgaaccgatgggcttttccagcaccacacgggtgttgtccgccaggccgaccttggccaggttctcgcagatcgcgccgtacactgccgccggggtagcgaaataggcaatcaggcgttgttcgctgccaacgttctcggccagggcgacgtagtcgtcagccttcatgaagtcgacatgcacataggccaggcgcgcgaggaagcgcgtggtcacggcttcgtcgagttccttgccgacgtacttacgcaattgtgtttcgatatgggccaagtgttgctgctcgctaccggcttcacgggccagggccaggatgcgcgtgtcgtcgtgcagcaacccggcaccatcgagttgatagagagcaggaaataacttgcgcagcgccagatcacccaaggcgccaaacagggcaaaggtgcagggttctacggttatcgaaggcatgatgtttgttcttttatcaagttaagctacaaataccttttttcaaggcatcactcaaggaaaaatgtagtaataaccacaacattttcccgaaatacgcattccgagtggtggtgttcagctaccctcagtaggataggccaccgcaaacggccactcatcgattggtcactgccccttatttgcatcgtcgcccgaaggaaagactgaatggaccgcgtgcgaaatcttctggaacagatccggaaccgcctcgaagaattgaacaaggccgagcgcaaagtcgctgaagtcatcctgctcaacccgcagcaggccacccgcttctcgattgccgccctcgcccaggccgcctcggtcagtgaaccgacggtcaaccgcttctgccgttcgttcggcgtcagcggttaccctgaacttaaattgcagctggcgcaaagcctggccagcggcgctgcgtatgtcagccgggccgtggaggctgatgataaccccgaagcctacacccagaagatctttggcagcgccattgcgtccctggacagcgcgtgccaggccctggacccggccctgatcagcaaggccgtggacttgttgatccaggcgcggcagatccacttcttcggcctcggggcttcggcaccggtggcgatggatgcgctgcacaagtttttccgtttcaacctggcggtgaccgctcatgcggatgtgctgatgcagcgcatgatcgcttcggtggcccacaccggtgagttgttcgtgatcatttcctacaccgggcgtacccgtgaactggtagaagtggcgcgtattgcccgggaaaacggtgcttcagtactgggtgtcaccgccgagaactcgccgctggccaaggccagtacggtaagcctgaacattccgttgccggaagacaccgacatctatatgccaatgacgtcacgcatcatccagctgacggtgctggatgtgctggcaaccggcatgaccctgcgccgcggggtggattttcagccgcatttgcgcaagatcaaagagagcttgaatgacagccggtatccggtgggggacgagttcaactaggcctggacttgtgttggctgcactggcctcatcgggagcaagctccctcccacatttgaaggtattcacaaatcaaactgtgggaggggggcttgctcccgatagggccctcagccatacacctaaaccccagccctggcctgcaaactcaaatgcgccctctcccccggcgccaggctggccccggccatcgccgactctacgcacacaaaccccgacgcctcgttgaagctcacgcccaacagcggtcggctacctgggtgccacaccaccgtgtcggcgctgtcgccggtgtcgatgcacagttcgcgctgccaggcatggtccttgagctgcaattcgccctcatgctggaacacccgctggcaaccgccatcgacccttagttcgccttcctgctggcaaacctgacggttgagctgatcataaccttgcgcgccgtcgagtccagacagcgctacctcatcaacgtgaccaatacgccagtaggcgtgcaatgcatggctcagctggcacggcagttcgtcctgatgctcagtgctcaggcgcaggtccagggtttcgcccaggtgcgcgtgcaagtccacctgccagtcacacagctgcaattgccagtgcaggcgcacgccgtcgtcgtcggtgctgctgtcgagcagcttccagtcgatcaagcgcgcccaaccatgggaaggccaggcgttttcgctgggatggcggccataccagggccagcacaccggcacgccaccacgaatggcaccgacttgcggccatttggcggcgcaccacagccagggcttctggcccgtgggttgaaagtgcagcaattgcgcgccctgacgactgaacaccgcctggcacaggggatggtcgatcaccaacacgtcgcgcatctgaaagcgttcccaggcgaacactggacgttcgcgcagggatttgaaaaagcgttgcagcggttgctcatgcatgtgcccaggtcccgaatatcacagtgcaacccaaaaaaaagcggatagccatggctacccgcaaatgcgcacagagagaggagcttatcgcaacagcgttagaacgtagactgaattttcaggccggcgaccaaggcgttgtcgactttatccacgccgccaggctggactacgtattgcaggttggggcgcacggtcagccaattggtgacgtggaaaccgtagttgagttcaacgttgtactcggtctcacgaatgggcgtgtacagcggattgtcatagtcgctcacaccattggcggcgttgagcagctgggagttcttcttcacgtcatcgttgacatgcaggcgagcaacgccaatgccgacgtcatcttttggacgcgcgtcgaatgggcctttgtacaccagcatcaacgactggtagttgtcgaccaggttggtttccttgtcgtggaaggtcgcgttggcagcgatgttcaagccacgggaagcgtcgccgttatgcgtggtcagttgctgttgcgcaacgaaccagtaacctttcttgctgctacgggtacggaagtctgcgccagaaaggacagcatcgccgccgttgacgtcttcacggacatccggggcatcggcggcgctcttgtagaagcccacacggtattcgcccggcaggttattaaccttcggcgaccagaccaattcaaccggaatcacagtacctttggtaccgctaccgctgagtttgaagccgttgccgtgctccagctgcgatgggttctggttgtaggcgccgatttgcgcatacagctcaggcgtgatgttgtacttcacgcggatcgcggcctgggcaaccggccagttgtaccaggtgttgacgtagttacccacctgggagccacagaacgacaggttctggaagtcgcacgggaaggtgttgaagtcttcgccttcaccaaagtagccgagtttcacgtccaacttgttgtcgaacatctggtgctgaatccagaactgggtcagacgtaccatgtggccacgaccgtagacttcctgggacgagctcaaggtgccggcacgcgggtcaccaatacggtcattggagatgttctgaccattacgattggtcaactggatcttggcctgggtgttatcccagccccacagtttttgcaggtccagtgccacgccaagaccaaactggtcagagtagcgaccggtcttgtcgtcgttgtagccgccgtgggcgttgtagcccatttccccaacgtagtcggccttgatgtcgataccttgctcgatcagcttggtacgctcgccgccccaatcgccggtcatccacttggaatcggcgctgaacgcatcggccgccatcgcattggcggacaatacaagggctgctgctgctgacagttggcagatcagccgagtgttgttgtgttgctttttcatccctacatcctcgtctttattgttattaaactgtttttatctaacgcgggttacattttttaactaaaacaactgcttatctgcttcagcgacccttgaactgggtcacgttgtcggcatgcccctgtgccggcagtgaagcagcggtacccagtcgctcaccggtcttggcgtcaaacagcaacaccttggccgggtcgaattgcagggtcagggtctcgcctacctgcggcgccacgtccggcgccaggcggcagcagaccttggtgtcgttgagctgcacgaataccagggtgtccggaccggtcggctcggtgacctggacttcggcacgaatgctcgatgcgctgttgccctcgcccgccgccaacatgatttgctccgggcgcaggcccaggatcacatcgcggtcttcaaggccggcgtccgtcacgttcagcgccagttcgcaacgggcctggccgctgtcgagcagcgccaccaggcgaccgtccttgcgttgcaggcgcagaggcacgaagttcatcggcggcgaaccgataaaactcgcaacgaactggttggcagggttgttgtagatctctttcggcgtaccgaactgctggatgatgccgtccttcatcactgccaccttgtcgcccagggtcatcgcttcgatctggtcgtgggtgacgtagacggtggtggttttcaggcgctggtgcatcagtttcatttcggtgcgcatctcgacgcgcagcttggcgtcgaggttggacagtggttcgtcgaacaggtagatcttcggccgacgcgccagggcacggcccatggccacacgctgttgctggccgccggacaactggccgggcttgcggttgagcaggtgttcgatctgcaacagcttggccacccgtgctacttcggtgtcgatatcggcctggggcatcttgcggattttcaggccgaactcgatgttctcgcgcacgctcatggttgggtacagcgcgtaggactggaacaccatggcgatgtcacggtccttggggctcatgccgctgacgtcctgatcaccgatcatgatcgcgccgccgctgatggtctcaaggccggcgatgcagttcatcagcgtggatttgccacagcccgacggaccgaccaggatcaggaattcgccttccttgatcgacagttcgatgttcttcaaggtgtcgggcaggccggcgccataggtcttgtttacattgcgaagttcaagcgtagccatgattaccccttgaccgcgccggccgtaaggccgcgcacgaaatacttgcctgcgatcacatagaccagcagggtcggcagcccggcgatcatcgccgccgccatatccacgttatattccttggccccggtgctggtattgaccaggttgttcagcgccaccgtaatgggctgggagtcgccactggagaacaccacgccgaacaggaagtcgttccagatctgggtgaactgccagatcaggcagaccatgatgatcggcgtcgacatcggcaggatgatctggcggaagatagtgaagaaccccgcaccgtccaggcgtgccgccttgatcagcgcatccgggatgcttacgtagtagttacggaaaaacagcgtggtaaacgccaggccgtagaccacgtgcacaaacaccaagccggtggtagtgctggccaggcccatcttgccgagggtgaacgacgccggcagcagcacggtctggaacggcaggaagcagccgaacagcaacagcccgaagaacagctgcgaaccccggaagcgccagaacgacagcacatagccgttcaaggcaccgatggcggtggaaatcagtaccgccggcacggtgatcttgatcgagttccagaagtagccatccacagtggcccaggccttgacccagccgatgccgctgaccacggtcggccagctcagcaggttgccggtgctgatgtcttcaggggtcttgaagctggtgagcagcatcaccaccagcggtaccagatacagcagcaccgccaggatcagcaccgcgtagatcgcgatgcggctcaggctgatggcaggtttggcaacgagactagtcattacgcttggtcctcagctcggaatacaggtacggcacgatgatcgcgaggatcgcaccgagcatcaggattgcactggccgagcccatgcccatctggccacgactgaaggtgaacgagtacatgaacatcgctggcaggtcggacgaatagcccgggccgccggcagtcatggcggccaccaggtcaaagctcttgatcgcaatgtgcgccaggatcattaccgcactgaaaaacaccggacgcaggctgggcagcaccacgctccaataaatgcgcggcaggctggcaccgtcgatctgggcggcgcggatgatcgactggtcgacaccgcgcaggccggccaggaacatcgccatgataaagcccgaggcttgccacacggcagcaatcaccaggcaatagaccacgcggtccgggtcgatcagccaatcgagacggaagccttcccagccccaatcacgcaggagtttgtccaggcccatgcccgggttgagcagccatttccaggcggtaccggtgacgatcatcgagagcgccatcgggtacaggtaaatggtgcggataaaaccttcacggcggattttctggtcgaggaagatcgccagcgtcaccccgatcaccagagtgatgccaatgaacatgccgccgaatacggccaggttcttgctcgcgacccaccaacggtcgttgtcgaacaaccgctcatactgcgccaggcccgcccacttgtagctgggcaggaacgtggaggtggtgaacgacagcacgaacgtccaaaggatgtagccgtaaaagcccaccagcacgatgaacatgctcggcgccagcaccagtttaggcagccagcgttgcagtgcatcgaacggcgaggccttgctgaacacagcaacagaactcatgggaaaatccagtacagggaaaaaggactaacaggtgaaccgaaccctgtaggggcgagcttgctcgcgaaggacttcaacgatagcgcgtgcatccaggatgaacgcggtgaccttgagtttttcgcgcgcaagctcgctcctacagatatctgcgttacttggccgacttgatcgccgcgccaagcttcttggcggtgtcggccgggtcggctttcgggtcattgatgtagttggtcaccacgtcaaagaacgcaccttgcaccgccagggtagtggccatgttgtgcgccatgcttggctgcaggccgccggtcttggcgtcggtcaggaagtccttggcggcggtctgggcgcaggagtcgaagccgtaggaatccattttgttcagcatgtcgttacgcacagggatcgagcccttgttgatgctgaacaccttctggaagttttcacccagcacgactttggcgatgtcctgctgacccgcggcagtgcctttgtctttctgcttgaacaccgccagggagtcgatgttgtaggtgaaggctttgtcggtgcccgggaaggctacgcactcgtagtccttgccggcgactttcttggccgcagtccactcggacttggcccagtcacccatgatctgcatgccggccttgccgttgatgaccttgccggcctcgaggttccagtcctggcctttaccgtcgacgtccatgtaggtcgcgactttcttcagctcggtgagggccttgaccatttccgggccggtcagcgcgccgttatccaggtcgaccagggctttcttgtagccatcggcgcccatcaccgacagcaccaccgcttcgaacacggtgctgtcctgccaaggctggccgccgtgggcgagcgcaatgaagcccgcagcttttagcttgtcgccggctgcgtagaattcttcgagggtggtggggttcttggtgatgccggctttcttgaagacttccgggttgatccacagccagttcacccggtggatgttgaccggtacggcaacgtagtcaccgtcgtacttgacggtgtcggagactttcttgtcgagcaaagaatcccatttttctgctttggcgacgtccttgagcacgtcggtatcgagcagaccggtggacgcccattcctggatgtcggggcccttgatctgggcaacacctggtgggttgccggcgaccgcgcggcttttcagcacggtcatcgcggtggcgccaccgccacctgctacggcaccgtctttccaggtgaaaccgtctttctcaacttgggccttcagcacatccacagccgctttctcaccgcctgaggtccaccaatgcaccacttcaaccgtacctttggagtcggcggcaaatgcactgaggggaaacaacgaggcaatggaaatagcgacggcgaggcgattaatcgcgttcatctgagtaccttttcttgttgttatgcatgcaagtctagagcttgcgctgcacggagtttaaacatggatttgcagggtgcaggtaacaaagggacgtacaaatgtcaccacttggtgacataaacgccctgagctaaagcgctggtcatgctgggcgacaagggtagcgccggcagcaccaccgcttgccaggcatggtacaggtccggtttgccaccccagatcttgctgctgggctggttgtgggggctgagctcgtggtgccagctgccgttgtggcggtcgataaagtgggtttcgcagaactcccagattcggcggtaccaggtttcgtaatgcagctcgccggtgcgcttgagcagggcttgcgcggcggcgctggcttcggcgtgggtccagtgcagacgctcgcgtaccaccgggcgatggttccagtccagggtgtagacgatgccggcagcgccatccaccgcccaggcgtattcacaggcactggcaaacaggtttttcgcgtcgcttaccagccagtctggcgtgctgagccctgccagcaggcgcgaggcttcaaggtgcaacaccagccgggcccattcgaaaccgtggccgggggtgatgccataagggcgaaagccatcggcggggttatcttcgttgtagtcgagcagtggcttccactgcgcgtcgaaatgctcgatcaccatgaactggttgccggcggcatgggtgtggattacccgctcgacgatacgtagtgcacgatccagccaacggctgtcaccggtcacatcagccagcgcaaggaaggcttcggtcgcatgcatgttgctgttggcgccgcgataagcttcgacgccgctccagtcctgggcgaaggattcgagcatgacgccctcctcctcgctccagaaaaactggtcgatgatatggatggcgtcgctcaataaggcctgtgcaccgggcgcgccggccactgcggcagagctggcggccagggcgacgaaggcatgcaggtaagctgccttgccggtgttgccatcaagggcgtcgggagtggcgaaccagccaccgtgctcactgtcgcgcagcggcccgccaagggcctcgacaccatgggccaccaactcggcataaccaggcaggcccatggcatgggccatggcgaagctgtgggtcatacgggcggtgttcatggtctcggcgtgggcgtcggccggcagttggcctttatcgtccaggttgccgaaaccgtccggcaaccgcgatgccttggcaaacgccagcaggcgctggccttcggcggcgagccaggcgtgatgggcaggtgcgttcagccaactgctggcaggcagtggttgggtggtcatgggtagcccttattgttttttgtgggatgaccggagtctaaacaagggcgcgggaggggcaagtaacgaaggggaaaagaaatgtcaccgcttggtgacaatccatgtaggagcgagcctgctcgcgaaaagctaacaagcaccgcgtttatccaggataacctgcgtgatcgttaacgtttttcgcgagcaagctcgctcctacagaggacgattggtggtcactgacccagcggtgtggccgcagcaggcgcattgaggcgctggttcagattctgcacctggctttgcaaggtggtgatattgcgggtggtctggatgcggaacacgtcgaactccttgttggtcggcgcatcgaggttggcaggctggttttcctgggcgctcttgagtaccagcacgtcctgctcgaggcgggcaatggccgcgcttgggttgccctgctttttcaaggccgccacctcggtggacaggtccttgatctcgccttgcgccgccttgagcgtcgcaacggcatcggtcagggcctgcacctcgccttgcaacttggcgttcgccgccgtcagctcggtggtgctggcggtcatctgggccaaacggctgtccagttcggtggcttggccagccacgcccagctgttgcttgttctgctcctgcaactggtcctgcaactgcttaatctgcagtttcaacgcttcgctgccgttgttcacgttggcttcactggctaccaccttgccggaaatagcctgcaggcgccccgccgcttcctcgctgatccgcgcaaagctttcctgggtggcgaccaactgctggcccatcagcgaaatctgctggaagctccaccaggcgaggccagcaaaggcgatcaacagtgcgccgaccaatgcccacaatgggccggtgctggcgctcttgaccttgaccacgggcgtcgcgcgcgagcgcaccgacgtggcgggggtcggcacgaaatcatcgtcgtccccatggtcggcccgcagggtgggaacgttgtcgagatcgtcatttgcatcgttacgcatgaatctaccctgaatcaatgaggtggctggctgcaaagccgagcggcaggagtataaaccgcactcccggcgcatggatcgacccggaacctggaattcggttcccggtgtgttgctggttatgagcttatttgaagcccgggtcctgagccttccaccagctgcagaactcgtcgagcgcggcccacaggctgaccttgggctcatagtcgagataatgcctggcgcggctgatatcgagggtgaaatccttgttcatcacctgcatgcccaggcgcgataacgccggctccggccgccccggccacatggcgcaaaatgcctcattcaaggctgccacgctgtaggacaaaccgtaggatcgataccgggtcacttggggcagttccatttgccgcattacatagttgaccacgtcccacaccggcaccggcgcaccgttgctgatgttgtaggccttgcccaacgccgaaccgggggcgagcaggctgctgagcaatgcttcattaagattatgcacactggtgaagtcgaccttgttcaggccgtcgcccacgatagccaggcgatttttgcgctgcatcttcaacaagcgcgggaagatgctcatgtcgccggcaccggtaacgaaacgcggacgcaatgccagcacttcaaggccgaactcctgggccccgaagactttctgctcggccaggtacttggtcgcggcatagggatgcttgaaacgcttgggcacttgctcttcggtgagccccaaatgatcgcggccatcgaagtagatagacggcgacgacaggtgcaccaggcgcccgacgcgctgcttgaggcaggcttcgaccacgttttcggtgaccagcacattaccctggtggaagtcctggtacttgccccacagcccgacggcaccggcacaatgcaccacggcttcgacatcgcggcacaggtcgcgtaccaggtcggcatcattcaaatcaccctggataaactcggcaccacgccgtaccaggtgttccacaccttcggcgcgccgcccgttgacccgcacatccaggccctgctcaagggcgaagcgcgcaaagcgcccgccgatgaagccgcttgcgccggtgaccagaattttcatgtagtactccgtgttctttcgtttttcatcgctgttgccttgacgcctgccgctactccaacggcaccaaccattggccacacgcctgggccagatggtcggtcaacaggcctaacaactgcccgccactgcgccaatgatgccagtacagcggcacatcgatgggcttatctggcaataactcgaccaatgcgccggtttcaagctggtcacgcacctgcaattcgggcaccaggccccagcccaggccggcttccgtcaggcggataaagccttcggatgacgggcatagatggtgttcgaaaccaccattcaccccaagagaggccaggtagcggtgttgcaggaaatcatccgggccaaacaccagcgcaggtgtgcgcgccaattgatcggcccgcacgccctcgggaaaatgcctggcaatgaaggctgggctcgccagcgcgcgataacgcatggcacccagcaacaggctgcgcgcaccggccaccgggcgctcgctggcgcagatacaagctgccacttcaccggcacgcatgcgcttgaggccaaccgtctggtcttccaccaccagatccagcagcaagtgctgttcggcgcagaagtcgctgacggcctctgcccaccaggtggcgaggctgtcggcattcagggcgatgcgcaggcgttcgggcatgccctcctcgtcaagggccggcacctggctttgcaggtcgcgctcgagcaagcgaacctgttgcacatggttgagcaagcgccgaccgatatcggtgggcgtcggcggcgaagcgcgcaccagcaccggctggccgatacgcgtctccagcaatttgatgcgctgggagatggccgactgcgacaaccccaatacatgggcgccacgttcaaagccggcctgttccaccactgccgccagggcagacaacaacttatagtcgaacatcattttctctaatgagcgatcagcaatattggtttttcttatacaggcacgatgcgcatcatagccagcaccgtttgagcattcacaaggatccttcagtatgtggcagagctatatgaacggattgctggtggccctcgggctgatcatggcaatcggaacgcagaacgcattcgtcctcgcgcaaagcctgcgccgcgagcatcatttgcccgtcgcggctttgtgcgtgatctgcgatgcgctgctggtggccgccggagtgttcggcctggccactgtcctggcccagagcccgatactgctggcggtggcgcgctggggcggtgcggcgttcctgctctggtacggcgcgtgcgcgctgcgcagggcctgttcgaagcaaagcctggatcagggagccagcctcaagacccgctcgttgcgcgccgtcctgttgagcgcgctggcggtgaccctgcttaatccccatgtgtacttggacaccgtcctgctgatcggctccctgggcgcgcaacaaacagagccgggcgcctacgtggccggcgcagccagtgcatcgttcctgtggttcaccaccctggcgctcggcgcggcgtggctgtcgccctggctggcacgcccggccatctggcgcctgctggacctgctggtcgcggtgatgatgttcactgtggcctatcaattgatcagcgcctgacaaatattccaaaacgctctggaacctctatcccacacagttgttgcgtggttatgccgcacccccggtgctatgatcagacccctgcgccgcaaagagtacaaactccccggcgcatgtctggccgcccgtgatcggccttgcgctcaccgcaactgacctgattaggagaatcatcatggctttcgaattgccgccgctgccctatgcacacgatgccctgcagccgcatatctccaaggaaaccttggaataccaccacgacaagcaccacaacacctatgtcgtgaacctgaacaacctggtgccaggcaccgagttcgaaggcaagaccctggaagagatcgtcaagtcttcctcgggcggcatcttcaacaacgccgctcaagtctggaaccacactttctactggaactgcctggcgccaaacgccggcggccaaccgaccggcgcattggctgaagccatcaacgcggcgttcggttcgttcgacaagttcaaggaagaattcaccaagacgtccgtgggcaccttcggttccggctggggctggctggtgaaaaaggctgacggctccctggccctggccagcaccatcggcgccggcaacccgctgaccagcggcgacaccccgctgctgacctgcgacgtgtgggaacatgcttactacatcgactaccgcaacgtgcgtccaaagtatgtggaagcgttctggaacctggtcaactggaagttcgtggctgagcagttcgaaggcaaggccttcactgcctaaacagctcgttcattgaagagagcccggcgattgccgggcttttttttgcgcgccagatagaccgcccaaaaataccggaacccaacagtaacaattcaccacacaagcagcaggaggaataaacctcctgattaattttcaatgtggagaatgtcgatggatcctatttcgttggtagcaggtgctgcgggtgcagtcccactggtagcgggtattgttgataaaggtctggacttggcaaacggcgcaatggacctctgcaacaaagccatggacatggccggtgaaggctcgaagatcggtgggcaagagcaaccgccccaagagccggtcaacttttaatcgtcgtcaactcgaaggcggatctcctccgccttctcccctgccgggctttcagcccactgcccattctataagtttgtccagccaaaacctcaattgagcccaggccccaatgtccctttgactgccatcatcagattgccaatactcatggcatattgaaggccacccgcatgagacaaggaatgcccctttgaagctggaactcaagaacagcttgtcggtgaagttgctacgggttgcgctgctgtcggccttaatcgtgggcgtggcgctgagcgtggcgcagatcgttttcgatgcctacaagacacgccaggccgtggccggcgatgcccaacgtattctcgacatgtttcgtgacccctcgacccaggccgtctacagcctggatcgcgaaatgggcatgcaggtgattgagggactgttccaggacgacgcggtgcgcatggcttccatcggtcaccccaacgagaccatgctcgcggaaaagagtcgcgccttgcagcaatcccccagccgctggctgaccgatctgattcttgaccaggagcgtacattcaccacggccttggtcggcaagggcccttacagcgaatactacggcgacctgagcatcaccctcgacaccgccacctacggcaacggctttattgtcagttcggtgatcatttttatttccggcgtcctgcgcgcgctggccatgggcctggtgctgtacctggtgtaccactggctgctgaccaagccgctgtcacggcttatcgggcacctgacctcggtcaaccccgaccgccccagcgagcacaagattcctcagctcaaggggcacgaacgcaacgaactgggcctgtggataaacaccgccaaccagttgctcgaatccatcgagcgcaatacccacctgcgccacgaagcggagtcgagcctgttgcgcatggcccagtacgacttcctcaccggcctgccaaaccgccagaagctgcaggagcaactggacaagatcctcaccgacgctggccgccggcaacgacgtgtagctgtactgtgcgtggggctcgatgacttcaagagcgtcaatgaacaatttacctaccaggccggcgacaaactgctgctggccctggccgaccgcttgcgcgcccacagcggacgcctcggtacgctcgcccgcctgggcggcgatcagttcgccctggtacaagccgatatcgaccagccctacgaagccgccgaactggcacaaagcattctcgatgacctggaagcggaattcgtactcgaccatgacctgattcgcctgcgcgccaccatcggcattacgttattcccggaagatggggatactaccgagaagctgctgcaaaaagccgagcagaccatgaccctggccaagagccgctcgcgcaatcgctatcagttctatatcgccagtgtcgacagcgaaatgcgccgacgccgcgaactggaaaaggacctgcgcgacgccctgggccgcgaccagttccatttggtctaccaaccgcagatcagctaccgcgatcaccgtgtggttggcgtagaagccctgctgcgctggcaacacccggaacacggcctggtgccgcccgacctgtttatccccctggcggaacagaatggcaccatcatcccgattggcgaatgggtgctcgaccaggcgtgccggcaactgcgcgaatggcatgacctgggcttcactgaactgcgcatggccgtcaacctgtccaccgtgcaattgcaccacaccgagttaccgcgggtggtcaacaacctgatgcagatctaccgcttgccaccacgcagcctggagctggaagtgaccgagaccggcctgatggaagacatcagcaccgccgcccagcacctgctgagcctacgccgctccggggcgctgattgccatcgacgacttcggcaccggctattcatccctgagctatctgaaaagcctgccgctggacaagatcaagatcgacaagagtttcgtccaggacctgcaggatgacgacgacgacgccacgatcgtgcgcgccattatccaactgggcaaaagcctgggcatgcaggtgattgccgaaggcgtggagacagccgagcaagaggcctacatcatctccgagggctgtcatgagggccagggctatcactacagcaaacccctgcaggcacgggagttggccgcttatttgaaacagtccgagcgcaataacgccgtgagtctctgaccgcgaaaaacgatactgaatatttcccacgcataagcctttacacaaaatgcaaatctttcgcattatgtcgcagcttttgcgctccccgcgcgccctattcaccaccgaagcaggatgttcgccatgattcgtatgcccctggccaccgccagtctgctggccattgccatttcgctcgccggttgcggcgaaggtaaagacaaggccgccgcgcctcaagctcccgcagccgccagcgctaccgcacctgcggctgccgcggcaggccaggtcgacgaagcggctgccaaagccgtggtcgcgcactacgcagacatggtgtttgcggtgtacagcgatgccgaatccaccgcaaagaccctgcagaccgcagtcgatacgttcctcgccaacccgaacgacgaaaccctcaaagcggcccgtaccgcctggatcgccgcccgcgtaccttacctgcagagcgaagtgttccgcttcggcaacaccatcatcgacgactgggaaggccaggtgaacgcctggcccctggacgaagggctgatcgactatgtcgataaatcctacgagcacgccctgggtaacccaggcgccaacgccaacatcatcgccaataacgagatccaggtcggcgaagacaaggtcgacgtcaaggacatcaccccggaaaaactcgccagcctcaatgagctgggcggttccgaagccaacgttgccaccggctaccacgccatcgaattcctgctctggggccaggacctcaacggcaccggccctggcgcgggcaaccgtccggcctcggattacctgaccggtgacggtgcaaccggcggtcataacgagcgccgccgcacttacctgcgcgccgtgacccagctgctggtcagcgacctggaagaaatggtcggcaactggaaacccaacgtcgaagacaactaccgcgccactctggaatcggaacctgccaccgacggcctgcgcaaaatgctgttcggcatgggcagcctgtccctgggcgagctggccggtgagcgcatgaaggtatccctggaagccaactcgccggaagacgagcaggactgcttcagcgacaacacccactactcgcacttctacgatgccaagggcatccgtaacgtctacctgggcgaatacactcgcgttgacggcaccaagatgagcggtgccagcctgtcatccctggtggccaaggccgacccggcagccgattcgaccctcaaggctgacctggcggcgacggaagcgaaaatccaggtcatggtcgaccacgccgagaaaggcgagcactacgaccaactgatcgccgccggcaacgatgcgggcaaccagatcgtacgtgacgccatcgccgcactggtcaagcagaccggttcgatcgaagcggctgcgggcaagctgggcatcagcgacctgaacccggacagcgctgatcacgagttctgatccgtacgctgttgaaaaaggcgaccttcgggtcgccttttttatacctgtttcaaacactgctgatcccctgtgggagagcgcttgctcccgatagcagtggaccagcaaccacatgcttcactgacccaccgctatcgggggcaagcccccgcccacattttgctccgtgtaacctcaagcactttggtttacatgccttgcaccgtaggtagaatggcgcctctgaccaatcacccgagcgaacttcatggcgttgccgaccctacgcatcattggtttcatcatcggcatcttcctgatcacccttgcggtcgccatggtcatcccgatggcgaccctggtgatcttcgagcgcaccagcgacctgccctcgttcctgtgggccagcctgatcacctttatcgcagggctggccctggtcatccccggtcgccccgaacatgtgcacctgcgccctcgggacatgtacctgctgacggtcagcagttgggtggtggtgtgcatcttcgccgccctgccgtttttgctgacccagcacatcagctacaccgattccttcttcgaaagcatgtcaggtatcaccgccaccggctccacagtactgagcgggctggacagcatgtcaccgggcatcctgatgtggcgttcgctgttgcactggcttggcggtatcggctttatcggtatggcggtggcgatcctgccgctgctgcgcattggtggcatgcgcctgttccagaccgaatcctcggaccgctcggaaaaggtcatgccccgctcgcacatggtggcgcggctgatcgtggcggcgtatgtgggcattaccatcttcggcagcctggcattctggtgggccggcatgggcttgttcgatgcgatcaaccacgcgatgtcggcaatttccaccggtgggttttccacgtcggatgagtccctcgcgcactggaaacaacccgcggtgcactgggtcgccgtggtggtgatgatcctcggcagcttgccgttcgccttgtatgtggccacattgcgcggcaaccgtcgggcgctgatcaaggaccagcaggtgcaaggcttgctcggcctgttgctcgtgacctggttggtactcggcacctggtactggtggaccaccaatctgcattggctcgatgccttgcgtcatgtggcgctgaatgtgacgtcagtggtgacgaccactggctttgcactgggagactatagcctatggggcaacttctcactgatgctgtttttctacctgggctttatcggcggctgttcgggctctacagccggcggtatcaagatcttccgtttccaggtcgcttacatcctgctcaaggccaacttgaaccaactgattcacccacgcgcggtgatcaagcagaagtacaacggccatcgcctcgacgaagaaattgtgcgctcgatcctgaccttttcgtttttcttcgccattaccatctgcaccatcgccctggccttgtcactgctgggcgtggactggatgaccgccctgaccggcgccgccagtaccgtatccggcgtcggcccgggcctgggcgaaaccattggcccggccggcaacttctccaccctgccggatgcggccaagtggatcctgtcactgggcatgctgctgggccgactggagattattaccgtgtttgtgctgtgcattccggcgttctggcgtcactgaccgccgacattgccagcaaccgcgcccggtattcgccgggggtggcatcaaaccagcgacgaaacgcacggaaaaagttgctcgggtcggcaaaacccagcaggtaggcaatttccagcaaggtcatgttcggctgcgccaggtattgctcggccagttcgcgacgggtgtcatcgagcaaagtctggaagctggtgccctcttcctgcagacgccgctgcaaggtgcgctgggacaggtgcaacgtctgggccaccgcttcgcgcttgggttcaccctggggcagcaaacggcacaacacctgccgtgccttgtgggtcacgcgactttcagaaaaacgcgccaggtattcaccggcaaaacggtcatgcagcagtgccatggcttcgttggctgtgggcaacggcgcctccatgtcggcttgctcgaagatcagcgcgtcatagggtgcattgaattgcaaaggcgcatgaaaggcctgtttgtacggcgccaggtccgcgggttgatcgccctgcagcagcacgttgcgcggttgcagggtgcgtccggtaagccagccgcacaaggccagggcgctggccaacgaggcttcggcgctttgtcgggtcggcggcaggtgatcgccatgcaccgtcagaatcaacgcatagccttcagctaaaagtcggaagctcaagtcagcgctttcggcgatgatgcgctggtagcgcaccagtcgcataaagccttgggccagggtgttgctggacatcaaggcataaccggcgacatgaaacgaggcaggacgcaccaccttgcccatgttcaggccaatcgcggggttgcccgacaactccaccgcccgctgccacaggcgagtcatggcatcctgagggaaacgcgcgtcggggtcattcagcgccgcataatccaggcccagctgcctgaacaaggcacggcaatccaggccgtccatttccagtgccttgactatccccatcgcccagcttgcagaagttgttcgttcgctcatggcgtcttcttattggaaagcaggctcaaacggcagccaggaagccaaggatactaaaatggcatctattgtcactggccgttacctccgatgactctagactcaaataagctccccgccgaacatctgttgggcggtataacaacccgagggccggcagtcgtggaaaacgtcaagaaattcaacagttttgccgagttctacccgtattacctgagcgagcatggcaacagcacctgtcggcgcctgcactttatcggcactaccttggtgatcggcatctttgcgtatgccattggcaggggctcactggttcttttgctggccttgcccgtcgccggctacacctttgcctgggtcggccactttttcttcgaaaagaaccgcccggcgaccttccagcatccgctctacagcttgttgggggattttgtgatgtaccgcgacatgatcctgggcaaagtgccgttctaagggtgtgacctcatgtcacttgcgtttgaaccatgaaaaaatgtgaattcgccgagataaaagtctttttgtcatttacggtgctgtatcctgccaaggctttttgagagcgcggaatcacctgcgattgaaaaaacagaccttgcgaggagcgacgacgatgcacgagatacctaatctccccttcccaagcctgcacccaactgagcagccaacaccgcagcaggccagcgacaagcagcctgaggccaaagaagcaaaaccagtcgaccgcgaaagccaggactgacgccgtaccagaccgtgtggaaagcgcacctttgagcgctttccacactgcctgaatcacccgagaccttcatcatgaccactacccttcccgataccccggacgccgccgtgctcgacgctgccttgcagatggtcgaagtctggaaccgcctcagtgcagacaagcaggccgcattgctcaagcgcttcggcacccaggaaaacgccctggcggccctggtaacaactcaactgttggcccctgcccaggcttgatgtgttgttgatctgacgttttacatttttcccgccctgcccggcctgcgcgccggtatcattagcagcctatctttgcctgctgcgacagtggacctctcccatgccagattcccagcgacccatggcggtcacgctgcaagttgtctccatcgtgctgtttacctttatcggctacctgaatatcggcattcccctggccgtcttgccgggctacgtccatagccagttgggctatggcgcggtgatcgccgggctggtgatcagcgtgcaatacctggccaccctattgagccgcccctatgccggcaagattatcgacaacctgggcagcaagcgcgccgtgctgatcggcctggtgggctgcggattgagcggggtgttcatgctgctggcagcgtggttttccagcctgccggcgctcagcctgggcagcctgctgatcggtcgactggtgctgggcagcgctgaaagcctggtgggctcgggcgcgattggctggggcatcggccgcgtcggagcggcgaatacggccaaggtcatctcctggaacggcatcgccagctacggcgcgctggcggtcggcgcaccgctgggggtgctgatggtcagccatttcggactgtggagcatgggcgtcagcatcattctgctggcggtagtgggtgtgctgctggcctggaaaaagcaagcggcgccaattgtgcctggcgtccgcttgccgttcatgaatgtgctgggccgggtactgccccatggttgcgcgctggcgttgggctcaatcggctttggcaccatcgccacctttatcaccctgtactacagcacccagcactgggacaacgcggtgtgggccttgagcctgttcggcgccagctttatcggcgcacgcttgttgttcggcaacttgatcaaccgcattggcggctttcgggtcgcgattgcctgcctgtcggtggaagtgctcggcctgctgctgctgtggctggcgccagatgcccaactggcgttggcaggtgcggcgttgagtggcttcggcttttccctggttttcccggcactgggggtggaggcggtcaacctggtgccggcctccagccgtggctcggcggtgggcgcctattcgctgtttatcgacttgtcactgggcatcaccgggccgctggctggcgccgtggccgcaggttttggctttgcgtcgatcttcctgttcgccgccctcgccgctgcagcgggcttgctgctgagcctctacctgtaccgccaggcgcccaaggcccgcgagacacgcgacgcctagaagtcgaccttgccgcgcccggccttgatgctgccgcgcttggtcttggactccagacggcgtttcttcgagcccagggtgggcttggtcggacgacgctttttctcgaccttggtggcgctctggatcaactccaccaagcgctccagcgcatcggcgcggttctgttcctgggtacggtattgctgggccttgagcaccagcacgccttcgctggtaatacggctgtcgcgcaacgccagcaggcgctccttgtagaactccggcaacgacgacgcgggaatatcaaagcgtaggtgcaccgcactcgagaccttattgacgttctgtccgccggcaccttgggcgcgaatggcggtcagctcgatctcggcatcgggcaagtgtaggttgttggaaatcaccagcatgagcaacaaggtcctccagaaggagttccaggatacgcgaatgcatcttgcccatcctctcaaacaacaaacccggcgctaggccgggtctgctcaacagcattggaagatcacttcaccgcaggagcggccatatccaagggttgttgcacccttcgcttgttcttgacccagtagcaaacgcccatgaacgccacccagaccgggatcgcgtacaccgacatctggatccccgggatcatcagcatgaccaccaggataaacaccacgaatgccaggcacacgtagttgccgtacgggtaccatagcgccttgaacagcggcacctggccggtgcggttcatgtgctggcggaacttgaagtgcgagaagctgatcatcgcccagttgatcaccaacgtggccaccaccagggacatcagcagttccagcgcgtcatggggcatcaggtagttcatcagcaccgcgaccagggtgatcgccgccgaggccaggatcgaccgcaccggcacgccgcgcctgtcgattttcgccagggccttgggcgcatcgccctgctcagccatgcccagcagcatgcggctgttgcagtaggtgccgctgttgtacaccgacaacgctgcggtcagcaccacgaagttgaggatatgcgcggcggtgttgctgcccaacatcgagaacacctgcacgaatgggctcccgctgtaggcatcgccggacgcattgagtgtcgccagcaggctgtcccatggcgtgagcgacaacagcaccaccagggcgccgatgtagaaaatcaggatgcgatagatcacctgattgatcgccttggggatcacggtacgaggctggtcggcttcggccgcggtaaagccgagcatttccaggccgccgaaggagaacatgatgatcgccatggccatcaccaaaccgccgacaccatgggggaagaagccgccgtggtcccacaggttgctgaccgaggcctgcgggccgccgctgccgctgaccagcaggtagctgcccagggcgatcatgccgacgatggccaccaccttgatgatcgcgaaccagaactcggcttcaccaaagactttgacgttggccaggttgatcgcattgatcagcacgaagaaggccgccgcagacacccaggtcggaatctctggccaccagtagtgcacgtacttgcccacggccgtcagctccgacatacccaccaggatgtacaggatccagcagttccagcccgacagaaagccggcgaagccgccccaatacttgtgggcaaaatggctgaaggaaccggcgaccggctcttcgacgatcatttcgccgagttggcgcatgatcatgaaggcgataaagccgcagatggcatagcccaggatcattgacgggccggcggacttgagcaccccggccgagcccaggaacaggccggtgccgatggcgccaccgagggcgatcaactggatatgccggtttttcaggccgcgtttcagctcgcctgaagaagaatggggtccactcatgaaaagggtctcacgcaaggtttgaagatgttgaatgcaggttgctgtcttgaattaccgactcaagcagcgccgctcaaaccccagcgcaggcaccaggagtacagcgtctttctaacggtcatgcgtcacctgtttgtttttatctgtgacgaaatcgaacccgtccggctcgtggccgggcggagtgatcagggcgaacaaaccctgggtcttggccttttgcgtgggtacgcaaggggggtcacagtaaaacgcggcgcattgtacaccgctcggcggcttcgggccgagcctgcaaagcgcacgcgacaaactggcagatatctcttacgcgttcggcacacgctgaaatagcagggcaaaatcgtaaacttatcgttacatcatggaaaacctacgttacagccggcttttaccgtcatccaccagaaaattgtcggtgcgaattttccgcagaatcggttcagccaattcactgttttgcttgaataaaaaaatccgcaaaaaaacagaagaaaaaatccaaatgagaccgtgtcaataaattttttgcattctgaaacacactcttctaggttctttgcacttgcccgcaaagcccgcgggcaagccgttctcaaacaacgtcctctaggagatacaccatgcaagcactggaaaaagacctggaaaccgaactgcaactcgacgattggtttgaagcgccgacccatgaggccgccgttgaaatgatgcaagccgatgccgttgtgcctttcggcaccgcgatgtggcctttctaatacccggcaggcattcggcaggtgctgtgcacggcacctgcccccttacccaggcacagaaggacacacgtcatggacaaggcccgcgccgtcgaacactttctctactacctcgcacaccacccggccctcagcggcctgcatcgtcccaccgtgctgctgggccataccgagcgctacgacgccatcgcccaggcaatcacccacggtagcgccgcgcgcttcaacttccagctgcaacgcctggacctggcgcccagcgacactctggtcaaggccatcgaagcctgcgacctgtacctgtttctctacgactcctcgaccctgcccaatccacgtgctgaaggccctgattttatccgcgccctgcacggcgtgatggccgagcactggaagaaatccctgctattcaaggattacggcgattacttctacgacacattcagcgtcgagccgcagcgcatcgccgaccttaacgccacgctgatccgacgcatgtcccaggccaatgtactgagcttcaccgacaagcacggctcgcgcctggaagcgccgatgagcagcatcaagaagtggaccaatatcaacggcgtcggcaaccacgacctggcccccggcgaaatcgccacccacagcgaagccatcaatggccaggtgcggtttgtcggcaccttcctcagcactattccgtttgcacgcaaatacggcgtgctgcaatcaccgctggaattgtggatcgaaaattcgaccatttgcagcgtggccagcgaggtgccggggctggcggatgatttcaacaaatacctgaatgctaacccgtccaaccgtcgcgtggaggagttgggcattggcaccaatgaaggggtcaaggatctgtatgcgcgcaacgccgggttcgaggagcgccattgcgggttgcacctgggcctgggcggcgggcagaaaggcagccatcacctggatttgatctttgccagtggggtgttggccttggacgataaaccggttttcgatggaacgtttgccttctgaacacaagactcaaaaacaccgcagaccaaatgtgggagggggcttgctcccgatagcagtgtgtcagtaacagatacttaggctgatataccgctatcgggagcaagccccctcccacagttgattgcatttcaaattcagatcgaaaaaaaacgccaaccctagggttggcgtttttgtgcagcgcttagcgcatcactgcggcttcttgcgaccaaaacccggacgctggccggaaccggccggggcgccgcggcgcttgcccgatggctcatcggctaccagtttcgggccagggcgcttgttcgccgctggcttggctggacgcttggtactggcgctgtcggccgggcgatccgcttcaccacggttgctgcgaccaccgcttggcgcttcgccacgagcaggacgtggtgtgcggggcgcacgctcaccttcctgacgggacggtgcggtagggcgacgctcaccttcgatctgcggctcacgggagatacgaccgccagtggccggggcattcagcgccgggcgcagggtacgggccacgcgctcggtacgcgctaccgggcgcgaggatttgcgctgcatacgctcaagcttgtccttgctcttggcattcatctgcggcatcgcgaccggcgtcaggccgacttcggcactgaggatgtcgacttcgtactggctcatttcgcgccagcggcccatcggcaggtcggagttcaggaacaccgggccgaaacgcacgcgtttcaagcggctgaccaccagcccctgggattcccacaggcggcgcacttcacggttgcggccttccatcaccacgcagtggtaccaatggttgaaaccttcaccgcctggggcctgcttgatatcggtgaacttggccgggccgtcttccagcaccacgccggccttgaggcgttcgatcatctcgtcatcgacttcaccacgtacacgcacggcgtattcacggtccatctcgtaggacgggtgcatcaggcggttggccagttcgccgtcagtggtgaacatcagcaagccggtggtgttgatgtccaggcggccgatgttgatccagcggccttccttgggcttgggcatcttgtcgaacacggtcggacggccttccgggtcgtcacgggtgcagatttcgccatcgggcttgttgtacatgatcacgcggcgcaccgattcggcagcctcttcacgcttgatcaccttgccatcgatggtgattgcatcgtgcaggtcgacacgctggccgagggttgcctcgacgccgttgaccttgatgcgcttctgggtgatccaggcttcgacgtcgcggcgcgagcccacgccgatgcgcgccagcactttttgcagcttttcgcctgctgggccgatttcctggtctttctggtcttggtcattcatcgtaagcacctcccggtgggtcgattcaggcgtggcctgaagggtattgaaagcggggccttgggcgaataggtcgccaaggggtcgcgaatcatacgcgcatggcgcgtgttgcgcatcacagactagtcgataaagcccaagtcatttgcttttccgccgaccggtggcgccaagggccagcaagcgtagctcggcttcggcgagaaccgtgcgcttgtcgactttgtcgagtttcttccaggcgcggatttcacgcttgctgcgtccgcagccgacgcagacgtcgtcggtgaacttgcagatgctgatgcacgggtctttggttgaactcattttttctcccagaccatccagacaatggagatccaatgtgggagggggcttgctccctcccacactaaatcagcatcagtcttcgagttggcggcgttcgttttcgatggcctctgccagcgcccgggcttcgtcttcttcgtcgctcagcggcggctgttcgagggccgcgacggcggccagcagtttttcccgggcttcggcgatgcctagcgtgtcttcttcgacttcaggctcaacttcaacgttcacctgggtttcaggttcagccgcgccgtcacgcaacaggtcatcaaagtcggtcttgatcccctgttccatatcgtccagctccaacaacagcgtatggaaactggtctcgtcctttggctcctccggctcggcactggcgtcggccagttcctgcaggctggccggcaccggcgcgtcgtcgaaatcgagcaccggctcggcttccatttcgcgcagttcggccaggggcggcaggtcgtcgaggtttttcaggttgaagtggtcgaggaacaccttggtggtggcgaacatcgccggtttacccggcacatcacggtagccgacgatgcggatccactcgcgctccagcagggtcttgacgatatggctgttgaccgccacgccacgcacgtcttcgatttcgccgcgggtgatcggctggcgataggcgatcagcgccatggtctccaacattgcccgggaataacgctgggggcgctcttcccacaaacggcccacccacggcgaaaattgctcgcggatctgcaggcggtaacccgacgccacttcgcgcagttcaaaggcacggccgtcgcaggacttgcgcaggatctccagggctttcttgaagaccggcggctccgggcgttcggcttcttcaaagagttcgaacaggcgctccagagattgcggtttgcccgaggccaggagaaaggcctccagcaagggtgccagttcgcggggttcagtcagattcatcgattcagctcgttattcggctcgcgcccgcacgtggatagccgcaaaaggctcattctggaccagctccaccaaggactccttgaccagttcgaggatcgccataaaggtcaccaccaccccaagtcggccttcttcggcagtgaacagctcgacaaacggcacaaacccaccgcccttgagacgttccagtacatcgctcatacgctcgcgagtggacagggcttcacggctgacctgatggctttcgaacatatcgccacggcgcaacacctcggccatggacatcagcagttcttccaggctcacatccggcagcaatttacgcgcacgcgcttcgggcgcatcgagtttgggcaccaccacatcgcggcccacacggctcaggttgtcgatgccttcggcagcggccttgaagcgctcgtattcctgcaggcggcggatcagctcggcgcgcgggtcatcctcttcggcttccaccgtttccgagcgcggcagcagcatgcgcgacttgatctcggcgagcatggcggccatcaccaggtactcggcagccaactccaggcgcaccgactgcatcagctcgacataacccatgtactggcgagtgatttccgccaccgggatgtcgaggatattgatgttctgcttgcggatcaggtacagcagcaagtccagcgggccttcgaaggcttcgaggaacacctccagggcatccggcgggatatacaggtccaggggcatttccatgaccgcctggccatacaccatggcaaacggcagttcctgctgggcgccggcctgggggtcagcggtttccacggccgacactcaggcctcgaccatgaacggtgtagggtcgccgcaacccacgcgcaccacctccggttcgccatcggcgaggttgatcaccgtggaagccttgttgccgccataaccgccgtcgatgatcaggtcgacatgtttttccagcaggcggcgcatttcgtaagggtcatacagcggctcggtttcacccggcagaatcaacgacacgctcatcagcggttcacccagctcggccaacaaagccagggctatcggatgctccggcacacgcaggccgatggtgcgtttcttcgggtgcagcaacaaccgcggcacttcgcgggtggcgttgagaataaaggtgtagggccccggcgtgtgtgccttgagcaggcggaaggtgccggtatcgaccttggcaaacagccccagttgggacaagtcgctgcagatcagcgcaaagttgtgcttgtcatccagttgacgcaggcgccttacgcgttcgaccgcgcccttgtcgccgatctggcaaccaatggcataggacgaatcagtcgggtagatcaccacgccaccagcgcggatgatctctacggcctgcttgatcaggcgcgcttgcgggttttccggatgaatctggaagaattgactcacgtgttctacctgttcagacggtggcaataatggggtcatgcttgaatcgcccccacaacagcggcagatcttccgggacttggcgatactcgccaatctcggaccagccgcctgggccatggaaatcactgccggcactgaccagcagaccaaattcgcgggcaagaatcgccaggctgccaacctgttcggcaggttgatgcccgttgaccacttcgatcgcgtggccgcccgctccaatatagtcgctgatcagcttgcgacgcttgctgcgggtgaaatcgtaatgccagggatgcgccaggctgacccaggccccggaggcccgcagggtctcgacggtgtcttcaagggtcggccaatgcagcttcacatcgcccaacttgccggcgcccagccatttgcgaaaggcctcggcgcgatccttgacatagccttcacgcaccatccagtcggcaaagtgcggacgggccggtgcgttgccactgtcacccagctcctgctggatggcgcgggcaccgtccaaggcaccgggcatgcctttaaggctgagcttgcggcttatttcttcggaccgcagccagcggccatcgtgcaattgggcgatggcggccaccaggggtggggcgttctggtcgaagccgtagccgagcacatggatggtggcaccgccccaggtgcacgacaactccacgccgttgaccaactgcatgcccagggaatgggcggcgtcacgggcttcatcgaggccctcgagggtgtcatggtcggtcaacgacaggactcgcacgcctttttcaaacgcccgcgcaaccagtaccgcgggcgccagggcgccgtcggaggccgtgctgtggcagtgcaaatcaacattcacgtgggtatgtaacctcaagtcagctggcgctatcgcaaccaaggatgtttgttattatgccgccacatccagcttctggctcttactgtgaaacaattcatcgacttcatcccgctgttgctgtttttcatcgttaccaaactcgaccccagggtcatcgaaatcgccggtcacgagctgtcgttcggcggcatctacagcgccaccgcggtactgatcatcagctccatcgtggtctacggcgccatcttcatctcccagcgcaagctggaaaaaagccaatggctcacgctcatcgcctgcctggtcttcggcggcctgaccctggcgttccacagcgaaaccttccttaaatggaaagccccggtggtcaactggctgttcgcgctggtgtttatcggcagtcactttatcggtgaccgcctgctgatcaagcgcatcatgggccatgcgctgactttgccggaaccggtatgggtgcgcctgaacgtggcctggatcgtgtttttcctgttctgcggtgccgccaacctgttcgtggcattcaccttccaggactactgggtcgacttcaaagtgttcggcagcctgggcatgaccgtattgttcctgatcggccagggtatctacctgtcgcgtcacctgcatgacaccgcccctaccacgccgaaaaccgaggactgacatgctctacgccatcatcgccactgacgttgccaactcgctggaaaagcgcctgagcgtgcgccctgcccatgtcgagcgcctcaaacaactgcaggccgaaggccggatcgtactggctgggccacatcctgcggtagacagcaatgacccgggcgaagccggtttcaccggtagcttgatcgtcgccgagttcgcctccctggccgacgcccaggcctgggccaaggctgatccttatgtcgcggccggcgtgtacgccgaagtcgtgatcaagccgttcaagcaagtcctgccttgagcccggcggcgccgaagcaaatcggttcggcgcactgccaatggctcattattcccggtgacctgccgacaacgttctgaatattcgtgtggaatcaggagttccgatgcgcttacgtcagttgtgtctgttggcagtgttaacgatcggggctacggcccacgctgaagagccctcgtacagcggcggttccgcgcccttgtccttgagtgccgacgcccaggtcaccgagttgcagcaacgtttgaaagaaagcgaacgccagcgtgaagcactgggcaagcaactgcaaagcgcagacgctgcccgcgaaagcgtccaactgagtcgtttgcgccaagagaaccaacgcctggcccagcaactcaaagagatacagggcggcgccttgacccgctggctgaccgaacagcagcagtggttcgtcatcggcgcggccgtcgcgctgatcgccctattgtgtgggatcttcgccagcggtgggcaccgtcgccgtcgacaatggctaaattgagtgagtcatgagcgagctgttactgatagatgatgaccaagagctttgtgagctgctgaccagttggttgagccaggaaggcttccaggtgcgcgcctgccacgacggcttgagcgcccgcagagccttggccgaagccgccccggcggcggtggtgctcgatgtgatgctacccgacggcagcggcctggagctgctcaagcaattgcgcaacgaccacccggagttgccggtgctgatgctctcggcccggggcgaacccttggaccgcatcctcggcctggagctgggagccgacgactacctggccaagccctgcgatccccgcgaattgacggcgcgcctgcgcgcggtattgcgccgcagccacccggccgcggtgtcgacccaactggaactgggcgacctgtgcttcagcccggtgcgcggcgtggtcagtatcgatgagcaggaattcaccctcactgtttccgaaagtcgcctgctcgaagccctgttgcgccaacccggcgagcctttggacaaacaggaactggcgcagatcgccctgggccgcaagctgaccctctacgatcgcagcctggacatgcacgtcagcaacctgcgcaagaaaatcggcccgcatccggatggtcggccacggatcgtcgcgttgcgcagtcgcgggtactactacagcctctagaggcagccttaccaaatctttaccctctcctgacggcggctgaccttgatctccctaatctactcacatccggactcaccggaatagagacaggagaatcaccatgcgcaagacccttatcgctttgatgctcgccgctgccctgcctaccgttgccatggccatgccagaaggcccaggcccaatgggcgaaccctccggccacatgatgggtggcccgggccacggtggtgaacatggtccgcgtggcaaaggtggaccgttcagccaactggacctgagcaaggaacaacgcgaacaggtccgcaagctgatgggtgaccaatggcacgctcgcaaagacctggtcaagaagtacctggacaaactgccggccgccgaccagaaagccatgcaggatgaaatcgccgccggcaagcagaaaacccaggccgatatccgtgccgtgctcaagcccgaccaacagaagaagtacgacgagatcgtcaagaagcaagccgagcgtcgcgccgagtggaaggaattccaggcctggaaagcccagcaggcgcaaaaagcgcaataatgcgcgaggcgtaatgcctacagcccagtggttcatgccgctgggcttttcctgtttgagggtttcctgtgcgttcattgttctggcgtatcctggcaagtttctggctggccatcgccctggttgccggcttgtcgatcctgctcgggcatatgctcaaccaggacgcctggattctcagccgccatcccggcctcaacaacctggcgcaggaatggacccaactctacgaagcccagggcgaggacgctgcccaggacttgctgcaacaacgcaaacgccagtaccacatcgacgtgcaagtgctcaacgaaagcggcgagccggtggtgcgcggcactttcccgcgccgcgccgcggccttcgaggcccggcagaatgacagccaggacggccacctgccctggcggcgcctgacggccgagtacaccagcgacaaaaccggcgacacctacctgttgatctaccgcattcctcacccggagctggatgcctggcaccgcagcagcctgttgtggccgttcagcgccctggcgattgccctggtggtgctgaccctgttcagcctgctggtgacgctgtccatcacccgcccactcagccgcctgcgcggcgcagtgcatgacctggggcaagccacctatcagcaaaacagcctggcgcaattggccaaccgccgtgatgaattcggcgtgctggccaccgatttcaaccgcatgggtgcgcgcctgcaaagcctgatcggcagccagcgccagttgctgcgtgacgtgtcccacgaactgcgctcgccgctggcgcgcttgcggatcgccctggccctggccgaacgtgcgagccccgaggagcgggagaaactctggccgcgcctgacccgcgaatgcgaccgcctggaagccttgatcagcgagatcctggtactggctcgggtcgatgccgacaacgccagcgccgaagacatcgacctcaacccgctgctcaggaccctgcaaaaggacgcccaactcggcgcgccggagcaggtggtacagctcaccgctgacgccgacctacacctcaagggctggccgaccatgatcgaacgcgctgtggataacctgctgcgcaatgcccagcgcttcaacccgcccgatcagccaatcgagatgcacgcgcatcttcacggcgagcatattgtgatcagcgtgcgcgaccatggccccggcgttgaccccgaacacctgagtcaactgggcgagccgttctaccgcgccccaggccaggctgcacaaggccacggcctgggcctggcaattgcgcggcgcgcggcggagcgtcatggcggcagcctgttcctggccaatcatgcccagggcggttttatcgccagtatcgacctgccattggaacctggggttgtcacaccggtgtgaggatcttctatagtggcccttctcttacggagggcctttgatgactgacctgctgactcccatccaagccgcgctcgatttaccacacgcagcaatagccatgaccgaaaccggggccctgccctcggccttcgccgtcaccgacctggccgctgccagcatcggcgccgccggccaggccgtcgcccagttgctccagcaacagaccgggcgtttgcccaatgtcagcgtggaccggcgcctggcctccttgtggttctcctcctcgattcgccccgtgggttggcaagtgccgccgctgtgggacccagtggccggcgactatgcctgcgccgatggctggattcgcttgcacaccaacgcgccccatcaccgtgccgcggccgagcgggtgctggggcctgtggccgaccgcgccgagatggcggccaaagtcgcggcatggaacgccgccgaactggaacaggccattgtcgacgtcggcggttgcgccgcgcagatgcgtgggtggcaagcctggcaacagcatccgcaaggcttggcggtgaacagtgaagagctgatacagcgccaggttttcgaaagcggcaccgacaaaccctggctcggttcgcctgcgcgcccgctggccggtatcaaggtgctggacttgacccgcgtattggccggccccgtggccagtcgttttctcgccgggttgggtgcggatgtgttgcgcatcgatgcgccgacctggaacgagcccggcgtggtgccggaaatgaccctgggcaagcgctgcgctcgccttgacttgaaaagccccgaaggccggcaggtattcgaagccttgctcaaagatgctgacgtgctgttccacggttaccgcgccgatgcactggagcaactgggttacaccatcggcgaacggcaagacctcgcccccgggctgatcgacgtcagcctcaacgcttacggctggagcggcccgtggcgtaaccgtcgcggcttcgacagcctggtgcagatgagcagtgggatcgccgaggcgggcatggcctggaagcaggcggaaacacccgtgccgctgccagtgcaggcgctggatcacgccaccggctacctgatggctgccagtgcgatccgggccttgggcgaacgcctggcatccgggcgcggtggctcggcgcgcttgtcattggcgcgtacggcgaaattgctggtggaggcagggcaagtgccggaacaagcggcgttgcgtgccgaagagccaggcgatcagggtttggtggtggagcagacggcgtgggggcaggcccatcggttgctggcgccgctgagcatcagtggcacgccgttgcagtgggatttgccagcgggagaattgggcgcgcaccggcctcaatggtgattaatacactgtaggagcgagcttgctcgcgaaggtcgccaacgataacgcgggaaacctgacacccagcggcaatctaaggtttttcgcgagcaagctcgctcctacagggttgtccacagatgctgcgccgcatacgccctcaacggccgccacgcctcggcccgggccagcaactgtcgcgccgacaccggcctcccctccagcgccgacagcgcattgatcaggccgatatcccctgatgcaaacgcatccgcctcgcgcaactggcgcatggcgatgtactgcgcggtccagtcgccaatccccggcaacgccaccaaccgtgcaacgccgtccttgaggctggccttgggttggaacacctgcgggtcatccaacactgcctgggccacggcagacaaggtacggcctcgcgccttgggcatgcccagagtcgcgaggtctgccgccgccagcacttggggtgtcggaaacacatgggtgataccggcgtatggggcgtgcagcggctggccgtactgcgccaccagcttgcccgccaggcgaatggccgccgccacagtgatctgctggcccaacaccgcacgaatcgccagctccagcccgtcccaggccccgggcacgcgcaggccaggacggtccgcaaccagttgcgccatcaacgggtcgccagccaactgggtattgatcacctcgggccgggcatccagatcgaacatcgcccgcaggcgtcgctcgatctcgggcaaggccgccgcgtcaggaaacgcgacgcccacctccagccaatcgccggcgcccggcgccacgcttagccaaccctgttgcccgttcacgctgatgctgcgacggtacgcgccagcctcaacgatttctaatccattgatggctcgagctgacaaaaacgccaacattgccgcccaatcgtagggcggctgatacgccaatctcacaacgacaataccccgctgtataacccgtatgccgccaacccggcgcccgcgatcacgcagctgaaaatgcctttttccacgtgggtaaacaagggttggccttgctcgcgcttggcctgggcgaacaggatcacacccggggcatacagcagcgccgacagcagcaaatacttcaagcctccggcgtacaacagccataccgcatagccgagggcaatcagccccactgccaagtctttcaggcgctggcgctgggcgccggcataggtctcgccgcgcccgctcaacaacaccgcataggccgccgaccacaggtagggcaccaggatcatcgacgacgccaggtagatcagggtggtgtaggtgctggccgaaaacagcgtgatcaccaggaacgcctggatcatcacattggtcagccacaacgcgttaaccggcacctgattggcattttcctttttcaggaacgccggcatggtcttgtcctgggcagtggcatagaggatttccgcgcaaagcagcgcccatgaaagcaacgccccgagcagcgaaaccgccaggccgatgctgatcaatactgcgccccagggcccgacgatgtgttccagcacgcccgccagggatgggttctgcaactgcgctaattgcggctggctcatgatgcccagggacagcacattcaccagcaccaacagggccagcacgcccaggaaaccaatcaccgtggcgcggcctacatccgagcgtttctcggcccgcgccgagtacacgctggcgccttcgatgccgataaacacaaacaccgtgaccagcatcatgtggcgcacctgctcgaccacgctgcccatctgcgggttacccaggccccagatgtcgcgggtgaagatatccgccttgaatgccaccgcggcgatcacgataaacatcaacaacggcacaatcttcgccaccgtggtgacctggttgataaacgccgcctccttgatcccgcgcatcacaaggaaatgcaccgcccacagcaacagcgacgcacagccgatggccagcggggtattgccctggccgaacgccgggaaaaagtaacccagggtgctgaacagcaacacgaaataaccgacgttgcccatccacgcgctgatccagtaaccccaggcggatgagaaccccatgtaatcgccaaaacctgccttggcgtaggcgtacaccccggaatccagttccggtttgcggttggccagggtctggaacacaaaggccagggtcaacatgccgaccgccgtgattgcccagccaatcagcacggcgcccacttctgcacgggccgccatgttttgcgggagcgagaagatcccgccgccaatcatcgaacccacgaccagggcgatcagggcactgagcctaagtttctgggctggttgggacatgcaggttcctcgcaataaaagtttgagccgaccactgcgaactcaactaattcaatttaatcacgctagcgcttcataacataagtgcatgtaaacgcgagaagtttaggcttatttagaatttaaataagtcaattatgaagcgttcgtcagacgccgtacaaaaagtttgcacatccgcaaatacgaactagcgtcaacctccatgtcccggacgaaatgattaaccacatcggaggagcccgctctagcaagcgcccccccgcggactgtgtcgcgcagcaacttctgctccctaagtcgttaattcacaatggaatgtgccaatgaagtgatctgagtcagctgtttgattagcgcacggaattattctgtgatctctcttctcctgcattggagtcacgcaatgtctgattctcccggaaaacttaggcttggtgcgctggttgcacttgtcgtgggctcaatgattggcggcgggatcttctcactgccgcaaaacatggccgccagtgccgacgtaggcgcagtattgattggctgggtaattaccgccatcggcatgctgaccctcgcattcgtcttccagaccctcgccaaccgcaagcctgaccttgacggcggtgtgtacgcctacgccaaggccggtttcggcgactacatggggttctcgtccgcctggggttactggatcagtgcctggctgggcaacgtcgggtacttcgtactcttgttcagcaccctcggctacttcttcccgatctttggcgaaggcaatactccggcggcggtgatcggtgcgtcggtgctgctgtgggccgtgcatttcctggtgctgcgcgggatcaaggaagcggcgttcatcaacctggtcaccaccgtggccaaggtggtgccgttgctgctgttcgtactgattgcgctgttcgcgttcaagctggatatcttcaccgctgacatctggggcgtgaaaaaccccgaccttggcagtgtgatgaaccaggtgcgcaacatgatgctggtcaccgtgtgggtgtttatcggtatcgaaggcgcgagcatcttctcctcccgtgcggagaaacgcagcgacgtgggcaaggccaccgtgatcggttttatcaccgtgctgctgttcctgatgctggtgaacgtgctgtctttggggatcatgacccaaccggaactggccaagctgcagaacccgtcgatggccgccgtgctcgagcacgtggtgggccactggggcgcggtgctgatcagcgtcggcttgatcatctcgctgttgggcgcgttgctgtcgtgggtgctgctgtgtgcggagatcatgttcgccgccgccaaggaccacaccatgccggagttcctgcgtaaggaaaacgccaaccacgtgccggtcaatgccctgtggctgaccaacgcgatggtgcagatcttcctggtgatcacgctgttttcggccagcacctacctgtcgctgatctacctcgccacctcgatgatcctagtgccttacctgtggtcggcggcctacgccctgctgctggcggtgcgtggcgaaacctacgaaaacgccctcaaggagcgcaagaaagacctgttcatcggcgccgtcgcgctgatctacgcgatctggctgctctatgccggcggcaccaagtacctgctgctctccgccctgctctatgcccccggcgcgatcctgttcgccaaggccaagcgtgaactgggcaaaccgattttcaccaacgtcgagaagctgattttcgccgcagtggtcattggcgccctggtggcggcctatgggctctacgacggcttcctgactctgtaattgtatgttcactggaggatttgtaatgaccacggaaaaagttaagtacggcgtacattccgaagccggcaaactgcgcaaagtcatggtgtgctccccaggcttggcccaccagcggctgacccccaacaattgcgacgaactgctgttcgatgacgtgctgtgggtggcccaggccaagcgcgaccatttcgacttcgtgaccaagatgcgcgagcgggatattgatgtgctggaaatgcacaacctgctcaccgacatcgtcgccatccccgaagccctggactggatcctggagcgcaagatcaccgccaataccgtaggcctgggcctggtcgatgaagtcggctcgtggctgcgcagcctggagccgcgcaagatcaccgagttcctgattggtggtgtgtcggccgatgacctgccgagcagctttggtggcaagaccatcgagatgttccgcgacttcctcggccacgccagcttcatcttgccgccgctgcccaacacccagttcacccgcgacaccacctgctggatctacggcggtgtaacgctcaacccgatgtactggccggcgcgacgccaggaaaccctgctggcctccgccatctacaagttccacccggaattcaccaacgccgacttccagatctggtacggcgaccccgaccaggagcacggcgctgccacactggaaggcggcgacgtgatgccgattggcaatggcgtggtgttgatcggcatgggcgagcgctcgtcccaccaggccatcggccaactggcgcgcaacctgttcaagaacaacgccgttgagcgggtgatcgttgccggtctgcccaaatcccgcgcagccatgcacctggacaccgtgttcagcttctgcgaccgcgacctggtcaccatcttccccgaagtggtcaaccagatcgtgccttttaccctgcgccctgacgacagcaagccccacggcatcgatatccaacgcgagaccaccaacttcctcgataccgttgccgcggccctcaacctcaaggccctgcgcgtggtcgagaccggcggcaacagcttcgccgccgaacgcgagcagtgggatgacggcaataacgtggtggctgtagagcctggcgtggtgatcggctacgaccgcaacacctacaccaataccctgctgcgcaaggccggtgtggaagtcatcaccatcagcgccggtgagctgggccgtggccgtggcggcggccactgcatgacctgcccgatcatccgcgaccctatcgactattaaggagattccatcatggctttcaatatgcgcaaccgcagcctgctgtcgctgatgcaccacactactcgcgaactgaactacctgctggacctgtcccgcgacctcaaacgcgccaaatacaccggcaccgagcgtccgcacctgcaaggcaagaacatcgcgttgatcttcgaaaaaacctcgacccgcacccgttgcgccttcgaagtcgcggcccatgaccagggcgcccacgtcacctacatcgacccggtgtcgtcgcagatcggccacaaagaaagcatgaaagacaccgcccgcgtcttgggccggatgttcgatgccattgagtaccgtggcttcgaacaggaaatcgtcgaagaactggccaagttcgccggtgtgccggtgttcaacggccttaccgctgaattccacccgacccagatgatcgccgacaccctgaccatgcgcgagcacagcgacaagccgctgcatgacatcagctacgcgtacctgggtgatgcgcgctacaacatgggcaactcgttgctgatgatcggcgccaagctcggcatggacgtgcgcatcggcgcgccgaaagcgctgtggccacacgaggatttcatcaagcaatgccaggcgtttgccgaggaaagcggcgcacgcatcaccattaccgaagacccgaaagaggcagtgaagggcgtggactttatccacaccgatatctgggtatccatgggtgagccggtggaagcgtgggatgagcgtatcgagcaactgctgccctaccaggtcaacgccaagatgatgaaagcctcgggcaacccccgggtgaaattcatgcactgtttgccggcgttccataacagcgaaaccaaggtcggcaaggacatcgctgcgcggtacccgaacctggccaatggtgtggaagtgaccgaagaagtcttcgagtcgccggccaacattgcctttgagcaggcggaaaaccgcatgcataccatcaaggcgattctggtgtcggcgttggcggatatctaactctcactgtcggaacagggttcaaaaatgtgggagggggcttgctcccgatagcggtggctcagctatagatagattgactgtcctgccgccatcgggagcaagccccctcccacattgggctctgctcacaccctaaaaggattgcattatgcgcatcgtcgtagccctgggcggcaacgccctcctgcgccgtggtgaacccatgaccgcagacaaccaacgcgccaatatccgcatcgctaccgaacagatcgccaagatccacgccggcaacgagctggtgatcgcccacggcaatggcccgcaagtcggcctgctgtcgttgcaggcggcggcctacaccagcgtctcgccctacccgctggacgtgctgggcgccgagaccgaggggatgatcggctacatcatcgaacaggaactgggcaacctgctggacttcgaagtgccgttcgccaccctgctcacccaggttgaagtcgatgccaaggacccggcgttccagaacccgaccaaacccatcggcccagtgtattccaaggccgaagcagaaaaactcgccgccgaaaaaggctgggccatcgcccccgacggcgacaaatatcgccgtgtggtcgctagcccacgcccgaaacgcatctttgaaatccgcccgatcaagtggctgctggaaagaaacgccatcgtgatctgcgccggcggcggcggcatcccgacgatgtatggcgaagacggcaaactgcgcggtattgaagccgtaattgataaagacctgtgttcatccttgctggcctcgcaactggacgccgatctgctggtaatcgccaccgacgtcaacgccgcctttatcgacttcggcaagccaacccagaaggccatcggccaggctcacccggacgacatggaaaaactcggcttcgccgccggctccatgggccccaaggtgcaagcggcctgcgagttcgcccgccagactggcaaaaccgcggtgatcggttcactctcggacatcgaagccattgtccagggcagcgccggcacccgcatcagcacggcgaaacctggcatcacctatctgtgaagtagaggagatacgcctatggctacctttgaacccggccacttgcacgttgaacgccacgcgctcaacaaggacgactacagctacaacctgtgcatcgactatgaagtcagccaggacccaaaggaaggcaagggaatgctcttcaagctgcacggttcggtgcagggcaaggacctcaaggaagagttcttcctggccaaggaccaggccttcgattttgcgcggcatgcgatgaacattgcgcagaaatacggcatgccgaaagtcgcagtgttgaatgggtcgatgcacaagcagtacgacctgatgtttgaggatgtgcggcatcagctggatgtgaaatcaggtgatccagtcaagcccgaacatctggaataacacgcctgcactgacacagtgcagttcaaaatgtgggagggggcttgctcccgatagcagtgtgccagccacaggttgattggctgatccaccgcaatcgggagcaagccccctcccacattttgatctccatcatttgtcagatttcacctacgccccgctccaaggcatacttgccgcctctgctctccagaattaccaaccgccccatgcgtatccacgtcagcttcatcgaccgcgtcggcatcacccaggaagtcctggccttgctcggtgggcgcaatctcaacctggatgcggtggagatggtgccgcccaacgtctatatcgatgcgccgaccctcagcgccgaggtactcgaggaactgcgtgacgccttgttcagcgtgcacggcgtgcaagcggtaaaggtggtcgacatcctgccgggccaacgccgccacctgcaactcgacgccctgctggcggccatgaccgacccggtactggccctggacagcgcgggcaagatcctgttggccaacccggcgttgatcgccctgtacgggcgcgagcctgccggggaaagcattgccgaactgttcaatgacccaacgctgctggacaccttgctggaacatggctttcgcttaccgttgcgcgagatcagcgtcaacggccagaccctgttgctggacgccacgccaatcactgacgcaggcgccctgctcaccctctaccaacccaatcgcatcggcgagcaactgtcggcactgcaccacgaccatgccgaaggttttgatgcgctgctgggcgaatccccggccatccgcaccctcaaggcgcgagcgcaacgggtggcggcgttggatgcaccgctgctgatccagggcgaaaccggcaccggcaaggagctggtggcccgcgcctgtcacgccaccagcgcacgccacagtgcgccgtttttggccttgaactgcgcggcactcccggaaaacctcgcggagagcgagttgttcggttacgccccgggcgcctttaccggcgcccaacgcggcggcaagccggggctgatggaactggccaaccagggcacggtatttctggatgaaatcggcgagatgtcgccgtacctgcaagccaagttgctgcgctttctcaatgacggcagctttcgccgtgtgggcggtgaccgcgaagtgaaggtcaatgtgcgcatcctcagcgccacccaccgcaacctggaaaagatggtcagcgaaggcacttttcgcgaagatctgttttaccgcctcaacgtgctcaacgtcgaagtaccgcccctgcgcgaacgcggccaggacatcctgctgctggcccgctacttcatgcagcaggcttgtgcgcagatccagcgcccggtctgccgcctggcgcccggcacttatccggcactgctggacaatcgctggccgggcaatgtgcggcaactgcaaaacgtgatcttccgcgccgctgccatctgcgaaagcagcctggtggacatcggcgacctggacatcgccggcacctccgtagcacgccagaacgatggcgaaatcgacagcctggaacaggccgtggaggatttcgagcgcgacctgctggaaaagctctacaccagctacccctcgacccgccaactcgccagccgcctacagacctcacacacggcaattgcccatcgcttgcgcaaatacggcatccccaacaagccttgagccatgtgctatccactgtaggagcgagcttgctcgcgaaaaacccgagggcgccacgttcatccaggcttcccgcgtcatcgttgacgatcttcgcgagcaagctcgctcctacagtggggcgcattacagatttggtctgagaacgacattgcgtgtactgaaagcgctacagcgtaacgatatcgctacaaccctgttttttgcgcgccatgcaaggctttgatccacataggctttttttcaagcactcgactgtagcgaaatcgctacagtcaaatgcactaacgccataaccaattttattaacttattgatttataacgatttaacaaccttggccgcaatattgctaatcaactccccattattccaatcccgttcaccagacgattctggccctgaggagtttccatgagcgagttgcgtttcactgaagatcacgaatggctgcgcgccgaagccgatggcagcgtcaccgtgggcatcaccgcttttgcgcagaatgcgctgggtgatgtggttttcgtgcaactgccggagttgcaggcttacgacaaaggcgctgaagcctccaccgtggaatcggtaaaagccgccagcggcgtgtatatgccgttgaagggtgaagtgctggaagtgaacgaaaagctgagtgacagcccggaactggtcaacgaagacccgatgggtgaaggctggttcttccgctttaaaccgaccgacgccgaggcagtggctaagctgttggatcaggatgcgtacgaccgcctgatcaaagccaacgcagaagcctgaggagcgcgccatgaccgttaatctgaccaccgccaacgaattcatcgcccgccacatcggcccgcgccaggcagatgagcagcagatgctcgccaccctgggctttgactccctcgaaggcctgagcgccagcgtgatcccggaaagcatcaagggcaccagcgtgctcggcctggaagacggcttgagcgaagccgaggccctcgccaaaatcaaggccattgccagccagaaccaactgttcaagacctacatcggccagggctactacaactgccatacgccgtcgccgatcctgcgcaacctgctggaaaacccggcctggtacaccgcctacaccccgtaccagccagagatttcccaaggccgcctggaagcgctgctgaacttccagaccctgatcagtgacctcaccggcctgccgattgccaacgcctcattgctcgacgaagccaccgccgccgccgaagccatgaccttctgcaagcgccttagcaagaacaaaggcagcaatgccttcttcgcctcagtccacagccacccgcaaaccctcgacgtactgcgcacccgtgccgaaccactgggcatcgacgtggtggtgggcgatgagcgcgaactgaccgacgtcagcccgttcttcggtgccctgctgcaatacccggccagcaacggcgatgtatttgattaccgcgagctgaccgaacgcttccacgccgccaacgccctggtggccgtggccgccgacctgctggccctgaccctgctgaccccaccgggtgagttcggtgccgacgtcgccattggcagtgcgcaacgcttcggcgtgccgctgggctttggtggcccgcacgcggcgtacttctccaccaaggatgcgttcaagcgtgatatgccagggcgcctggtcggtgtttccgtcgaccgcttcggcaagccggcattgcgcctggccatgcagacccgcgaacaacatatccgtcgcgagaaagccaccagcaacatctgcaccgcccaagtgctgctcgccaacatcgccagcatgtacgccgtgtaccacggtcccaagggactgacccagatcgcccagcgcatacaccagctgactgcgatcctggccaagggtttgaccgccctgggtcttgaggtcgagcagaaaaacttcttcgacacgatcacactcaacaccggcgccaacaccaaagccctgcatgacaaggctcacgcccagcgcatcaacctgcgcgtagtggacgcccagcacgttggcctgtcggtcgacgaaaccaccacccaggccgatatccaggccttgtgggcgatcttcgccgacggcaaggccctgcccgccttcgcggccaccgacagcgcgctgcctgccgccttgctgcgccagtcaccaatcctcagccacccggtattcaaccgctatcattcggaaaccgaactgatgcgctacctgcgcaagctggccgacaaggacctggccctggaccgcaccatgattccgctgggctcgtgcaccatgaagctcaacgccgccagcgaaatgatcccggtgacctgggccgagttcggcgccctgcacccgttcgccccggctgagcaaagcgccggttaccagcaactgaccaccgaactggaagccatgctctgcgcggccaccggttacgacgcgatctccctgcagccaaacgcaggctcccaaggtgaatacgcaggcctcttggctatccgcgcctatcaccagagccgtggcgaagcacgtcgcgacatctgcctgatcccgtcatcagcccacggtaccaacccggccaccgccaacatggccggtatgcgcgtggtggtgaccgcctgcgatgcgcgtggcaacgtcgatatcgaagacctgcgcgccaaggccatcgagcaccgcgagcacctcgccgcactgatgatcacctacccgtccacccacggcgtgttcgaggaaggcatccgcgacatctgcgcgatcatccacgacaacggcggccaggtgtacatcgacggcgccaacatgaacgccatggttggcctgtgcgcaccgggcaagttcggcggcgacgtgtcccacctgaacctgcacaagaccttctgcatcccccacggcggtggtggcccgggtgtcggcccgattggcgtcaagtcgcacctcacgccattcctgcccggccacgcggccatggaacgcaaggaaggcgcggtgtgtgccgcaccgttcggcagcgcaagcattttgccgattacctggatgtacatcagcatgatgggcggcgctggcctcaagcgtgcgtcgcagttggcgatcctgaatgccaattacatctcccgtcgcctggaagagcactaccccgtgctctacaccggcagcaacggcctggtggcccatgaatgcatcctcgacctgcgccccttgaaagacagcagcggcatcagcgtggacgacgtggccaagcgcttgatcgattttggtttccatgcgccgaccatgtcgttcccggtggctggcaccttgatgatcgagccgaccgaaagtgaatccaaggaagaactggaccgcttctgcgacgccatgatcgccatccgcgaagagatccgtgcggtggaaaacggcacgttggacaaggacgacaacccgctgaaaaacgcaccacacaccgcggctgaattggtgagcgagtggacgcatccatacacccgcgaacaagcggtgtacccggtgccgtcattgatcgaaggcaaatactggccaccggttggccgggtcgacaacgtgtttggcgatcgcaacctcgtctgcgcatgcccctcgatcgagagctacgcataacctgaaggtcaactcgatcaaatgtgggagcgagcaagcctgctcccacatttttgacaacattatcgagtgctggcgcctaccagcgcgccagcacgttgttcaggagctgaatatgtccaccgaaaccctgttgaaaaccccattgcacgccctgcacctcgaactgggcgcgcgcatggtgcctttcgccggctacgacatgccggtgcaatacccgctgggcgtgatgaaggaacacctgcacactcgtgaacaggccggcttgttcgacgtgtcccacatgggccagatccgtctgaccggcgccaatgccgccaaggccctggaaaccctggtaccggtggatatcatcgacctgccggtgggcatgcagcgctacgcgatgttcaccaacgagcaaggcggcatcctcgacgacctgatggtcgccaacctaggcaacgacgaactgttcctggtggtcaacgccgcctgcaaggaccaggacctggcgcatctgcgcaaccatatcggcgaccaatgcaccatcgagccgctgtttgaagagcgtgccctgctggccctgcagggcccggcggcggtgaaggtactggcgcgcctggcgccggaggtcacccagatgaccttcatgcaatttgccaccttgcgtctgctgggcgtcgactgctacgtcagccgctccggctacaccggtgaagacggttttgaaatctccgtaccggcggccaacgcagaaagcctcgcccgcagcctgctggccgaaaccgaagtacaggccatcggcctgggcgcccgcgactccctgcgcctggaagccggcctgtgcctctatggacatgacatgaacaccgacactacgccaatcgaagccagcctgttgtgggcgatctccaaggctcgtcgcgctgacggcgcacgcgcaggtggcttcccgggtgccgaccggattttcacccagcagcaagccggcgtcagccgcaagcgcgtaggcttattgccccaggaacgcaccccggtgcgtgaaggtgccgagatcgtcgacgaacacggcaccgtgatcggcagcgtgtgcagcggtggctttggcccaactctgggcggcccgctcgccatgggttacctggacaacgcctttactgcactggataccgaagtctctgcactggtacgtgggaaaaaggtgccattacgtgtaagtaaaatgccattcgtgccacagcgttactatcgcggctgaataaatgtttcaataagtaacgcggctgcgttaacgcgcactaaactgtaacgcagccgccataaaacagtgcatatccgatagtcttttctataggaaatctcctataacaagtgaataactctatcgaataactcaccactcctacgttcaacaaagtgtcatatgcccgagcaaaaacaaggcctttcgcagggcttgtttttttcatattagttggcgtagagttcgttcactgtgtttgcatgggtcgcttggaacctggacctgggcagtagctaaaagttttgctacaacccgttcgacgtctcttactttcctgcaacccagcccagtactctttcatgtgaaaggggctgtcattaattttagcgtcaaaggaaagaagaaaatggctgaacgtcagagcggtaccgtcaagtggtttaacgacgaaaaagggtttggttttatcactcctgaaagcggcccggatctgttcgtgcatttccgcgccattaaaggcaacggcttcaagagcttgaaagaaggccagaaagtaactttcgttccggcacaaggccagaaaggcatgcaggctgacgaagtagaaccagaagcctgatccttcctgcgacaaaaagcccctgatatgacatcaggggcttttttatgggcgtttgtccgtaaaatgctgcttttccttctgagagccctgccatgtcgaagcacctgctaagcccccaaggccaattccccgccgttggcctgggccgtcgcctggcagcgatgttctacgatttcctgttgtgcacggcgctgctgatcgtcactgcatttgtctacaagctggtgtggatcgcctttgtgggcgaagcgaaaatgcgcaccctcaccgagtccggcgccctggacggtgatccgttgctgtcgacaatcctgttgtttgtgctgtttggattcttcgccaagttctggacccattccgggcaaaccctgggcatgcaggtgtggggcgtgcgtgtacaaaatgccgacggttcgcggatcagcctatggcaggcgttgttgcgttttgtggtgtcgattgcgtcgtggttatgcgtggggctggggtttgtctggtcgttgttcgataaacacaaacgcagctggcatgacatctattcggatacgcagctggtgcggatccccaagcaaaagaagtaatcgcacaatagcgtagatccaagtgttcacacctgggctatgcgttacctgccagcttgaggcgtgcagcctgggtgaagtcgagcatgcgcttgagcggtcgcaccgcctgtggaatcaccgacggctcgacgaaaatctcattactgccctctcgtagacactgcaacgtgcgctccagcgtattcatcgccatccacgggcagtgcgcgcaactgcgacatgccgcgccgttacccgcagtcggcgcctcgatgaagactttgtccgggcacagctgctgcatcttgtagaaaatgccgcgatcagttgccacgataaaggtcttgttcggcaggcgctgcgccgcagcaatcagttggctcgtcgagcctacggcatccgccaactcgatcaccgaggtcggcgattccgggtgcaccaggatcgccgcgtccgggtacaacgccttcatgtcttccaactgcttggacttgaactcttcatggacgatgcaggcaccgtcccacagcagcatgtcggcaccggtctggcgctggatgtaggtgcccaggtgtttgtccgggccccagataatggtctcgccgttgtccatcaggctttcgacgatttccagcgcgcagctggaggtcacgacccaatcggcacgggctttgaccgccgccgaggtgttggcgtacaccaccacggtgcgctccggatgctggtcgcagaacgctgaaaactcatccaccgggcaaccaaggtccagggagcaagtggcttccagggtcggcatgaggatgcgtttttcaggggtgagaattttggcggtctcgcccatgaaccgcacaccggccaccagcacggtcttggccggatgggcggcgccaaagcgcgccatttccagggagtcggaaacacagccaccggtttcttcggccagggcctggatcaccgggtcgcaatagaagtgggcaaccagcaccgcatcctgagccttgagctcggcggcgatggcggcgcgcaggctcgcctcttgcgcggcgctgagcaccttgggctgcttggcgtcgaggtgggcttgaaccagtaggcgttcggaaatgtgcgtcatgttcgcaagacctgcaggcgcagtagcgcgaaagtcgagtgtaccaccggctctggagcccttcgggcgccgccggacgaagtgtttgtgttcatcaagcacgggtaaagatgaagccgcgcaaggctacagaatatcgaatggattcaaaagcctaatctggtatgccggtacgcggctgttgggcgcaccgccgcctgccataaacacaatgattaagcgcaataactgcaacaatccaaaaaacctccaccccctccatcgccaccaacacccttgaaacactgaaacctcaggttaccactcgcccattacgcactatttttgtgcggtttttccctaaataacgtggtactcctcacgttttgtgcaataaatcccccgctcatgtaacgaaccgtttaatgatgactccagtgtggcaactcccccgagatcacggtttggctcgggaggcatagatcgtgtgtatttctacgttaaggatgtcgagtgccaattcagcccacaaccggacactggtgtcgtattcaaaagtggggcatcaccctgctctgcctgtgcgcgctgccggcggctgccgcccaagcgccgcagccaggccaggaagcccttcgcttgcagcagcaacagcagcgcgacctgcagcagttacaactggagcagcgccagcgccagatgcagcgcggccgtttcggtacaccgccgagcacaccgaccgcgcccaaagacatcgcccaggatgaacgctgctggcccctgcgcggtacacgcctggccggggtcacattgttcagccgcatcgagctggacaaccacattgagccctacgttgccccctgcatgggcgtcacccagatcaaccgcctgctggccgagatcacacggctgtatgtcgaggccggctatattgccagccgcccctacttgatcagtgcgccgagcgccgggcacccactggatattcacgtcgaggaaggttatctcgaagccatcgaactagccgaccagagcctgcccgtgtcgttaggcgcagcgtttcccgggatgctcggcaagccgctgaacctgcgcgacctggaacagggcctggaccagctcaaccgcctgcgctcggtcgacctcaccgccgatatcgcccctggcagccaggcgggcgcctcgcgcatcatcctgcgctcgcgcagcagtgcctcgcgctgggccctggggcttgggttggataacctcggcagcgccggcaccgggcgtgatcgcaatgccctcagcctgagcctggacagcccgctgcaattgggcgattcgctcaacctgagtttcagcgacacgctcaaccatgggccgcgctacagccgcagccacagcctgttctactcaatcccctatggctactggacctacagcctgttcgccagccatgccgaataccgctcgccgttcaaactcagccgcacgacgctctacaacagcggccgcaccgatcaggtcagcctgcgcagcgaccgggtgctgtggcgcgaccagggtcatcaactgagcgccaacctgcaactggcctacaaggacgtcgacagctacctgcagaaagcccacctggacatccagagcccgacgctgacggtggccgaggccggcctgaacctgttctggctcaacagcgcggtgtggaacctggacgtcaattacgcccagggcctgacttggttcggcgccgatcgcgatgccgatcaggtgcagaaaaaccggccaaaggcccagttccacaagtaccgcgccaacctcagccaatggcgcaatggccaatggtcggcgcaaccctggcagtggcagagccagttgtcgttgcaatacagcccggacgcgctgcctgccatcgaacaactactggtcaccgacgactcggccgtgcgcggctaccgcgacaacagcagctccggcgcgattggcgcggtgtggcgcaacactttgcgcctgccgttgaacagcgatttgccggtgaaaatcaccccgcgcctgggcttcgacaacggctgggtcaagcgcgaacacggcgcccaaagccaacgcctgagtggcgccagcgcggggctcaacctgagctggaaaaacgtgcagctcgacttcgattaccaacgcaacctcaacaccccaacaggttttcgccaggagccggaggtctggctgacacgcctgagcctacagatttgagccatgagctgttttttagcctgagtcaaccgccgtacctgatcaccccaatagcgttgcaacgaacaacgcacgtcgtggatcagccaacacagagcgagatcatttatgccgactacttcccacagctttcacctttcgccccagggcaaactgcgctgggccattgccagcctgttcctgctgccccagcttgtgctcgccgcgggcgtgaccgtggtcgaaggccctggcggcacgccgcaactgcaaaaccagggcggcgtgcccatcgtcaatatcgttgcgccgaatgccggcggcctgtctcataaccagtttctggattacaacgtcgaccgccagggcctggtgctgaacaatgccttgcaggccgacgtgtccaagctcgccgggcaactggcggccaacccgcagttccacggccaggcggcgagcgtgatcctcaacgaagtgatcagtcgcaatgcctcggccctcaacggcgcccaggagattttcggccaggccgccgattatgtactggccaaccccaacggcatttctgtgaatggaggcagtttcatcaacaccccgaatgccaacctggtggtcggccgccctgaactcgacaacggcaaactgcaagccttgagcacccgggatgccaccggccaactgacggtgcaaggccagggcctgcacaaccgcgaaggctccatcaacctgatcgcgccacgtatcgacagcgacggcagcatcagtgcccatgatcaattgaacctcacggtcgggcgcaatcaggtcgacttcgccagcgggcaagtcagccacgtggacccggccagcaagacccaggaccagcgcatcgacgcacacctgttcggggcgatgctggccgggcgcatcaatatcatcagcactgccgaaggtgccggagtgcgcgtgggcggcgtgcaggtggacggccgtgacggcgtgaaaatcagctcggccggcgacctcgatatcagcggccaggttcacgcaaacagcctcgacgccgcccgcgccggtgtgcagagccgccagggcgatgtcgacttgcacagtgccagggacttgaacctggcggccaccgacatcagcgggcgtaacgtcaagcttgctgccagccgcaacctgaccctcagcagcctggaaagccgcaagctccaggaaaagcgtgaacagtgggacaacagcaacttcctgttcacctacgaaacctatgaccgcaccaccaccgacaaggactcgcgccagcacggcaacaaggttgtcgcgcaacaagatgccgcgctgtcgtccggcaccaagaccgagatcaaagccagtcacgtggaagcgggcaacgccttgcgcgtcaacagcggcgccgacttgcaggtgaacgccgccaccgaaacccatgaaacccgcgaccagggcaaccatcgcaagcacctgtggaaagccaactgggacaaatccagcagcgaacaacgcagcatcaccagcagcctcaaggcaggcaacacgctggagctgaccagcaagcaaaaactgcaattgcaaggcgccgaactgcaaaccccaggcgatatccagttggctggccgccaagtagaaattgccagcgccagccgtacccagagcagcagcgacaacgcctactccggtgacctgacaggtggcagcttcttcggcaagaatggcgacggcaatcagggcaagaccttgaacactgccagcaaggtcaacgccgatggcaagctgatcgtcaaggccgacgccgtacgtatcagcggcagccaggcccgtggcggcaagcaggccagtgtcatcagcgacaagggctcgctggtgatcgacggcgtacaggacagctcccacgacaaccgctacagcaacgacagcaaattcttcggtatctccaaggatgaaagccgcaagaacctcaaggacagcaccgttgtcgccagcaacctgcgctcggacagcaacctcaagctgcaaagcgccaaggacatcaccgtcagcggctcgcaggtgtctgccgccggcgaactgcaggcggatgccaaaggcgatatcaaggtggttgcggctgaaaatacccgccacgacaccaccagcacgcacacccgtggcttcgatggctacgctaaggaaaccgccgacggcagccgtcagtatcgtgcgggggtgagctatgaagaccagcagcaaacccgcaagaccgacaccacccggcaacaggcgtccagccttgaaggcgacagtgtggcagtcagcgctggcggcgatgtgagcatcaagggttccaacgtcaaggcgacccagggtgatgcaagcctgagcggtaaaaacgtcgagctgttggcagctgacgacagccgcacccaagccgtcgacaagaccaccaccggcggtagcttctactacaccggcggccttgatcgggctggcagtggtgcgcaattcagccaccagagcagcgaggacaccagcagcaaaactaccgcgcacaccagcaccgtggcagcggccggcaagctgaccatcaacgccggcaacaccctcaccagccagggcgcacaggtaaaggctggctccgagttgctggtcaatgcaggccagatcgacaaccaggcagcccattccaccgagagcagcacccataagcaaaacggctggaccgccgatgtcggcgccaatgtggagtacaaaggcatcacccgcccgatcgaaaaagccgtcgaaggcgtggcccaggtcaaatttcatcagcccggtttgctggacgcgttcgagcagccgaatgtcggcctggacgttgaagtcggacataccaacaaaacccgcacacagcaggacagcacggcggtggtcagccagttcagtggcgccacggtgcaggtcgataccgctgggaaactgcaggatacaggcactcaatatcgggccaccgatggcgggctgacgatcaaggccggcgaacatgtcgccacggcagcggccaatacccacgacagcggcgagcaaggcgttgacgccaaggcgggcgtgcggatctacaccaccaccggtgaagacctgaatctgcgcggcagcggtttgggtggcagtagcgatgtgcgtgaaaccagcagcacggcggtggtcggcagctatgccggcacccagggggtgagcatcgaggccaagggcgatgcacgctatgaaggcagcaagttcaacggcggccaggcaggcgtcaacctcaagaccggcggtgagttggcgctcaaccaggccaacgacacccagagcaaaaacagcagcaccttgcgcggcaacggttcattgaccgtgggcaccgcgccgggcgccaatggcaacaacgtcaacctcggtgccggtgtgcaactggacaacaaacgcctggacacccaggacagccaggcccgcgtcgcgtcggtccagggcagcgggccgatccagctcagcagcggcggcgacatgaccctgcaaggcacgcacgatcggcaccgccaacgccaagaccggcgatatcagcctcaatgccgggggcaagctcgacctgcaagccgccaccaacagccacgtcagcagcggcaacaacctgggtggcggcctgacccttggcgccggcaagaccagcactgccgaaagcagcagcaagaccggcagcctcagtgccaatttcaacatcggtaaggtggcggaaaataaccagggcatcgtcgtcgggcagttgcacagcaacggcaaggtcagcctcgccagtggtgccgaggcggctgatgccctgcacttgcagggtactcagatcaacgcggccagagtcgacctcgtcgcgcagaacggcggcatcctgcaagagtctgcacagtcaacccaggcccatgacaactggggcgtgaccctgggcgcgggtggcagcgttggcaagaccaccttggccgatgccggtgagcacgccacacccaagacccagcgcggcatcaatgcgcgagccaaggtcgacgtggatcacctgcaaagcaccacccagcacgacagcctgatcaaggccgacaacgtggtcatcaacagtgccggcgacacccacctggccggggcacgcatcgaagccgaccaggtgaacggcaaggtaggtggcgatctcatcgtcgaaagtcgcaaggaccaggtcaacagcacccaggtgaatgtcgatgccaggctggatgtggaaaaaaaccagcccggcgtggtggataaactcgccactgccactggcccgctcaaggacaaagtgcaagccaaggccgaaggtgcgttcgacaagcatcgcgacaaactggagaacgtcgtagacaaaagcaccgggcacctggcttcggccaaggacaaagtggtcaacggcgtcgtcaacgccaaggaacgcctggaagaaaaactcacccgcagcggcagttacgatgtgaaccccgagccccgtggcgctttcggcacccgtgtggacaaggccaaggcttacctggcggacaagaaggaggccctgggcacacgcctgtcgggcttcaaggataaggtctggccgaaaaacagcgacagctacgtcgtcagcggcaagaacaccaccggcagctcggtagccaataccgccgaaagcgtgttgttcggtgacaagagtggcaacaccaactacaccccgaccctgtatctggacgtcagccatgtggtcaaggacagcgtcacccaggcgtcaggcattcacgcaagccagggcgtcaatctgcaggtgagtggtgatacgcacctcacgggtgcgcggatcggcgccgagcatggcaaggtcgagctgggcggttccaaagtcaccgctacggcattggccggcagcgactaccgtgctgatgtcggcctgaacgtctcgaaatcaccggtcaacctcgcactgggggccaaggatgaattgactcagaaacaggacgacgccacgcgcaaggatcaagccttcaacctgggaccactgcgagcgggtgggcacagtgaaagccaggccttgcaggcggggattgatcaaggcatcaactaaaaggttaagcacccgatttactaaacgaaacagatccaaatgtgggagggggcttgctcccgattgcagtgtgtcagccagcttatctgtatctgacccaccgctatcgggagcaagccccctcccacatttgtagacctaattcctggcttgttgccgcaaggcaagggccgccacaccacatagcaccaacgctatacaggacacgtagaacgcatcgctgtaagccatcaggtacgcctcccgccgcacggtatggatcagcccctcaagaacctgctgttgagcgggtaacagttggttgaagatgaaaccctcgctgtcggccatgctgacgcgcaaacgctcctgcaaggacggcgaaaacaaggtgatcgactcccctacccgctcggagtgaaagcgctcgcgcatggcgacgatctgcgtcaaccccgcagtacctacagccccacccaggttacgcagcatggagaacaaggcagaggcagaaccggcttcctccttggccagcccggataccgccagcaccgacagcgccaccatgatcagcggctgtccgataccgcgcaccaccgtggaaggaatgatcacgttggcagcgctatccacatccagatgcgcccccagataacaccccagcgccatgatgaaaaagccgctggcgaccatcagtttcgggttgagccacttcatcaggcgtggcatgaacggcgccagcaccagttgcaccatgccgtaggcgatcaggctgatgccgatttcccgggcgttgtagccctgcaactgggacaggtagttgggcaccaggaacaccaggccgaaggtcgccccgccgaaaatgaacatcgccgcactggccaccccgaagttatagctcttgagcaggcgcaggttgatgaaggagcgactgccatacagctgcgacagcacgaagtacaccagggcaacgcctgcgaccagtgacatccacacaatgaaatcggagccgaaccaatccttgcgcccgccttcttccagcacgatctgcaagccacccaggccgacgatcatggcgatgatgccgccccagtcgccgcgtttgagcaggctcaactgcatgggcttggcgtcgatggaccacgccaccgccagcagcaagagaatacccggggccagttgcaggtagaaaatccagcgccaggaataagcatccgtcagccagccaccgatggacggcccggcggcctgggcaacgctgttggacagggcgaacaaggccatgcccatggcaatcttgcttggcggcagctcggtgatgatcaactggaatgacaaggggataagtaccgcgccggccgcaccctggatcacccgaatgatgatcatcacttccaggttgggcgcccaggagcaggcaatggacgccaccaggaatacaaacgaacccaccagcatcacccggcgcagggagaacacctgcaccagccaggcggtcagcgggatcatcacgatttctgcgaccaaataggcggtggagatccacgagccctcctcgaacgtcgcccccagggagccttcgatttccggcaatgcggcgctggtcacgtgcacgttcatgccggccatgaaacagccgaacagcccaccgatcaccgccacccaggcgcgaaaggacacgctcttttcagcggcttcagtcatgtgcaacgccctggttggctggccgggtatcgaccgtagtgatcaccgacatgcctggcaggataggcccgccctgatcatgctcatcgatgacaatcttcaccgggaagcgctgcacgatcttggtgaagttgccggtggcgttatccgacggcaacagtgcgaacaccgcccccgaacctggcgaaaaactcaccacgtggcccttgagcttgcgtcctgaatagctgtcgatgctgatgtcgacgggttggccggcgcgcatgtcgcgcaattgggtttccttgtagttggccaccacgtaggcctgctgcaagggcaccaccgccagcagcggcaagcctggcgcgacgtactggcgggtgcgcactttgcgctgccctaccacgccgtcgatgggcgagcggatcaaggtgtcttcctgcgcatgggtcgccaggttcaactgcgcctgggcttggctgcgtcgggctatctgttgttggagcgaggcttgggccaattggcggcgactgatggcaacggtcagccgggtttcctgttgacgttgcatggccttggcaatttccaccgcggcgctggcctgggtgtagctggcggccgccgtttccaggcgctgggcactggcggcgtggtcgcgcaccaacccttcgtagcgacgctggtcgaggcgtgcgcggtgcaactcggccgccacgctgcgggcgtgggcctgagcctgggcaacgccggcctgttgctgggcgatcaggctgtcggtgacgttgaggttggcctgttgcgccgccaccgaggcttgggtttcggccagttgtgcacgggcctgttccaaacgtgcctggtagtcatggtcctcgatgcgcaccagcacatccccggccttgacgggctggtcgtccgcaaccaacacctcggccacatacccggagaccttggggctgatgggaatccagtcggcacgcacataggcatcatcggtctgttccagataccggccgaccgtcatccagtacacgccgaacaccatcgctgcgatcaacagcgccgcgccgcccagcaggatcaggtgccgtttgcgacgttgcttgcgcgtatgcgccgattcatcctggacagcagttttttcatcaacggcgatattcatggctgggtaccggaaaaagtggtgtaagcgtgggtgggagctgaaggttgccaaccaccgccgagcgcccgaaacaggctgatctggcgttgcagcaactggccatcggcgtcggcgcgagtggcctgtaggcggatcagttcacgctcgctgtccagcacgtccaggaaatcgatagacccggcgtcgtagttgaattgggccaacctgtaagcgtggcggctgctgtccagtgcctggctcaaggccgcgtggcgctggcgctcgccgtcatacaaggccagggcctggcgcacctccttgagggccttgagtacgctggcctcgaattgcgccacctccacctgctcaagcgcccgcgcctggttgacccgtgcgcggttggcgcgccaattggggaactgccaggtgatcagcgggccgatgccgaacatcaccgcgctgctgtcgcccagctcatggggcctgttggccgatgaagacaccgaggcgccgaaggtcaccttcgggtacaggtcggcctggacgatatccacttgcagcgtggccgcctgcaacgctcgctcggcctgacggatatcggggcggcgcgccaataattgccagccatcgcccaccggcagttcggcattgagttgtggcaccacttcacagctcgcagcgccagcgccttgttccagatcagccacgccggtcagcatcgccagctcgtacagcgccgcttgccgacgcgcctcaagcatcggcagcaaggcctgggtttcgccctgcagggcttgcatgcgcgtgtattcaaggtccgtcaccacaccggcctggcgctggcgatcgatcaacgccaggctgcgcccgaccacgtccaacgaatgacgctggaccttggcacgtgcaccgagggcgcaggcattcacataggcgcgggtggtttgcgccacgacggtaatgcgcaacaagtcttcggcgtcctgcgccgccgcggcttgcacctgggcccgctcgatactgcgctggaccttgccccagacgtccacttgataagccagttcaaagcccgggttgaacgcccactctgacggcgcatgactatcggtggccttggccagggtctggtcatcggccgtcttgccgtactcggcgcccactgacgcctgggtggccggccagcgctcggcatcggcctgcatgatcccggccagcatcgcttgcacatgggcctgggccgccgccaggtcgcggttgtgcagcaatgcctgcagcaccagcccatcgagctgcgggtcgttgtacaactgccaccagcgctcgggtaacgcctgggccgatacgccttgtggcaagtggctcagggcattgatgcgctgcggatgtggctgtgcgggcgcatgggcaacccaggacgaacaccccgccgacaacaccagcgcaatgccaagcagcgcaagacggccatgccgtggggggaaagaaggcgaacccatcgaagaaatccagaaggccaagtagagacccagggtaagagcgcaacgaggtacgaatctcccgagttccggacaaccatcgttttgattgggacaagatgcggggtggcttggcagtactcagtccaaatgtgggagggaagcctgtcgccgagtcaaatcacaccaatcgacagttacgcggggtgtaacccatggtgcgcttgaacatcgcagtaaacgcactcgggctctgataaccatgctccagcgccacttccaggatcgacacgccacaggccaggcgctgcatgctgagcaacaaccgcgtgcgcttgcgccattcgccataactcatgcccaactctttctggaacagccgcgccaaggtacgcgaactcatattgagctgcagcgcccaactctccagtgtcgactcctgggaagggttgtcgataaagcccgcacacagcgacttgagcctcggctcatccggaatcggcacatgcgccagcacccgttgtgcccggtcgagctccgagaaaatcaactcgacaatttgcgcatggcgcaacaacgccggctcactgtcgacttcatcgcccgcagcgacaatcagctcgcgcaacagcggcgaaaccctgatgacctcgcaatccgccgtcaagccacgatgcgcccccggcgagatcaacaaggtgcgcatacgcacctcaccggtcatgcggatctgatgctccctccctgaaggcacccacaatgcatgcccggaaggcaccacccaggccgtcgcctccaccgacaccagcatcacgccgttgatggcatagacgagctggccctcgtcatgccgatggggcgccacgatgtggccgtgttcatagttagcggcgagcgcggctaatggggtaggcgcgttcatttcagcaggccatcgcggcgtttgctcgtcttgagagaagcgagctatgtcggcaattgcaggaagaggctgtgagcatcatatcgtttctcctttttagggcagaccgccaggagcctccggcgcgtcttgagtgcagaaacaacccgcacatcagaaaaatgcacaaatgcatattttcgccttgaaaatttcactgtatggatacacagtaccaacaggcctcatcttatgccgattcatcgctagcgacgagcagcgcggcgaggccgagccagaggggtaattcccaacaattgaccgaaatatatatcgataaggatatcgactcatgactatcgttcttccacccatcgtcgtcactgccacagagcccggttacccggcaaatcctggaggcctgccgtttcccgcgccgaacccggcagttgtgttccaagggcagatgctggaacgctttgcttattatcgccaggggttgtggcgcgagatgctaatcaaaatcgccaacgaacaggtcacctggggaatgacaggtgggccagcgccagggatcgtccatgatttgcaatcggtgccgtttgcagatagctacctttactttaatccgggcctgacttctggccatggtttgaattacgcccagcaatatttccaatcaggtggcgtaacctcctctccaggcctctcgggcggcgacctgactccggtcgcagccgttgggcacttcctttacggcaaaggtactccaaccgaaacctcaatcaacctattcgggctgaactcaccgagtatctcaagcgctgtgttcaatgatgttctagcctcagcgccaattggaacgtcgccgatttccattggcaacattccttttacgccagatgccacgtcctggcagcttgcaacgtggatagacaatctttccctgaccttgcaaggcaccctcaataaggctcaggacggtagttatcaatttaacggctccgtatccgccgccaaccacacctacgattcgatgcctgccggtttcaaagcagccatcggcgaagcggctgcaaatacgcttcaaagcgtatttgacgctcatggcgctatgccctttgaggtcgtgatcaaaggcgaaaccgcagttaccgttaccaaagagctcacacccgatgaaaaggctgcctatacagacgctgtcagcttcgtatcgaccgccaatgaacaaatgcttcaaaaatatggtgccaacttgagcaaagttgcccaagacatgcaagctgagatctctggcaagaaaatcagaagttatgcagaagcaatggcgacctttgagaaaatcagcgctaaccccgctatgaaactgaatgcgttggacacccaagcagtggtcgatgcgctgaatgcactggataaggcgagctttgcggataacatcacccgtttgggcaaagcattcggtgtggtcggtaaagtcgtacaagcagaagccatccgcgagaaaaccgtctccggttttcaaaccggcgactggaagcctctgatgcttgaacttgaagcgatggcagtcggcacaggtgctggaattttgctcgccaccagcatggcgttcttctttcctgtttttgcgtcggctgccgctggagtcgtcgtggtggccttgatgatggcagccaccgctgcgtattttgatgcagccaaagtcgatgagatcaacaacctgattcttaactaaaacaaaggatccgggcgagccgagtctcgtccggacccagcgtgttagcattaaaaatcgtacaacaggatttccgagcaatgaacaagtcaatcaaacagtgcatacctctgccctatttattcattgcaatgaccatggcacctatatttttcatagcttttttatttcctgcaaaggccacatccgcgccctatacaaatattgaaagcttcataaacacctacctgctcggcgtggtagggttttggtcgtctaacttccctttcagctccacagtcataacaaactacattggcttgctcggaccgatatttgcggtgatctttttcttgaaggtccgcaaggggatgatcatcgatgctgatcaatatgcaaacatgaccatcagcaaatatctgttcggcttgatagttttatcgagctttatctatatgatcgtatccgtgagctatttttacccgcatgatctggcggctcacaacttgaaatggcgattgtttggcacacacatattcacatatgcaacattctcttcgggcgtgctatttatcatttactttattaccttgatttcatacttctctttattatacataccgagacttttaataaaaaagaataaacagcactagcttcacgccatatagcaagatgacggataaaaggatatttagtcccgaaacaggtgtaagcctatttcggattggagaccatatccccttctcccactgccacaccaatactagtgccctttgctgtctttacggcttttcagccccagcaaccgcccccaccatccagactcggcacttgaattaggtgttggtatcactttctcattgggatgtagcaaatcacccggatagtgctcgtgcccaatgcaatcgctgtcctcaagcccaaatactttcacggcggcgaccgcctcaaaacaccagcggccgaagtagcttcccatctcaagtgggtgcattaccggatcaccataaatgtaccaccatggttgctgtttaccgcgcctgttcagctctggataccaatgctccacgaacgccagcagtagagttgcttgctgcgcctgttgcgcatcaattgccttgagcagtctcgcatatggcttggcgtgtagcagcttctccccaatttcccgctctggttggcggtacgcaatgatccgatccagcagaatgtcctgccccccatcacctattaacgcaaccaatcgaagccactgctcatcgggaatttccagagcaagcgctagccccaccaaccagaaacaatagatgtaatggtttaaatcggtcagttcgaaggtccagtctcggcaagtcttaagatcattctcagcgcatattttgtcggactctcggttggaaatttcccatgcattcagaacgccggggaagaatgttgcaatcgtcgtaatatttccaccactcgagtagcaccgtatagccgcgcgcaaattatctttggcaaagtcgaacgtaaattgcgctctatatacgggattagccgaaggctccgacagaatcttgccggcacgctcaatccattgcagatcttttgcctcatgatcatcccaatactgcttatttccccaaggtgcacgaatcatggaaaaactccattcaacgccgcctttttacaggcggcgcctttatttacaaggcaaacccggacagtgtccggtgattacctaagggttgatcaactgcccaacagtccactggtgtccgcgtcgaagcgcttgcgggcctgatcagccgccggtttgagctgcatgagcagcgccgcctcactgtacaactgagtgaccgccagttccttgggggtcggctcaatcgggatcagcacatcttcgctgtctgcgtgcagccagattgccacaacgtgcaatgccgagatgaacagcactcgcagctcaacggttttaccttgcaattgcgcggactgttccgccattttcagcgcatccaccgtcgccgcagccaggggcccatggttgagcgaagcgaactcgacatgcccgcctaggtcggccaattgcgcatccgcaatcgtcacaccatcggcaaacaccaagtaatgccaatcgccgacctcagcgtctttcaggcctttaccgtgagtcaaatcctcgagggtgagcgagtacccacgataggcctcgctcagcctgatgttgcccggtgcggcggccgcgaatgagtgattgcgtcccaggccctgggtttgcagcgcggcttgcaacgccggacgcagtgtctgtacgccgtttgagggcgcctttggataaatcagttgcatgatgcagccctcctcagttttttacggtgaagtaagtgttggtccaattgccgccgccgttgtacgaaccggggaacgcgttcaacgcacgggtcgagtaaccgtagatcgaatctgcgatcaacaagtagttgccgttggtcccatagatcaccaaaaagtgcgcaccgccaccgtaccaggcacaacgcaaaccgatggggcggcccctgttgatctggttctggatggccgacatctgcaacgagccttgattcatgccgttgtagctgcgcgtggttcgtaaggcggaatccagatagccgtagacgttgcacggtccaggttggttgcagcagttgcggtcaagctcgctgctggctacaccgcactgggtccaggacccggtgccatagtagttgccgaccgaggcagagagcgccgcccagcaccaattgctctgggtttgtctctgcatgctgaaattgagactggcggcagccattgcttggggctgtgcagccgctttgacttcgaccagttgcggatcgagcagatggccgaccaggcaattgggcggtgtgtcgccggtgagtcgggttgtttcagtggataacatttttcaatcctccatgaatgaataccagcgtcctgctggtaagcgcgtagcggtgttgctgagctttcgacgttcaaggtggcccatatttgatgggggcgttgcgatctggctcggggtaaccctaggcgttaatatgcatatacgcaaatattcaaatgcattggcgcatatttttgatgaatgcgtgtggtttgtctggcggggtgagcctcaaaaatggggaaccaaataaatccgtccccttttcttctggggctcgcaaagagcccctgtttgcgtttaaccctaaaacgcgtaacgcgccttgaccatcacgccatcagcatcaaacccgctacgcgcctggcgggtatagctggcgcccaccgtcagcgccgacacctgataattcaggcccaggctggcttcgtaactgtcacgtgcgaccgaagcgccagtgacggtaaacgccgaaccacccagcacaaaactggaggtttgcgccacgcggtcgcccatcaggtcgtgataagccatcaaggtcgcttccggttgcaggctgccagtggccaacgggaagttgccagccaagcgcacacccgcacccaactcgcccacttcatagcgttgcgagccggtgctcagcgccgctgaagagcccttctcggtaaagctgtccatgcgcacgttggaataacgcgccgccactctcggctctatcacggcagcatccgacagcttgaagctgtagccgcccaatacgctggccgacaacacattgctgtcgtagctgcccttggcggtagtgcccgccacacgacgcttgctgtcattgtcgttatggccatagctcaggctgccgtcgacgaaccagttctgcagcgaccagttgccgtacaacgacagcgcatggccctgcacgtcggtcttggtgcccaggtccgaatggatgttggaattgaggtagctgtaagccacacccaccgtggtgctgtcgttcaaccgaccatccacccccaccgccatgccgctgctgttggccgaatagccgttatcgccgctgtggccatcctgatccatgttgctgctcaagccttgcaaccacacacccacggcttcacgattatcacgctggcccgagaggcgatcggccgagtaactgagcagatccagcaacgaagaggtactggcgaccgacaggccgttgttctgcacactgctggcttgcaacaaggtgtactccgtgccgcttggcacggcggtgaaatcacctgggttggcgctcaaggtcactttcgatgcctgggcaaaatttgccgcaccattgacagtcaggtacggcgtggtcggtaccacgctattggccaggcgcatatcaatgcctgcaccgctggcgacgttgaggtcgcccgtaagcacggtgcctggggccgtcaggttcaaggaacccgagttgatagacaccggcgcgatgatgcgattaccggaaaaatcagcctggcccgcgatgttcatcgcgctgacatcgagcacatcaccgacgattttgccgccggtccagttcaggacggcgcggctggctgcgtcgatggcgataccggcgttgctgcgaatctcaccggcttgctggttgatttcgaagacggaggtttgctcagccgcgtcgacagaaatcgccgtgccatcggcggtgatcgtgccgcggttgatgatgccacgggagccggtggctgttttgggtgaaggtggcgctcaggagatcgaccgctttggcgttggtgcctttggcttcgagggtgccggtgttgaggatggagtcgacggtgcctgcataaaaaacaatacggaagcatctgtgccgttcacagacagcaggccactgttttcgatgcgaagtgcgcccgtggtggtttcaaaaatggacaaattaaggctgctcttgaacgtcaatcagcatctgatcgcagctggcaccgcgtcggtggggcaggccagactccaggcaaaaaaacccggcctcatgttcagggatcaacttgcgaacttgagtaccgcctcaagttcatcttcatcgtcaccataggtgcccccggtcagttcaaagcccatgcgcttataaaaaggttctgggctgccctctcctactccgtatcctacgcgaatctccttaaagccccgatagctcaactcataggtaagaagctcgattgccttcttgccatatcccattttctgatagggaccagcgatcataaaacgccaaagaaatacgccagggtaataaatgccctcatcgtgatcggcgccaatatgcagcatgataaaaccaatcaaggtttcatctgcgtagattgctcgaaaccaagcgttctcagagaagtgtgcttctgcaatcgaagcgccgttgtctgcaatcatacttctctgagccgctgaaagcgtctcactgagcatgcatacatcccacactgtcgcagaagttattcggcgaaaggaaacacttgaatctcgggtaggtagatcattcatgatgtactccagtatttaaatatttgaatattgctcagcgaaatcaaagaaaacttatatttgtaaagatcggtcaggccctctgctctttacccccgttacgctgagggccataggtgattaaccgcaaaattttttctaaaggggcctggcccgcatacttggctatcaagccagtgagggtcatcgagatgagcgctatgcctacagcaagtggtatcaacgcgagattgccaagctcaccgaagaagccaagcccatacccaccgaaaaccacacctgcaatgagcccttgaaggacatagggagtgagagagtttcggcctgctgcaatcagaacatctggcaagtttatccatgtgctgtatcgcaatagcacgttgatgtagacagctgacattaaaggagcgcctactgcgaaagataaaagccccattagctctacaagatcaccttctttaggcgctagcgcgaaagcgagatttgtcaggactgcttgtaacagcaataaaggggtaatacgcgtgagttgtttttgccctcgactcccaggctcaaaaaaacctgctttcgcagccgccaggcccaagaggattgcaccaaaggctaatggcccttgaaatagaattagaaaaccgaacgttcctggccattcggaaatccttgtaagcgtggatcctacaaagttgtaatccaacgcatgattaacaggtgtagtcgggtagatcgaaagaagaaccgccaggacaactaaggttataagctctaaaccgaccatggacatcgccgttcttataagcgtgcgaggtgcacagttccgaaatggccaaagtaaacatccaagaaatgcatagagcaacaatatatcaccgggaaaaaccagaaccgcatgcaggcagccaaagatcgctaaaccgatgagccttctgaaatagcgccctttgaattgcacaccggccctcgccgcagattggatttgaatatgcacgccccagccaaaaatgaatgagaaaatcaggaaaaacttcccttggaacaagaactcgatcaagaacgccgcgacgcggtcaccgtgggcatcgggaatgccgattgcctgcgccggcggcagcgcaagaaacggcaggttaactacgcagataccgatcagggcggcggtacggatcaggtcaactgacgtgttcctgagtggcttgttcatcgtcgtcatcgtcttgtgaatttattgagcgactgctcaaaacaatgatattgagcagtcgctcaattcgtcaagcgatttaatggtgagatcggagagaggggtaaggggctacacgcggcgacagctagaatggtcaccgagcgcgcaggaatggaaaccggtgggctttaaaaaaaatgatgtgaagcgctgacggctgcatatcagacatgcgcggcgatttttctgcaaacttgcagcttcgccctcaattcacaggcaaaaaaaacccggaaatcctcacttacgtgggccttccggattttctaaaccgccaaaaatggtgggtcgtgtgggattcgaacctacgaccaattggttaaaagccaactgctctaccaactgagctaacgacccgctgtgttgtggcgcgtataatactgatttctaaggattattcaacaccttatttgaaataaatcagaaaaaacgcatttgaacggtaattcggccggtagaacgcctctcgcagccgcctgatcaacgccccggctcgtcgttccacaggtacttatgcagctgcaattgcaggcgcaccggcaggttgtctgccacgacccagtcagccaggtcgcgagcgttgaggtcgtggtggctgggcgagaacagcacctcgcccgcacgacgatccaggccgtattggatcagcttggagctggcccagtcataatcgtcacgggaacagatcacgaacttgacctgatcattggccgtcagcaggtccatgtttgcgtacaggttgcgatgcgcttccttggagcctggcgtcttgaggtcgaccacccggcttacacgcggatcaacagcggaaatgtccagggcgccactggtttccagtgagacctcgtaaccggcgtcacacaactgcttgagcaagggaatggcattgggttgcgccagcggctcaccgcccgtcacacagacgtagcgcggccggtaactggcaacctgttccaggatgtcgtcgagggtgcgcacagtgccgccactgaaggcgtaggcgctgtcacagtattggcaacgcaatgggcagccggtcaaccgcacaaatacagtgggcaggccggcagtgcgcgtttcaccctgcaacgagtaaaagacttcggtaatacgtaatgtgtcttgcatagtcgccacgggcgtaacagctaaacaggctgtccgcctccgtcaggcacttcaagggattgcgccaacgcgccaaccccaggaagcgtatttcataaaagggcgtggattctaacgaaaaaacccgcgccaggcgcgggtttcttctcaacgggaaagatgcgcttacaagcgctgcagatcccgctgggccaactgggcggcggacgtccccggatattgggcaaccacctgttgcagaatgcctttgaccttgtcggtatgacccaggcggcgttctacgtcagcaagcttgtacagcgaatccggcaccttggcgtgcttggggtacaactggctgaccttggcaaaagcctggcctgccccctgcaaatcgccctttgccaggttgacctcgcccaaccagtactgggcattgcccgcgtactggctgttggggtacttgcgcaggaatgcggtaaaggcctggctggccttatcgaaatccttggccttgatcaggtcgaaggctgcatcgtaatacagcttttccttcgctggatcacccggttcgctgctggcggcaggggcagccgcggcggccccagctgctgcgccaccggcggcagcgcttggcgcgccaccggtagaagaattatcaggagtagcggcaggtgcaacaccggctccaatacgacgatcaagatcctggtatcgctccaggccttcttgcttgagctggttcacctgattctgcagcacttcaatggcgccttgttgctgcgacaattgatcctgcatgcgttgcagttggttgaacagctcgccctgtgccgagggagcggacgtagccgctcccccagcataggcgccgttcgtgccataacccgctggcggataactgctcccgctattgttatagcctgagttgctatccgttacaggaaccgcagcccacaccgcaagcggtgcgaggctgagagccaatacagttagagcacgacggcacgttcgcatgacgaattacttacgcagttcgacgcgacggttctgagcccacgactgctcgtcgttgccagttgcaactggacgctctttaccgtaggaaaccagttccagttggcctggagcaacaccttgcagtaccaggtagcgctgaacggctttcgcacgacgctcgcccagtgccatgttgtactcacgagtaccacgggcgtcagtgttaccttccagaacaacgcgagcgccgttagctttcaggtccttggcgtgaacgtccagagcgcgcatggcttctggcttcaggtccgaactgtcgtattcgaagtagaaagtggtgatagcgcgcagagcagcttcttcgctcagggagccgtcaactgcaccagtgttagcgccgtaaccagcgtttggatcaacagcagcgccttcaccggcattgtcgccgcctttagaggagcaaccaacggctacggacagagccagagccagagcagcaaacttaccaaacttcagcatttccatcgtgaaactcctaatgaaccccagtgtgttaagtacttctttttgtagcgccgcgtcagttcaggtaaggggaccaggatggttctctgacttcgccttgtgcggtaggaagcgggagccttacgcgtccgttaatggacacgagcatcaagactccccggccctgctggcgggtggcgtagattaccatggtgccgttgggcgcaacagtggctgactcatcaaggttggtatctgtaaggattttcacggttccgcgctgcaaatcctgggccgcaacccggaaattagtgaaaccatcctgacggtgaatcatcaccaacgtcttttcatcggccgaaagcttagggttggcgttgtagttaccgataaaggtcacacgctcagcacccccaccgttcacgtttgccttgtagacctgaggcttgccgccacggtcggaggtgaaatagatggtggaaccatctttaccccagaacggttcggtgttgatacccgggccgctggtcacgcgactcagttggcgcgaggccatgttcatcacgtagatatccgggttgccgtccttggacagtacgaaagccaggcgcgaaccatccggcgaccaggccggggcaccgttgaggccttcaaagttggtgatctgctcacggcggccggtatcgatgtgctggacgaagatacgcggacggcgctgttcgaacgatacataagcgatacgcttgccgtccggcgcaaagcgcggcgacaggatcggctcacgggactgcagcaacgtcactgcacgtgcaccgtcgtagtccgagcgttgcagggtgtagcgggtgttgtccaccgagaaacgctcagccgttacatacagcaggcgtgtcgagaaagcgcccttgatgccggtgagtttttcaaacgactggtccgagatgtagtgggccatgtcgcgcagttgctcggcggtacccgatacgctgccggtcaggacctgctgctcggtagccacgttgaacaaggtgtactggatctgcaggcgaccgccggccggcgtgatgttgccgaccatcaggtactgcgcgcccacggctttccagtcacggaacacgacttcgctggcctggttgggctggctgatcatgttgcctttgggaatcggcgcgtagtaaccggagttacgcaggtcgtcgctgacgatctgggccatgtcgtccggcagcacgctgccgccctgccaaccgaagggtacgacggcgatcggggtggcccgatcgctgccgctggttaccaggatgttcttttcatccgccgccgctatccctgccatacagcaaataacgacaagcattcctcgaagaaggtttctcacaaggctagatcctcaggtgtgaatgtcatcttgaatgaacgatagggagcgaagtcacttggtttcattccctgcatctcggtcaaccggccaatattcttgaccgcggcaaccgccgaactgtcgaacgaaccgtcaccactggacttggccacgctgaccgaagtcaccgtaccgtccggcaacatgccgatctgcagcactactgtcatgcctttacgtgccgaaggtggacgtgtccagccttccgctgcccgcgcccgaatcaggtcgtcgaaactgcccgcgacttcatcaccacgctcatcggccaaggcttgctgacgctgcggcgtgtcggaaagcaaatctgccagggcctgggcctttttctcttcggcggatttgcgtgctgcttcctgggccttcttcttggaggcgtcggcggcagctttcttcttcgcttcgtcggcgactttctttttcgcctcgtctgcttcagcttttttcttggcgtcttcggcggctttcttcttcgcgtcttcgactatctttttcttggcttcttcagcggccttcttcttggcctcttcctcggcagccttcttggcttcttcttcagatttcttcttggctatatcagccagttgtttctcttcggcctttttcgcttcggcagctttctcggctttcttggcttcatcagcctttttcgcctcgtcagctttcttggcttcgtcagcctttttcgattcctcggccttttgagccgcctcttctttcttttgttccgcagcagccttcaccgcttcctgctcgaccttcttctgttccatctgctcgacttcagtctggcgcgcagccgacttctgggcctcacccgcaatcttctgattggtctgggtggtggcctggcttttcgatttcagctgatacagggtcgcctgcacgatcggcttggctggcggcaggtccggggtcatggcgaagctgacgaacagcatgccgaacaccagtacgtgcagggcaatcgcccacacgccaggccagaagtagctttccgaggcggacggctctcgctgttgctgcatcagggcgcctcggtaatcaagccaacgttaccgacgccggccttctgcagcccgcccatggcgcccatgacggaaccgtagtcgaccgatttgtcgccgcggatgaacacctgggtgtgcttgccgccttcgttgccggagcgaatgatcttggtcaccgcatcggtcatcgccggcaaggtcagggccttgtcctgctgcttctgggtgtcgacttcgctgccaaggttccagtagtaggtcttgtcagccttgatcgaaatggtcaggacctgagtgttgttgtcctgcggcaaggcttcactggaaaccttgggcagatcaaccttcacgccctggttgagcatcggcgcggtcaccatgaagatcaccagcagcaccagcatcacgtcgatgtagggcactacgttcatctcggcgaccggcttgcgctttttgcgagctcgagcgattaaagccattgggaattacctgcttattcttcgctggtgtgcactttacggtgcaggatcgcctggaattcatcggcgaaggtgtagtaacggccgatcaaggtttcgctggttgcagcaaaacggttgtaggcgattactgcggggatcgcggcgaacaggccgatcgcggtggcgatcagggcttcggcaatacccggggccacggtggccagtgtggcttgctgggcctgggccaggccgcggaaggagttcatgatcccccacacggtaccgaacaggccgatatacgggctgacggaacctacggtggcgaggtacggcaggccttgctcgagcttttcttcctcacgggagatggccacgcgcatggcacgggccacaccttccatcacggcttccgggtcaaccccaggctgctggcgcagacgcgagaattccttgaagccggcgcggaaaatctgctcgacacccgaatccgggtccgggttgctgccggcctggcggtacagcttggacagatcgatacccgaccagaagcgctcttcaaagctctccagggcacgtcgaccggcgcgcagcatattgctgcgctgaaaaatcatgacccaagaggtaaccgatgcggctaccagggtcagcatgaccagttgaaccacgacactggcattgctgaccaggctccacatggaggaatggtcgacgacggtaggttccacgctaaatctcctgctttgattgttgacccgcgccgctcacggcagcaaaggccgcacgtagagtttcgggaatggcccgaggtttcaagctgttggtgcgcacacacgccaccaggaactgcccctcgcagagcagcgttgcatccgtagcccgcctgacctgctgtttgaagcgcaggctggcacggttcaattcgatgacttcagcgctgaccagcaactcgtcgtccagtcgcgccggtgcgtggtaacgcgcctcgctggaatgcacgacaaataacaggtcctcccctgccagcgtggattgggcaaagcccagctcccgtagccgctcggtgcgagcccgctccatgaacttgaggtagttgacgtaatacacgatgccgccggcatcggtgtcctcgtaataaacgcgacagcgatgtgcgaacgactgatccccgttttgcgcgcgcatactctagtgcttactcctcaggttgccaattggctgggcaactgttttttcaatgcctgacaacattttccactgcctgaatgacgacaccagacactgggacagcacaaacttcagataaatcgtctggcgtgacctttttaatcgtccactgcatcgaggaattcgtctacagcaggcatctcccccaatcgtgacggaatatttaacccgaagtgcaggtaagcgtggcgcgtgaccaccctgccccgcggcgtccgcatgatgtagccctgctggatcagatatggctccagcacatcctcgatggtatggcgctcttcactgatggccgcggccaggctgtccacgccaaccgggccaccgtcgaatttctcgatcatggtcaagagcaggcgccggtcctggtgatcgaagccatgttcgtccacgtccagcaggttcaatgccaggtccgccaccgccttggtgatatggcccttggcacgcacctcggcaaagtcgcgcacccgacgcagcaagcggttggcaatccgtggcgtaccgcgggcgcggcgggcgatttcaaacgcgccttccgggtccaggggcaagcccaggatgctcgccgaacggctgacgatggtcgcaaggtcggcagtgctatagaactctagacgttgaacaatgccgaaacggtctcgcaacgggttggtcagcatgcccgcgcgggtggtcgccccgaccagggtgaacggtggcagatcgagcttgatcgaacgggccgccgggccttcgccaatcatgatgtcgagctggaaatcctccatcgccgggtacagtacttcctcgacaatcggcgacaatcgatggatctcgtcgataaacagcacatcgtgaggttcaagattggtcaacagcgccgccaggtcgccaggacgctccagcaccgggccggaggtggacttgatcgacacgcccatttcctgggcgatgatattggccagggtggtcttgcccaaccccggcgggccgaagatcaaggtgtggtccagggattcactacgcccgcgcgcagcctggatgaacagctccatctgctcgcgcacggtaggctggccgatgtagtcggccaggctcagggggcggatggcccggtcctggacttcttcacggtcacgcgggccggtggccgcgatcagacgatcagcttcaatcacttaaatcattcccttcagggctcggcggatcatgtcttcgctgctcaggttcttgtccttgatggccgataccgccttgctcgcttcctggggcttgtagcccagggagatcaacgcactgactgcatcgctttcggcgctcgcgacctggcctgccggcatatccggctggttcggtaccagggcgaacatgttcggcaccacctcccaggccttgaagcggtccttgagttccaccagcaggcgctcggcggttttcttgcccacgcccggcaccttggtcagggccgaggtgtcctgggcggaaacggcacgtaccagctcatccacttccaggctcgacatcaatgccagggctagttttggccccacgccattgaggcgaatcagctcgcggaagaaatcgcgatcacgcttgccgatgaaaccatagagcagttgcgcgtcttcacgcaccactaaatgcgtgtgcagggttatcggctcgccgaccgacggcagccgatacaaggtggtcatgggcacttccagctcataacccaatccattcacatccagaatcaggtgcggcggctgtttttcagccagggtgccgcgcaagcgtccaatcacggttcagatccttaaggcttgagggtcaggtcagggcctgaccgcaaataacgaatgcgctgatgctatcagagacgtagccgcccgccacgactacgtgcggtgcccaagccgtgaggcaacaggctggagcgggtgtgcgcatggcaaatggcgatggccagggcatcggaggcgtcgatctgcggttttgaagtgagcttgagcatgtgcatgaccatcatctgcacctgctccttgttcgctgcaccagtgccaacgacggcctgcttgacctgggtcgcggtgtattcggcgatctccatgccctcctcggcccccgccacgatcgccgcgccacgggcctggccgagtttcaacgcagagtcggcgttcttggccatgaacaccttttcgatgcccatggtgaccgggccgtaagtctggatgacttcacgtacgccgcgatagacgatctgcaaacgctcggccaactcgccggcgccggtgcggatgcaacccgaggccacatagatacagccgcgcggggtgtgctgcaccacgccaaaaccggtgatgcgcgaaccggggtcgatacctaggattaaagtcataacgcctgcggttggggtaaacacattttttgatacacagagactctaatgtgggagggggcttgcccccgatgagggagtgtcagtaagtaaatttgtgactgactccccgccatcgggagcaagccccctcccacacaagcccctcccacattgggatctacatcgttcttcagcctagctgttcagccaccgattccgggatgtcggcattcgagtagacattctgcacatcatccaggtcttcaagcatatccagcatcttcaacaccttctgcgctccctccaggtccagttcggcactggtggtcggcagcatcacgatttctgcatcggtgccgttgaaaccagcggcttccagggcattacgcacggcgtagaagctggcgaacgaggtaaacacgtcgatggaaccgtcttcgttggtaaccacgtcgtcggcgtccgcttccattgcggcttccatcagtgcgtcttcatcggtgccgggggcgaaggtgatctgccctttgcgttcgaacaggtacgcgaccgaaccatccgtgccgaggttaccaccgcacttgctgaacgcatggcgtacagctgcggcggtccggttgcggttgtcggtcatgcactcgaccatcaccgccacgccgcctgggccgtagccttcgtaggtcaactcgaccatgtcgtcggtatcggccgcaccagcaccacgggccacggcgcggtcaatgatgtcgcggctcatgttcgcgcccaaggctttgtccagcgccaggcgcaggcgcgggttggagccaggatcaccgccaccctggcgggcagcgacggtcagttcgcgaatccacttggtgaagatcttgcccttcttggcatcctgacgctctttgcggtgcttgatgttcgcccacttggaatggccagccataacacaactccgaattctctagaaaccttatcaatcccgcaccaggcaggatttccttctttctaaacgcaaaggcgcatccgaagatgcgcctttttgactgcgtacaaccttatcgcgctttcacgccgcagccttactcagccttcggcgtctcgcgcaggcgaatgtgcagctcgcgcagtgccttggcatccaccacacccggagcctgggtcatgacgtccgcagcgctctgggttttcgggaatgcaatcacttcacggatcgactgggcgccggtcatcagcatgaccagacggtccaggccgaaggccaagccaccgtggggcggtgcaccgtacttcagggcgtcgagcaggaagccgaacttctcttcctgttccgcttcgttgatgcccagcaggcggaacaccgcttgttgcatctctttgcggtggatacggatcgaaccgccacccagctcggtaccgttcaacaccatgtcgtaggcacgggacagcgcgcctgccgggttggcttccagctcctgcggggagcacttaggcgcggtgaacgggtggtgcaaggcgctgaagctgccgtcgtcgttctcttcgaacatcgggaagtcgacgacccacatcggtgcccattcgcaggtcagcaggttcaggtcgtgaccgagcttgatacgcagggcgcccagggcttcgctgacgatcttggccttgtcggcaccgaagaacacgatgtcgccatcgaccgcaccgacgcgatcaaggatcgtgttcaggttggcttcaggaatgtttttcacgatcggagactgcaggccgtcaacgccgttggcgcgctcgttgaccttgatgtacgccaggcccttggcaccgtagatgccgacgaacttggtgtagtcgtcgatctgcttgcgcggcatgctcgcgccgccaggcacgcgcagggctgcaatgcggcatttggggtcgttggccgggccgctgaacaccttgaagtcgacgtccttgagctggtcggccacgtccaccagttccagcgggttacgcaggtctggcttgtcggaaccgtagcggcgcatggcctcttcgaaggtcatgtgcgggaattcgccgaactccaggtccagcacttccctgaacaggttgcggatcatctgctcggtcaggcccatgatctctttttcatcgaggaaactggtctcgatgtcgatctgggtgaattcaggctggcggtcggcacgcaggtcttcgtcacggaagcacttggcgatctggtagtaacggtcgaagccggccaccatcagcagctgcttgaacaactgcggcgattgcggcaaggcaaagaagctgcccgcgtgggtacggctaggcaccaggtagtcacgtgcgccttccggggtagcccgggtgaggatcggcgtctcgacatcgaggaagccgttctcatccaggaaacggcgaatgctggtggtcatgcgcgaacgcaggcgcagcttctcggccatttccggacgacgcaggtccaggaagcggtagcgcaggcgggtttcttcgcccacgtcggagtattcgttgagcgggaacggcggggtttccgattcgttcagcacttccagctcgtagcccagcacctcgatgccgccggaagccatgttcttgttcacggcaccggccggacgcaggcgtaccttgccggtgatcttcaccacgtattcgctgcgcacacggtcggcggcggcgaagctctcggcgcggtccgggtcaaacaccacctgggccagaccatcacgatcacggatatcgaggaagattaccccgccgtggtcgcggcgacggtgaacccatccgcaaagggtgatttcctgaccttccagggtctcgttcagttggccgcaatagtggctgcgcatcatggtcgtggtttcacttctcgtaattcgaatttcggtggcaggcttgcctcgtcaccgtacattaaagcaggggacggataatgcaggagcctgcgcgtagagttcaactcagtctgctttgtcgccgcccgccaggttcttcttggcgccggtcttgaaatcggtctcgtaccagccgctgccgctcaggcggaagcccggcatggacaacatcttcttcaactcaggtgcctggcaggcagggcaatcgaccagcggcgctgcgctgatcttctgaatggcttccaactggtgaccacaggaagcgcattgatagtcgtacatgggcatggggatgtctcggcgatcagaacgttacagcgccacgccctgccctgtgcataaagcccggcatgcgcagcaaagcgcgggattatatctggtaaatcgaggcagcgcagccggctttctgcccctggcccggcccgcgaggttgaagggccggccccgaagccagcgggctattgcgcaagcgtgtccgcagacgcggcggcggcgcggcccttgagtacatgaaccacgcataccaccctcaccaacccactgaagttcttcactcctccgtagcgcaaatgcacttcccgatcgacataggacaacaaggcactgactgagcaggtattgatcctggcgatctccgtcaggatgttccaatagatctgctcaagccgcaggcaggtagagaacccgttgagcctgaccgaccgtgacaatggcttggccatccccatatcgaaccccttatcgaaggggtcgatctttatcttgtgaaaaccaccggtttccatcactcccttacctattccacatgacatacacctgacactccattgccaaacagcagccaatgggcttctcccattgggcgatgggcctataaaaccgcaggacgcgcggagcagccagaagacggagagttgttagtcgtaggacaacgccaggaagcgcagggaaacaagcaggcagcgcccagaaggcgccgccagggttcgacagttactggttttcgagcagggaacgcagcatccacgcggttttttcgtggacctgcatacgctgggtcaacaggtccgccgtcggctcatcactgaccttgtcgagcaatgggaagatgccacgggcggtacgcgtgaccgcttcctggcctgccaccagttgcttgatcatctcttcggcgctcggcacaccctcttcttccttgatcgaagacaagcgggcgtagatcgaataggcgccaggtgccgggaaacccagggcccggatgcgctcggcgatggagtccactgccagcgccagttcgttgtactgctcctcgaacatcaggtgcagcgtacgaaacatggggcccgtgacgttccagtggaagttgtgggtcttcagataaagaacataggtatcggacagcagccgcgagagtccgtcgacgatggatttacggtcttcttcactgataccaatatcgattgccatgtttttccccttcaattgacgagcattcattgatcaggtgcaggaccactctagcaagagagcgggcctcgtgcagcccgacacacccgggcagcgtgcggcaaatcgcccctgcaccgcctgcagacgtgaattggcaagcctttctccccgtaggaagcgtctctgtaggccaccaaaaaaacctgcacctgtctaggacaagggtttgccgcagaaatgccgtacccggcgcaacacgccgaaatgcttgatttgagtaggcacggcctttgctgttaaatagacgccgtgtggctgccgtttatttctgcggcacgccacataggctgatacccgcgtacgtgctcaacgcctcccattgttcagaagcgaaccgtgccagtcagctcttccttgtgatccgtcttaacgtgagttaatcaaaatgttgaaaatcgtccacctgctaacgggcgttgcggctttgctgctgtcctttatcccgagcctgcagcctgaaagcctgccctacctgcaacaacacgacgctctgtacctggccttgttcggccttcttaacctgacgctcgcaccggtaatcccttactggaacaaaggcacgcgtcatcaactgcaaaacctggtcagtgcgctgctggtgctgactgttgtcgtacaaaccctcaccctcctggcgcccatgcctgaagtcggtggccatccggctatcctgctcagcctggtgattgctgtggttgccatcgttcttcacctggccatcagcttctaccgttcgtccccagcggccgcgtcgcaaagctacgacatgaccaaccgggataccgggaccgtcaagtggttcaacacctccaaaggcttcggcttcatttcccgcgattcgggcgacgacatcttcgtccacttccgggctatccgtggcgaaggccaccgcgtcctggtcgaaggccagcgcgtggagttctcggtgatgaaccgggacaagggtctgcaagccgaagatgtcatcgctgccctgccgcgtcgctgatcccagccttcgcagcaaaaaaaaccgcgatccagcgttgcctggatcgcggttttttattgcctgccgtttcaatagtgcggcggcggcgcttcttcttcggacgactcgaactgcccgcccatttcttcctgacgcttgagcaatgccgtcatctgcaattgcaggcgctcgaccgcccgctgctgggtgaccaggatgtcattgagggtctcgatggtgtcgtcctggaaggccaggcggctttccaggtcggtgacgcgatcttgcaggtccatggttcagtcctgggtaaagatgaagtcggcgggcaatagctcacgcaaacgggcgcgcatcgccgacacttgctcgtggttataaggttgagcgggatgtttgccccacaccggagccggccaggcggcgtcatcgcgtttgcgcacgatcacgtgcacatgcaactggctgaccacgttgcccagcgcgccgatgttcatcttatcggcggccagcccttcattaagcagttgcgccagggccgtcgtctcttgccacaaggtttgttgatctgcgacatccagttgaaacacttcgctgataccgtcgatgcgcggtaccaagatgaaccaggggtagttcgagtcattggacagcagcaggcgacacagcgggaagtccccaatggccaaggtatcttgttgcaggcgttgatctagggcgaacacgtgggcactccgttcggcaggtcagtttcaggcgcccagcataccttcgaatgcccacgcgttcacggcgaatgggcacaagccttgaggcaatcggataaaaactacgcaccctttcgaggcaggcgcacggtcgaacacgctacctcgggcctcggcggcacgcaccaaaatgactcgcttgtgcatcaaagggatccgccaagtacccactgatggggtggaccggtaacgttttacccaggcgaacgcttttgtgaatgaacgcacaggtgtaacagcccggcgcctagctcgaaccaaagggtctaaaggccccgtgtttatgcggtttttacactcccttcacgcttttcacgaaaaaatgacattcggctaccagtttgagcacgcttgttgcattcaccctcatatcgtcggcaacggcacccgtttggaagcaggtgtttcgcgataaaaaccagcggcggttcaatgcgcatcaaggaagccttcaaagttagaaagatgtaggaaaagagcattgaagttgtcagcccggttacattcgggctgtgaatttgcgacatggatctagcgatttacgacagcctcgtaaagaagctgaaaggaaagatgggtaagtatcgtcattagagtctgcgtgatataactttgcgccgacacaaataaagaaagagccgcccagataaaaatacaggtgggacggcagtactcttcctaaaaccaaaggagcaaatcacgatgcgcgtgatgaagtggagcatgatcgccctggctgtttcagcaggcacctcgcagttcgcaatggcgtccgcccaggacgattccaagggctttgttgaagacagtacgttcactatcaatactcgcgccctgtacttcagccgcgacttccgtaacaacccttcgggcccgggttcgaagagccgtgcagaagaaaccggccttggcttcaatgccctgtacgagtcgggcttcacccaaggcaccattggtgtcggtgttgacgtgatcggcctgatgggcctcaagctcgacagcggcaagggtcgcgctggcaccggcctattccctacaggctccgacggtcgttcgcaggacgattactccaagggcggcggcgcggttaagttccgcatctccaacaccgtgttgaaagtcggtgaccagtacactaccgcgccagtgttcgcctccgacgacagccgtctgttgccggaactgccacagggtatctcgatcaccagcaacgagatcaagggcctcaagcttgagggcggccactttacttccagcgtcgcgcaggcacagacctaccatgacagcctgggcctgacgaaaaccgactttgtcggcggcgtctacgcgttcactccggaattcaccggtagcctgtactacgcgaaaaccgaagattacttccgcaagtactacagcaacctgaactggacccacgcgctgagcgatgatcagtccttcgcgctggacttcaacatctacgacaccaaaagcgagggcgcaggcctgcaacgcgcagagaaggatggcgtgaccaagctcgacaaccgcgcgttcagcttgcagggcgcgtacaccatcggcgctcacaccttcaccctggcagcccagaaggttaccggtgacggcgactacggttacggcgtagacggcggcggcacggtgttcctcgccaactccatcgcccgttccgacttcaacgccgaaggcgagaagtcctaccaggcgcgttacgacatcaacatggcgaccttcggcattcctggcctgagcttcatgactcgctacgtcaccggtagcggcgccaacactggcacaaccagcaacggcaaagagtgggaacgcgacatcgaagccaagtacgtgattcagagcggcccggctaaagacctcagcctgcgtctgcgtcaagcgacttaccgctccggtgatggcgtttactacggttcgccttctatcgacgaactgcgcctgatcgcaaactacccgctgaacatcttgtaatcgtctctttaattacaacgatggcttaaggcttcggccttgaacaaaaaagccgctccctgtttaaacaaggagcggcttttttattgcagttttgtttcaaccaaaaaaactagcaagctaagtaactagtttaccgaagctgacctatcggccaagttcggcagcttcacgccaaattatttcgccgcactttcctgcatcacacgaataacacgctgcggaaacggaatatcaatccccgctgctttcaaacgatcacgcgccagttcattaaacatgaacatcacgtcccaataatccggggtactggtccagcagcgcagggaaaccgtaatggagctgtcgcccaaggtcgaaacaaccgccaccggtgcagggtcggccagcacccgtgggtccttggccagttccagcagcacttcgcgagctttttgcaggtcagcctcgtaatccacaccgacatcaaacaccaccttgcgggttggctggcggttggtgttggtgatgatgccgttggacaggatgccgttgggcaggatcaccgtcttgttgtcgccggtacgcagcacggtgtggaaaatctggatgctgtcgacagtgccggaggtgccttgggcttcaatccagtcgccaatgcggaacgggcggaacagcaggatcagcacgccaccggcgaagttggccaggctgccttgcagtgccaggccgatggccagggtcgcggcgccgatagcggcgacgaacgaggtggtttccacaccgatcatcgaggccacgctgaccaccagcatgactttgagcacgatgtttgccaggctggtaatgaagtgctgcagcgccaggtcagcgttgcgcaccgccagcaagcggcccacgcgatgggtcagtttgttgatcagccaccagccgatggccagggtcagcacggccagcaatacacggctgccgtactccatgatcatcgggatccaggactgggaggccttgatcaaatgatccacttctgcgtttaaatccatgtagcttctcctgtcttcgcggatatgcggcttgattgactgcctgaaaacgcaattgagccccgtagggctcaattgtaggcgctgagtctggggcgtgggacgtcaaaaaaccccacaggttccccaaagtgccatcagtcgcggaagttattgaactgcagcggcatgtcgaaggtcttggcgcgcagggccgcgatggcctcttgcaggtcgtcgcgcttcttgccggtgacacgcacctgctcgccctgaatggcggcctggactttcagcttggcatccttgatatgcgcgacgatcttcttcgccagctccttgtcgatgccttccttgagcacggcttcctgcttcatcagcttgccggaggcgtaggcgtccttgacttcaaggcactgcacgtcgatcttgcgcttgaccagggccagcttgagaatctcgatcatcgcttccagctggaaatcggcttcagcggtcaggttgacggtcagttccttttccttgaattcgaagctgcccttgcctttcaagtcatagcgacggtccagttccttgacggcgttctcgacggcgttggtgacttcgtgtttgtccagttcagataccacgtcgaacgaaggcatgtgatttctccaatataaggggcgggctcagtaaagatggagcgcgcccgagctaaaatgccgaggcattatagcggttctttcgcctcgttcactgtgagcgaccctacggagcacaaactgatgtcgaccccctggcatattctcggcgctggcagcctgggcaccctatgggccacgcggctggcgcgtgccggcgtaccggtcaggctgatcctgcgtaatgaggcgcgcctggccagctatcgcgccggccagggcctgaccctggttgagcacggtgtggaacacacctatgcggtgattggcgaaacagccgaaagcccggagccgattcatcgcctgctggtggcatgcaaagcctatgacgcccaacgcgctatcgcccagttgcaacctcgactggcgccggatgccgaactgatcctgctgcagaacggtctcggcagccaggacgccgtggctgcacaagtgccgtcggcccgctgcatctacgcgtccagcaccgaaggcgcatttcgcgatggcgattggcgggtagtgtttgccggccatggctacacctggctgggcgacgcaaaccatcccaccccgccgctatggttggacgacctgcaagctgcgggcatccctcaccaatgggccaccgatatcctcacgcggctgtggcgcaagctggcgctcaattgcgccatcaacccgttgaccgtgctttaccaatgccgcaacggcggcttgcaagaccatcagtgtgaggtcgccacgctctgcgccgaactggccgaactgctggagtgctgcggccagcctgcggccgcaaaggacctgcacagcgaagtggagcgtgtaatccaggccaccgccgccaattactcgtccatgtaccaggatgtcgccaacgcccggcgtaccgaaatcagctacctgctgggctacgcctgccaggccgccgctcgccaccggttggtattgccgcatttgcaacagctgcaagcgcggctggtcgaacatttgctggcacgcggattggccagcgactgaggcacgcgctaccctgcctacctgtctatcacctgggaaaaccctgatgccactgcgccagcgtcttgaaaatctaccggtagggcagaaactgctggtggccctgctggtgctattgaccacggtgttgctggtggccaatctcacatttatcagcgccgcctactggatctcccaggaaagcatggcgccccaggcattgcaggccattggccgactggtgtccaacccatcgctcgccgccgacgcgctcgaatccccggccaaggccgaggcgctgctcaatgaactgaccagctactcacccctgcgcgccgccgcactctacgacggtgaaggcaaccgtctggcgcagatgcagcacggcgaccgcctgcacctgccggacaattaccggcatatcgaggcctggcgcctgaccgagtttcgcagcaaccaggtcatcaccctgccccgcggcacccagccttccgggcatttactgctggtggccagcagtgagctgccggtggccttctataccggcacgctgaccgcgagcctgggcatcctgattttcagcgtgctgttgtggctggtcatcgcccggcaaatcaaacgtctgatcacgcggcccatccatgaactggaagaactgtcgcggcaggtcacccgtgaagagaactacgccctgcgcgccgggcgtggcaaccatgacgagatcggcagtctggccgaagccttcaacaccatgttgtcgcgtatcgaagcccgcgagcagcagctcaagcgtgcgcgtgacgattcccaggccgcttacgaccaggcccaggggctggccgaagaaacccggcataccaaccgcaagctggaactggaagtccaggtgcgcagcaagatcgagaaaaaactcacgggcttccagaactacctcaacagcattatcgactcaatgccctctgcgctgatcgccctggatgaacagctctatgtcacccagtggaaccaggaagccaccgccctttccggcacgcgcctggacgaagcactgaaccagccgatcttccttgccttccagccgctcaagccgtacctgccgcaaatcaaggctaccgtggagcaacatacggtggagcggatcgagcgggtcacctggatcaaggacgatgaacccaagcattacgccctgacgttttacccattgatgggtggtgccgggcgtggcgtggtgatccgaatcgacgacatcacccaacgcctgtccctggaagaaatgatggtgcagtcggaaaaaatgctctcggtgggcggcctggccgccggcatggcccacgaaatcaacaacccactgggcgcgatcctgcataacgtgcagaacatccgtcgccgcctgtctccggagctgcccaagaacctggagtacgccgagcaggtgggcatcgagctggacacggtcaatcgttacctgcaaggccgcgaagtgccgcagttgctcgacggtattcagcaggccggggcgcgggcggcgaaaatcgtcacccatatgctcagtttcagccgccgcagtaatcgccagatggcaccctgcgacttgccggccttgatcgaccaggccgtggaaatcgccggcaacgatttcgacctgaccatcggcttcgacttcaagggccaggcgatcatccgtcagttcgacccgcaactgggccctgtgcccggcaccgccaacgagctggaacaagtgctgctcaacctgctgaagaacgccgcccaagccattcacctgcgcgaagacgacagcgagccggggcgtattatcctgcgcacccgcctcaacccgccgtgggcagaaatacaggtggaagacaacggcatcggcatgagcgaaaacgtgcgcaagcgcaccttcgaaccgttcttcaccaccaaggaaattggccagggcaccgggcttgggttgtcggtgtcgtatttcatcatcaccaacaaccacaagggccagatggaagtgcattccaccccaggccaaggcacctgctttaccttgcgcctgcccctggccggcagccaattgtcccccacagaactcacccaactggagcactgaccatgggctttcgcctgtcgaaaatctacacccgtaccggcgacaagggcgaaaccggcctcggtgacggccgccgcgtgcccaaggaccacccgcgcgtggaagcgatcggcgaggtggatactctgaacagccagttgggcctgttgctggccaacctggaagaacaaagcggcaagcacccggcgttaaatgatgtgattgaagtgctcacgccgtgccagcaccgtctgttcgatctgggcggcgagctggcgatgccggtgtacaaggcactgaacgcagcggaggtggatcggctggaagcggcgattgatcgctggaacgaagaagtggggccgctggagaacttcatcctgcccggtggttcggcgctgatcgcccaagcccatgtgtgccgtagcctggcgcgcagcgctgagcggcggtgtcagcacctgaatgcgctggagccgctggaaggggtgggtttggcgtatatcaatcggttgtctgacttgctgtttgtggcggccagggtgattgcccggcgccaaggtgttgccgaagtgttatggcaggccgctgccaagccacactgagatttatcgggtgagtggcaaggccctatcgggggcaagccccctcccacattttaaattgtgaatacattcaagtgtgggagggggcttgcccccgattaggcccgtgagggcaccatcaaacctcaggccagaaagcccgaatcccagccaccccttgcgccccggcgtcccacgcctgctcccgctgcgcaggcccaaccccgcccagcaggaataccggtttactgaacccggcaatcaactgcgccgcctgctcccaacccaacggctgcgcatccggatgggtctgggtcggctgcaccggcgagagcgtgacaaagtccacgtccatcatctctgccagcgccagctcttcagcattgtggcaagaagccgccaaccaacggtctttcggcagcgggcggcccttgctcgcgtatttgcgcaattgcgccgaggtcatgtgccagccagcagcagggaaatcccccagccactcgaacggccccttgagcatcaattgcgccttaccggcacacaggccaaccgcatccaccgccagatcacggtatttagggtcgtagccgttgggcgcacgcagttgaaccagcttgataccccctgcgatggccttctggatgccgcgcaacagcgttggggtttccagctcgcctggggtgatcaggtactcggcgggcaagcgcgcagcggcaacaatcggcgcatttgccgccgggaactcatagttgaccaggtcccgtggcgtcacccattccaacggctgcccttcggccccatggggctcgccggtaaaggccgagacttcccagacgtccagcaacacctgcttgtccgggtaatcatgccgcaccttgatcaacggccgtgccgtagtgacctggatacccagctcttcctgcagttctcgtgacaaggccgtggcgaccgactcatcggcctccaccttgccgccgggaaactcccagagcccgccctgatgctgggtatcggcacggcgcgccagcaggatcctgccatcgacaccgcggatcaccgctgctgctacatgcactcgtttcaccgccagtttcctcttggtatcaggtacggtattccgcattgatcttcacgtactcgtgggacaggtcggtggtccagatggtttcgctgcacgcgccgcgccccaattcgatgcggatggtgatttcttcctgctgcatcaccgccgagccctgggcttcggtgtaggtttcggcgcgagcaccccggctggcgatgcacacatcgccgaggaacacgtcgatcttgctcacgtccaggtccggcacgccggcacgaccgacagccgccaggatacggccccagttcggatccgaggcaaacagcgcggtcttgatcagtggcgagtgcgccacggtgtagcccacgtccaggcattcctgatggttgccgccgccgttgacttcaaccgtcacgaacttggtcgcgccctcgccgtcacgcacgatggcctgggccacgtccatgcacacttcaaacaccgcctgcttcaacgccgcgaacagcgggccgctggcttgcgtgatgggtggcaggtcggcctgaccggtagcaatcagcatgcagcagtcgttggtcgaggtgtcgccatcgatggtgatgcggttgaacgacttgttggccgcgtccaggatcaggctctgcagcacgtcgcgggagactttggcatcggtggcgatatagccgagcatggtggccatgttcgggcggatcatgcccgcgcccttgctgatgccggtcacggtgaccgtcacgccgtcgtgcacaaactgacggcttgcgccttttggcaaggtgtcggtggtcatgatgccagtggccgcagccgcccagttatccacagacaggtcatccagcgcggcttgcagggcgccttcgattttttccacaggcagtggttcaccgatcacgccggttgagtaaggcagcacttggctggcgtccacgccggtcaattgggccagcttggcgcaggtgcgcgccgcggccaccaggccaggctcgccggtgccggcgttggcattgccggtattggtcagcaggtaacggatggtgccggccacgcgctgcttggccaggatcaccggcgcagcgcagaaggcattgagggtgaacacaccggcgacggtcgagccttcggcacagcgcatcactaccacatccttgcgccctgggcgcttgatgccggccgaggcgatacctagctcaaaaccggcaaccgggtgcaatgtgggcaaaggaccaagaccaacagccatgaatgcgctcctcaaaaataggtggtgtctgtgccgtcgcgatcgacggtgggaattaatggcaaaacgccgcgacggctagtgccggtcgcggcgcggggtgttgcagcgtcaggagaaaatcttagttgatttcgccgtggcagtgtttgaacttcttgcccgaaccgcaccagcacagctcgttgcggcccagtttctgatcgttgcgcaccggagtttgcgccaaggccacatcgacctcttcgcccaatgcctcaggcgcttccaggcccggtgcttcgtcatgctggaactgcatgcgcgcagccagtgcctcggcttcctggcgcaggcgtgcctcttcctcgactgggtcttcgcgacgcacctgaacgtgggacagcacacggatcgaatcgcgcttgatcgaatccagcagctcggagaacaaggtgaacgactcgcgcttgtactcctgcttcgggttcttctgggcatagccacgcaggtggatgccgtgacgcaggtggtccatggtcgacaggtggtctttccacaggtcgtccagcacgcgcagtacgatttgcttctcgaaggtgcgcagtgcttcggcactcgcctgctcttctttttcgttgtacgcggccagcagttcggccatcagtttttcgcgcagggtttcttcgtacaggtgatcgtcttcgtccagccactgctggaccggcagatcaaccccgaagtcgctcttcaacgccgcttccaaaccggcgacgtcccactgctcaggcagggactgtggcgggatgtgggcgctgacggtggcgttgagcacgtcctgacggaaatcggcgatggtctcgccaatattgtcggcggccagcaacgtgttacgcatgtgatagatcactttacgctgttcgttgttgacgtcatcgaactcgagcaattgcttacgaatgtcgaagttacggccttcgaccttgcgctgggccttctcgatggcgttggtcaccatgcggtgctcgatcgcttcaccggactgcatgcccagggccttcatgaaattcttcacgcggtccgaggcgaagatgcgcatcaggctgtcttccagcgacaggtagaaacggctggaaccggcgtcaccctggcgaccggcacggccacgcagctggttgtcgatacgacgcgattcgtggcgctcggacgcgattacctgcaagccaccggattcgagcacggcctggtggcgtttctgccaatcagccttgatctgggcgatctgctcgggggtcgggttatcgagggaggccacttccacttcccagttaccgcccaacaggatgtcggtaccacgaccggccatgttggtggcgatggtcagcgcgcctgggcgaccggcctgggcgatgatctcggcttctttctcgtggaacttggcgttgaggaccttgtgctcgataccttccttgttgagcaggttggacacgtgctcggacgtctcgatggtggcggtacccaccaggatcggacggcccttggccatgccatccttgatgtcgttgatgatcgccgcatatttctcttcggcggtcaggaacacgaggtcgttgtagtctttacgggccagcggcttgttcggcgggatgaccaccaccgacagaccgtagatctgatggaattcgaacgcttcggtgtcggccgtaccggtcatgccggacagtttgttgtacagacggaagtagttctggaaagtagtggacgccaacgtctggctttcagcctggatgttgaggtgttccttggcttcgatggcctggtgcaggccttcggacaggcgacggcccggcatggtacggccggtgtgttcgtcgaccaatacgacctggccgtcctggacgatgtattcgacgttgcgatggaacagcttgtgggcgcgcaggccggcatacacgtgggtcaacaggcccaggttgtgcgccgagtacaggctttcaccttctgccagctcgccgatctgggtcagcatctcttcgacgaactggtgaccggcttcgttgagttcgacctggcgggtcttctcgtcgatggtgaagtgaccttctttggtcaccacgccttcgacttcttcgatgtgctgttccaggcgcgggatcaacttgttgatctcggtgtacaggcgcgagctgtcttcggcctggccggagatgatcagcggggtacgggcttcgtcgatgaggatggagtcgacttcgtcgatcacggcaaagttgagttcgcgctggaatttttcttccatgctgaacgccatgttgtcgcgcaggtagtcgaaaccgaattcgttgttggtgccgtaggtgatgtcggcggcataggcggcgcgcttttcttccggcggctggaacggcgttaccacgccgacggtcaggccgaggaattcatacagcgggcgcatccagttggcgtcccggcgggccaggtagtcgttcaccgtcacaacgtgcacgcccttgccggacagtgcgttgaggtagacacccagggtggctaccagggtcttgccttcaccggtacgcatttcggcaatcatgccttcatgcaaggtcatgccgccaatcaactgcacgtcgaagtggcgcatgcccatcacacgcttaccggcttcacgggcgaccgcgaaggcttcggggagcagcttgtcgagggtttcacctttggctatgcgggccttgaactcttcggtcttggcgcgcaattgctcgtccgacagggcaaccatctgctcttcgaaggcattgaccagctgcaccgtcttgagcatgcgtttgacttcgcgctcattcttgcttccaaaaagtttctttaacaaaggcgcaaacatatcggcaggttcttccacacatagggatggagggcgcaccgtcagtggcccgagcagccctcacggccgcatgcgaacgcgcattctacccggaatcgtgggtgaggaaagtggcgttgttccccgatgctggcatgggcctgtgagagggcttgtttaaaataagggcttttgctggaacttcaacccatgaagtgaagaagttacctattgatttcatgggaaaagccctgcagaagcatggctccgggccgtaccggcgctttctgttaagatgagcgctctgttacttaaggtgtccagacatggcatttcgccctcttacagcccgcgctcccggcgtgttgctccgcgaagccaagccgttgaaagccatctacggccaggcgcaacgcttgggtcatttgcaacgcctgcttgaaagccaattgcaaccagccgcccgtgaacactgccacgtggcgtcctggcgagaaggcaacctgctgttaattgtgaccgacggccattgggcgacccgtttgcgctaccagcaaaaacgcttgcagcggcaattgatggtattcgatgaattcgccggtttgacgcgcatacaatttaaggtacagccgccctccgtgccgcagcgcacggtgggacacacgctggacctgtcggtaaatgcggccgaaaccctgcaggcaacggccgaagggatcagcgacccgggcctgcgtgcagccctggagcggctggccgcccacgcccggcccaagccctgaaacgctatttgcgtttgctgccgcccaacagcgagcccagcaagccacgcaccaactggcgccccatctgattggcggcctgctgcatcgctgacttcaacgccttgcctgcggtggtgccgaggaatgcaccggccttctcggtaaagctcggttcttcggcggtcggtgcagtctcgccagtaggcccaagttccttgcgcgccatcagcacttcataggccgactcacgatcaaccggcttgtcatagcgacccagcagcggcgaactggcgaccaaggccgcacgttcggcttcgctgagcggcccgatccgcgattgcgggggggcaaccaacacacgctggacgacttctggcgtgcctttatcctgcaaggtgcccaccaacgcctcaccggtgcccagctctgtcagtaccgacaagctatcgaacgccgggttgggccgaaaaccatccgccaccgcccgcagggatttctgttcttttgcggtaaaggcgcgcaaaccgtgctggatacgcaggcccagttgcgccagcaccgtatcaggcaggtcgcccggcgattgggtgacgaagtacacgccgacacctttggagcggatcaagcgcaccacttgctccaggcgctcctgcaaggctctgggcgtatcggcgaacaacaaatgggcctcgtcgaaaaacagcgccaacagcggcttttcagcatcgccgcgctccggcaactgttcgaacaactcggccagcagccacaataggaaggtcgcgtacaccttgggcgcttcatgcaccaggcggctggcgtccaacaggtggatgcgcccacggccatcgctggcgggctgcagaatatcttcgagttgcagggcaggctcgccaaacagggcttcagcgccttgctgctccaataccgccaggcgccgcaacagcgcctggctggaacccgtggtcatcaatgccgcgtcttcgcccagcagttccgggtggtaacgcaggtggttaaggagcgccttgaggtccttgaggtccagcagcaacaggccttcgcggtccgccaccttgaaggccgcgtagagcgccgattgctggctgtcggtgagttccagcaggctgccaagcaataacgggcccatttcgctgatggtggtacgcagcggatgaccggactggccatggatatcccaaagggtaacggggtacgcctgggccttgtagtcaaggaatggcatgccggcaatccgctcggcgactttgccctgcggattggcagcggcacccaggccgcaaaggtcgcccttgatgtcggcggcgaacaccgccacacccgcatcactgaaggcttcggccaggcgctgcaaggtgacggtcttgccggtgcccgtggcgccggcgatcaacccatgacggttggccaggcgcatggactgggcgatgggctggccgtctgggccggcaccgataagcagttgtgtggagtcaggcatttcgtcacctatggttaatctttagtgccgcaaggtcgatatagacagatgtaagcccgacaaagactaaaaaatggtcagataattccgatatggaccgacggagctatcaccagaaataccacaccttttttgacgctgccattttgcgcctcccgtccaggaagcgcctcggatattaagaccttagcggaccctacaagccatgaataaaaatctgcgcttcagccacaaaatcctgcttgcagcctcccttatcgtcatcgccgccttcgcgttgttcaccctctacaacgactacctgcaacgcaatgcgattcgcgacgacctcaataactacctgcatgaaatgggcgaggtcaccgccggcaatatccagacctggctcaccgggcgtatcgcgctggtggaaaacgcagcacaaaatattgccatcaacccagaaccgtccgtggtcgccagcctgctggaacagaaagcgctgacctcttcattcatggcaacctacgtcggcgacagccagggcactttcaccatccgccctgatacaaagatgcccgacggcttcgatccgcgtgttcgcccctggtacaagggcgcccaggccagcaacggctcaaccctgaccgaaccctatatcgacgcggccaccggtcaactgatcatttctgtagccacccccagcgccaaggccggccagagcatcggcgtggtaggcggcgacctcagcttgcaaaccctggtggataacatcggtgcgctggacttcggcggcatgggctatgcgttcctggtcagtgccgacggcaaagtgctggtgcacccggacaagaccctggtgatgaagaccctggctgacgtgtatccaaaggacacgccgaagatcagcggcgacttcagcgaagtacaagccaacggcaaaaccaacatcgtgaccttcaccccgatcaagggcctgccatcggtgaactggtacctgggtgtgtcggtggataaagccaagtcgttcgccatgctcagtgaatttcgcacctcggccgtgatcgccacgatcattgcggtggtgatcatcatcgccctgctgggcatgttgatccgtgtcttgctgcaaccgctgcacctgatgacccgcgccatgcaagacatcgccgacggcgagggcgacctgacccgacgcctggtcatccagaacaacgacgagttcggcaccctcggcaatgccttcaacagcttcgtcgagcgtatccatacctcgattcgcgaagtgtcttcggccaccgaacaggtcaatgaagtggcgctgcgcgtggtcagcgcctccaactcgtcgatggtcaactccgacgagcaggccaaccgcaccaacagcgtcgccgccgccatcaatcaactcggtgccgccgcccaggagatcgcccgcaacgccgcccaagcctccaaccaggccagcgatgcgcgccacttggccgaagacggccagcaggtggttgaacgcaatatcaaggcgatgacacagctatcgagcatgatcagcgcctcgagcagcaatatcgaagcacttaatagcaaaaccgtgaatatcggtcagattcttgaagtgataaccagcatttcccagcaaaccaacctgctggcgctcaacgcggccattgaagcggcacgcgccggagaggccggacgcggctttgcggtagtggccgatgaagtgcgcaacctggcccaccgcacccaggagtcggcgcaacaggtgcagaagatgatcgaggagctgcaggtcggcgcacgagactcggtgagtaccatgagtgaaagccaacgccacagcctggacagcgtggaaatcgccaacctggccggcgagcgcttgaacagcgtgacccagcgtattggcgagatcgacggcatgaaccagtcggtcgccactgctaccgaagaacagacgtcggtggtggagtcgatcaatatggacatcaccgagatcaacaccctcaaccaggaaggcgtggaaaacctgcaatcgacactgcgcgcctgctcggacctggaacggcaagcgtcacgcctgaagcaattggtgggcagcttccgtatctgatagacagaggggcctggcggtactcagtcaaaatgtgggagggggcttgcccccttccgacattcgccagcatttcaaacttgaacatgcagcacggcatcaatcccaatcgaacatctctgcgcgtctcaggtccacgttaatgagagcaatggatcggagggatgtttatcgtgcatatcgctgacataaccatgttctacgccccggcgagtggcggcgtacgcacctatctcgacgccaagcaccgacgcctggcgctcaagcctgggattcgccacagcctgctggtgcctggcgcgcacttgagcgagcacgatgggatcttcaaggtgccggctcctgccctgccctttggcaagggctatcgcttccccctccgcttggcgccctggcgaaatgtactgcacgatctacagcccgatcttatcgaagtcggcgatccctacctcaccgcctgggccgcgctcgatgcccggcgccagctggacgtgccggtgatcggcttttaccactccgacctgccgctgctggtaagcaaccgcatggggccctggtttacgcccaacgtcgaggcctatgtcagcaagctctacgggaatttcgatcgggtactggcccccagtaaggtgatggccgacaaactcaccggcctcggggtcagaaatgtcttcgtccaaccgctgggggtggacctgcaaaccttcacccccgacgtgcgcgaccctggcctgcgcgccgagctggggattggcgaagacacccgattgttgatcttcgccggacgcggttccaaggagaaaaacctgccggtgctgctcaattgcatgaagcgcctgggcgacggctaccacttgctgctggtgggctcgggcatgccggccaacgtgccggataatgtcaccgtggtcgatggattccgccctgcccagcatgtcgcccggctgatggccagcgccgacgccttgctgcatggcggcgaccaggaaactttcggcctagtgatcctggaagccatggcctgtggcatcccggtcgtcgccgttgcggccggggccttcactgaaattgtcgacgagcgctgtggcctgctgtgtgcgcccaacaaccccaaggcgatggctgacgcggtgcgcgaactgttcggtgccgacagccgacgcctgggcgcccaggcgcggcagcacgttgagcagcattatgcgtgggacaccgtagtcgatagcctgctgggccattatcacgccgtgctgggcacgcacaaaccgatgctcgcccatggctgagcgttcggtcatgctggtgttgcacgatgtagcaccgagcacctgggctgactatcgcccgtttgtccaggccgtggatgcgctgggcaacgtgcccatcacctggctggtggtgccggacttccatcaccatgacgacctggccgcccacgccgactttcgccgcttgctcgacagccgcgtggccaagggcgatgaactgaccttgcacggctactatcattgcgacgacctgcccaggccacgtacaccaaaagactggttcatgcggcgcatctatacacatgaaggcgagttttaccagttgtcccaggccgaagccttaaagcggcttactgccggcatcgagatattccagcgcaatgactggccgctgcacgggtttgtcgcccccgcctggttgatgagcgacggcacccgccaggcattgcgccagttgccgctgagttacaccagcgacccgcagcatctttatcgactgcctgacttcacgcgcatcgacgccccaggcctggtctggagcgcccgcagcgcatggcgccgcggcctgtccaaagtcctcagcgaccaacgggagcagcgctggcagaccgccccggtgatccggttggggctgcacccggttgacatgcgccacgagttttctcgtcgtgcctggctacaaactctgcaacgcctgctcaatgctgggcgcactccacagaccaaggccgcctggctggcgacgcagccatgagcaggctgatctggttattgctggccctgctcatcgcgctggtgattcccgtttggctgggcggcggagaaaccctgttgcgcctgcggcagttccccttgccccaattgctggggatgtttgccatgattatcggctgctggctgatcaacagcctgcgcatccgtctgctgctcggcgagcagcgcggccagttggggccgctcaaaagccttggcgtggtgatctccaccgagttcgcaatgtgcgctacgcccgggggcagcggtggccccctgacactgatggcgctgctggcgcgcaatggcatacgtcctgcccatggcagtgcggtgtttgccatggaccagttgagcgacttgctgttttttctctgcgcgctggcgggcattctcttgtatgcgctgttccatagcctcaacccacgaatggagtggctgctggggctcagcgcggtatcgatggtcggcgggatcatcagcggctggctggtcgtgcgttttcatcgccgcctgattcgccttacgggcttggcgctcaagaccctgaaagtacgcgccagcacccgccgacgctgggcgcgcaagttactgcgctttctcgcagcctttacccaaaccctgaaattgccttggcacacgctgttacgagtgtttgcgctgaccagcctgcattggttattgcgctacagcgtgttgtacctggcgctgcgtggcctgggcggcgatgtgcagtgggcctggagcttcctgatccagatgctggcattgacggcggggcaattcagcctgttgccgggcggggccggggcggccgagctgacctcggcggcactgttggcgcccatggtaggcaaaaccacggccgcggcggcgattctgatctggcgggcggtgacctattacttctacctgctggccggcgcaccggtgtttctattaatggtcggcaaaccactgctcaaacgtctttttcggggggcacgcaaggttcgtcctgctgcagctgttcccacaagcgggcagccccggggaaatcagtaccatcctcggcatccagcgcatccgggtcgtagcgactcagacagccctcgcccaaggtagcgggcgccctggaggtggctttatcgagggggtcggtcatgtgggtgtcctacaaataaaaagggcctagggagttgtacccccaggccctttcttattcaactattcaacccaacgggctgatcagaacaccacggtcttgttgccatgcaccaacacgcgatcttccaggtgataacgcaggccacgggccagcaccatcttctcgacgtcacggccgaaacgcaccatgtcttcgatactgtcgctgtggctgacgcgtaccacgtcctgttcgatgatcgggccggcatccagctcttcagtgacgtagtggcaggtcgcgccaatcaacttcacgccgcgcagggaagcctggtgatagggcttggccccgacaaacgacggcaggaagctgtgatgaatattgatcaccttgccggcgtattcacggcacagttccggcggcaggatctgcatgtagcgcgccagcactaccacgtctgcgtcgtgctgcttgaccaggcgcgatacctcggcgaacgcaggctccttgtcctggggattgaccggcacgtggtagtacgggatgccatgccattcgaccatgctgcgcaggtcgtcatggttggagatcacgcaggcaatctcgcagtccagctcatcgctgtgccaacggtgcagcaggtccgccaggcagtgggattcgcggctggccatcagcaccacacgcttcttctgctccgtgtcggtgatgtgccaggtcatcgaaaactcttcggcgatcggcgcaaacgcctcgcggaaggcttccaggccaaagggcagtgtatcggcacgaatttcgtgacgcatgaaaaaccaaccgctgagatcgtccgagtgatggctcgcctcggtgatccaaccattgtgggaagccagaaagttactgaccttggcaacgatgccaacccggtccgggcaagcaatcaccagccgaaaagtgcgcattagggggaaactccagaacttcgcaaaggccgctattctagcgattgcgcagaaaaactgcagtattcctgatgccttattcgcggtgctggctctggcaacaccccttattcgcgtaaggtttttaccaccgctgtttgatcgtataaggcaaactcgagcagttaacaggaaattaacgcgattatctttctgcccagcgcctattaattaactcgtttgcatcgctttgccacaaacattcaatgtaattcacacaaataccgtcttaaatgtttacttggcgaaattgcctgactattattgggccactcaccctgccaatcagcgttctacataaggtagtccacatgtcactgatcaacgaataccgcgccaccgaagaagccatcaaagagctgcaagctcgtttgaagaacctgtcccaagacgacaagctgcaaaccgagctggaattcgaaggcaaattgcgcaccctgatgggtgaatactccaaatccctgcgtgacatcatcgcgctgctggatccagagtcgaaagttaaagcaccacgcggcgctgtgaaaactaccggcaccaagcgtgctcgcaaggtcaagcagtacaaaaacccgcacaacggtgaagtgattgaaaccaaaggtggcaaccacaagactctgaaagagtggaaagccaagtggggcggtgatgtggttgaaggttgggctaccctgctgggctaagcctggtcagaccttcggccgatacgcaacacattaaaaacgccagcttgctggcgttttttattgtcaggatattctgtagttatccacctacagattcagtcgagcggctaaagagtcggcatagtcctgccattgctcgagtaccccacactgaaacgatgtagcactaactgccaactcctcacgcgcctgcttaaatgccagcaaggtattcggtgctccccactgcggatccgacaagcgttgctgacagaaaagtttccagcgctgttgctcctcattgttcaaggtttcaggaaagttacgtgcacggtagcgaaataataattccggcaaacgatgatcatcgaacggccactgctggcgcgctaactgcgcgggctctgccatccgaacttgttcacataaacgccggtcacggtcgccaataaagccatcgtagagctgctgctccgggtcttggttcaccgcaaagtcttcctcggcgtaaatggccgccaacttgtcacgccaaactgcttgtgcgtcagttagccgcagcgcccgtgcctgaaaagtatccatatccaattgcagacgctcgcgatcttgcgggcgcagcaccttcaacggcgcgaccaccgggcagcggttgatatgcaacaacttgagaggcaccggcagttcaccttcggccaactcaccacggcgcgtgtaaaggcgctcgcgcagggtctcggcgtccagatccagcaacccctgtgggtcgagccccaggtcgcagacaatcaaggcattgcgattgcgcgggtgccaggccaggggcaacaccacccccaggtaatggcgctcggcagaaaagcgcccggagatatgcaccatgggttgcagcaaccgcacctgatccatgacccgctgcttgctgcgcagttgaaacaaccattcatacaacttgggctgtttctcccggaccaaccgcgccagggcgatagtcgctcgcacatcagataacgcatcgtgggcctggccatgctcgataccgtttgcttcggtcaaccgctcgagcttgagcgtcacgcgcccgtcttgctctggccaggtaatgccctcgggccgcagtgcataggccgtacgcatcacatcgatcaagtcccagcggctgttgccgccctgccattcccgcgcataaggatcgaaaaagttgcgatacaagctgtagcgcgtcatttcatcgtcaaatcgcagggtattgtagccggcgccgcaggtgcctggcgccgccagctcggcgtgcacccgggtcatgaagtcggcttcggcaaggcccttctgcgcaagaacacccggggtaatccccgtgatcgcgcacgcagccgggtggggcaggatatcgtcgctgggctggcaataaaggttgatcggcgcaccgacctcgttgaggtccaggtcagtgcggataccggctacctgaagcgggcgatcattacgcgggttgataccggtggtttcatagtcgtaccagaaaatcgaggtcacgggctattcctgtgctgaagaccgacaaagtctaggcgctgcaaggcgctcggggccagcgatacctttactgtataaatacccagtaaaaccttgaagggttgcttccaccgtcgacactgctagcatccgtgtctcttagtcgtaatgcaaaggaccgcaatggcatcaacacccctggatacccactaccagatcgagacgccggaaggtatcgacctgcccttgcgtcctgccggcctgccgcctcgggcattggcctttgctttcgacttgggtgtacgtgggatcatcatgggtatcctgctggtgcccctggcgctgcttggcaacattggcgtcgggctaggctcgctgctgctgtttgtggtgagctggtggtacatggtgctgttcgaagtgctcaaccagggttgctccccgggcaaacaggtgatgggcctgcgggtggtacaggacgacggcacgcccattggctggtcggggtcgttgatccgcaaccttttacgctttgtcgacatgctgcccttcggttacttcctcggtgcgatcagttgcctgcaacacccgcatttcaagcggcttggcgacctggccgcgggcacgctggtggtctaccgcgaactgccgctgttacgcccgcgaatccctcaagcctccgcgctgcgcctgcccttcgcactgcaacttagcgaacagcgggccatcctcggtttcgccgagcgccaggccgagctctctgccgaacgggtgcatgagctggccgcgatcctcgccgagcccctgcaagtacccccggcccgcgccgtggagcaactcaacggtgtggcccgtggcttgttggggccgacatgaagcagagcctttttgaaagccgccaccagccacaatggcaagccttcgccgaacagctcaagcaactggagcaaggcaaagccaaggccgccgatgtcgcgggcttcccccatcaataccggcgcctgtgccagcacctggccctggcccaggagcgcggctacagcagctacctggtagacccgctgcaacaactggcgctgcgcggccaccaacaactgtaccgccatcgcagccagctgccggcaaacgtgctggcgttcatcctcgccgacttcccacgcctggtacgccagcagtggcgcttcgtgctgatcgccggcctgctgttctttggcagcctggtggggatagcgctgctggtctacctgtttcccgaccttatctacagcatcgtcagcccccaacaagtagctgagatgcagggcatgtacgacccccaggccagccgcctgggccgggccgccgagcgggccgccagcgaagactggatgatgtttggctactacgtgatgcacaacatcggcatcgccttccagacgtttgcggccggcctgctgttcggtctgggcagcgtgttcttcctgattttcaacggcttggtcatcggcgcggtctccgggcaccttacggatattggctatggccagaccttttggtcatttgccattggccatggcgcattcgagctcaccgccatcaccctggccggtgccgcgggcctgcaattgggctggtcactggtcgcgccggggcgattggcacgcggcgaggccctacgcctggcggcccgtaaaagtgtgcgaatgctctgcggtgtcatgatgctcctgctcatcgctgcgtttatcgaagcctactggtcctccaccaccagcattgccccctggatcaaatatctggtgggcgccgcgctctggctgctggtggccgcctacctgatattcgccgggcggactcatcatgcgcctgactgactccagtgtgatgattcgcccgcgtaccgcctgggaagccatggacctgggtgtgttgatggccaggcaacaccgcctcttgctgatgggcagttgggcactggtaagcctgccggtatttatggtgctcactgtgctgctgtggcgttacccgtcgctggcgatgttcctgttctggtggctcaagccggcctttgaccgcttgccgctgtacatcctgtccaaggccctgtttggcgaaacacccagcctcaaacaggccgttcgccattggccgcacctgctgaaggggcaattgttcgccagcctgacctggcggcgactgagcctgagtcgcagctttaccctgccggtgagccaacttgaaggcctcgatggtcatgggcgccaacagcgcctgggggtattactgcaacgcaatgccggggccgcacgctggctgacgatcatcggcgtacacctggaaatcggcctgtggttcggcgccatggccctgttctatctgttcattccgcaaaacgtggaactggactgggattggcaacggatggccttggcaacgggctcggacgtgctatggctggaacacctgggcaacgcgttctatgccatggtgctggtgttctgggaacccatctacgtcgcctgcggtttcagcctgtacctcaatcggcgtacggtcctggaggcctgggacctggagttggtattccgacgcttgcgccagcgcctgagcagtgttgcgccagcattgttgctggtcgtgggcctgacactgctacagctcagcccatctgccatggcgcaggaaccgcctggtcccaaatcgcttagtacccaggccgccagccaatccatcaaagcggtgttggaaaagccaccgttcaagaacccggaaaccgtcacccgctaccggtttggcgaagaaaaggcgccggttggaaaccaaggccatggcgatggcaaactaccccgctggctccaggccttgctcgacaacctcaacagcgatgccttcaagcacgtcgctaaagccttggaaatactgctatggagcctggtgattggcgggctggccctagtggtgtggcgttaccgcgaatggttgcgcacctttgtcagtcgcagccgacggcttcgcccgaaaacggccagtgccatgcccacccagctgttcggcttggaattgggcaccgacacattgcccgatgaccttgccggcgccgccgaacagctatggcccgcccagccacgggaagccctcggcctgctgtatcgcggcctgctcagccggctattgcacgaatacaacctgccgctgaaaagcgccgacactgaaggccaggtgctggagcacgtgcatcgcttgcagcagccgcagttactggcattcagtgacgaactgacacggcactggcaaaacctcgcctatggccatcgcctgcctccctcctctgcccagcagaagctgtgcgacgactggcgtgcactgttcagcgacggagcgagccaatgaaccgcccgctggtgtgggtggcgctgctgctggcgtgcctgctgggcatgggcggcgtgtatgcctggcacaaggcaattccctacgacgaagtggtggatcgcggcccatcgccggttgcacgggccaacccctatctggctgccgagcatttcctgcacgagcaaggcctcacggtggagcatgccaacggtcttgaacaccttgccgacctgcccgccaaaggccatagcctgttgctgctgggggaacgcagcaacatgactccacgccaggtcgagcaactgctgcagtgggccaaagccgggggccacctgctgctggtcgccgaggccttgtgggacgaagaaaccggcaaaagtggcgatctgttgcttgatcgcctcaatatccgccaaaccttgagcgaaaccttcgatgaaccgccacggcctcgtaaaaagccggcaccggacctgaccaaactctacgtcgacaatgaaaccgcccctgcgtatttcagttttgacaccgacttcaacctcatcgaccccaggcacctggcacagttctctgccaacagcgcgcagtccagccacctgatgcagctgaacctggggcaaggccgtgtcacggtgatgaccgatagcgacctgtggaaaacccctggcatcggcaaccacgataacgcctggctgctctggtacctgaaccagggcacccaggtaaccttgttgttcaacagtgacgtggacgatctgtttaccctgttgctgcgttttttcccccaggccctcgtcgctctcgcagcattggttgccctggcgctgtggcacgctggcatgcgccacggcccggtccaggcaccagcgcccaaggctcgtcggcaattacaggaacacttgaaggccagtgccgatttcctgctacgccgcagcggccagggcaccttgctgcaagccttgcaactcgacctcctgcgcgccgcccggcgacgccacccaggctttgaacacctcgacagcgcagagcaacggcaggtgctggaacacttgacacggcaaccttcccatatcatcagccaggcgcttgaaccacttgcgctgaaacggctctccagtgccgatttcagccgacaggtagcgtgcctgcaaaccctcaggaatgccctatgagcgactttccaatggccacccccctgaccgccgacaaccttggacatgccagccagcaggcccaggccctgcgtgtggaattacgcaaggccgtgataggccaggaccaggtgattgacgacgtgctcaccgccttgatcgcaggtggtcacgtcctgctcgaaggcgtgccaggcctgggcaagaccttgctggtacgtgccctggcccgttgctttggcggtgatttcgcacgtatccagttcaccccggacctgatgcccagcgatgtcaccggccatgcggtgtacgacctgcagaccgaacagttcaagctgcgcaaggggccgctgttcacccacctgttgctggccgatgaaatcaaccgtgccccggccaagacccaggcggcactgctcgaagccatgcaggagcgccaggttaccctggagggcgaggcgttgcccatcggccagcccttcatggtgctggcgacccagaaccccatcgagcaggaaggcacctacccgctgcccgaggccgagctggaccggtttatgctcaaggtgcgcatgggctaccccgacgcccggcaggaactggagatggtccgcgaagtgacccgctcgtccagggccgacatgctggatgtacagccgttgcgcaccgtgctgcaagccgaggacgtggtgctgatgcaggaaattgccagcgcactgcccctggatgaacaggtactcgactacgcggtgcggctggcgcgggccacacgcagttggccggggctgaccatcggcgccggtcccagggcctccatcgccctggtacgcggcgcccgcgcccgggcgctattgcgcggtggcgagttcgtgacgcccgatgacatcaagggctgtgcgctggcagtgctgcgtcaccgggtgcgcattgcgccggaactggacatcgacggcctggaagttgaccaggtgctccagcagctacttgaccagattgctgcaccaaggcaatgacgcagccatgaagccgacccgtctgttgctgatctggctgggtgtgctacttggcctgaacaccctgttgggcgcttcgatggcgctgcaggtcaagctacctcaaaccttgcattccatcgcttggggcctgcttctggccctgctgctattggcgacgctggatgcggcacgcttgcaccgccggccctcggcgcgcgtaaccaggaaactgcccggcagcctggcgctggggcgctgggaagaggtgcgcctgtgcctggagcatgactatcctcaaccactgaccgtaggggtgttcgaccacgtgcctgacggcctgagtgtggataaccagccccaatccatccaactgcgccccggcgaacgtgctgagctgggctatcgcgttcgccccttgcgccgcgggcatttcagcttcagtcgctgcgaactgctgctgcccagcccattggggctgtggtcggcgcgcagactcgtcgaaacccatgatgccacccgggtttacccggatttcgcccgtttatacggcgcgcagttgctgggtgtggataactggctgagccaactgggcgtgcgccaacatcagcggcgagggttgggcctggaatttcatcaactgcgcgagtttcgtgaaggtgacagcctgcgccagatcgactggaaggccaccgctcgccaacgcacgccgattgcccgtgaataccaggatgagcgcgaccagcaaatcgtgttcatgctcgattgcggccagcgcatgcgtagccaggatgatgaactgtcccatttcgaccacgccctcaacgcctgcctgctgctcagttatgtcgccttgcgccagggcgatgccgtagggatgtgcaccttcgccagcgaccagccgcgctacctcaagccggtcaagggcagtggccaattgaacagcttgctcaatgcggtctacgacctggacaccacccgtagaaccgctgactaccaggctgccgccagccaattactggcgcgtcaaaagcgccgggcactggtgatcatcgtcaccaacctgcgagatgaggatgatgaagcgctgatgaccgccgccaaacgtattggccggcaacatcgggtacttgtggcaagcctgcgagaggaaatccttgaccagttacgccaagcccccttgcagaccttgcccgaagccctggcttacagtggcacggttgattacctcgacacccgcaatcaactccatgatcgtttgaccgcccatgggcttgcagtattggatacgttgccgtcggaactgggcgccacactggtgacgcgctacctggggtggaaaaaagccggtgcgttctaaattgcctgcattcagacggaggcctgctggggatcaaagctgaagtactgcaccagcgcgttgatcaattgcccatacgcttcgggtggctgatgcaccgtgaacccggaatcgtaatgctgcgggttgacatcttcatggctccacaagcaggtcgccgtcagatcaatcgtctggaattcaccttgagccaccggaattttcaagcacagctgaaaatccacatcgaccatcatgggtaattggctgatcagcatcagcccattttcagacacattgcccaagaacccaatcggcttgtcggtaacacgattgaacacctgcaaaaaataaggcagttgatgccgttcgatccgtcgctcggtaaacatgatgaagtcgccatccaatggccaagagtctggccgtgccagtgattcggaacgagcagtcgctcgctctccctggatctcggtgtgacaacggtaccgtttgtcaccagacagctgccgaatccaggccctgcatccgttcgaatagaaacttgtacaaacgaacattcaaagaatagcccaggactggcgacgggccagctctaaaatgacaaatttcattacaaagatgcaggccgtggttttacggcggctgcactcgggaaatgccccagttgctgcaaggtatcgagccgcgcacgggcgcgataggcgtactcacttgaagggtattggctgatgatgaactgataggtttgcgcggcatcaacaaacagtttctgtcgctccaggcactgcccgcgcagcatcgaaacctccggttgcacataacgacgggtacggctttcgcgatccacctgggacaactccagggtgacgcgcgcgcaatcgcccaccccataggcacggtaagcgttgttcaaatggtggtccatcgaccagcgagtacagccgacaacactgacggccagggcagcaacgagcaaaattcgcatgggggttctcctgtcttgtgcagtgtatcgacccctggtcgaaaatcttcaaggatgtttgcccagtcaagcgcagcaaaaacaagccaatcgtcgataagtagtgcaaacgaacaatgactacaacgaaagagcatagtagccttctccagcgcttgaactcaggagtctgtgcatgtccgtccgtcgcaccaaaatcgtcgccacccttggcccggccagcaactcgccggaagtcctcgaacagctgattctggctggtttggacgtcgcccgtctgaacttctcccacggcaccccggacgagcacaaggctcgcgccaagctggtgcgtgacctggccgccaagcatggccgcttcgtcgcactgctgggagacctgcaaggcccgaaaatccgtatcgccaaatttgccaacaagcggatcgagctgaagattggtgacaaattcaccttctccaccagccacccgttgaccgaaggcacccaggacgtcgtgggtatcgactacccggacctggtcaaggattgcggcgtcggtgacgaactgctgctggacgatggccgcgtggtcatgcgcgtcgacaccgcgaccccgaccgagctgcactgcaccgtgatcatcggcggcccgctgtccgaccacaaaggtatcaaccgtcgcggcggtggcctgacggcgccagccctgactgaaaaagacaaggccgacatcaaactcgctgccgaaatggaagtcgactacctcgctgtgtccttcccacgcgacgccgccgacatggaatacgcccgtaaactgcgcgacgaagccggcggcaccgcctggctggtggcgaagatcgaacgcgccgaagccgtggccgacgacgaaaccctcgacggcctgatcaaggcctccgacgccgtgatggttgcccgtggcgacctgggtgtggaaattggtgacgccgaactgatcggtatccagaagaagatcatcctgcacgcacgccgccacaacaaggccgtgatcgttgcgacccagatgatggagtcgatgatccagaacccgatgccgacccgtgccgaagtgtccgacgtggccaacgccgtgctcgactacaccgacgccgtgatgctctcggctgaaagtgccgccggcccgtacccgctcgaagccgtgcaggccatggcgcgcatctgcgtcggcgctgaaaagcatccgaccagcaagacctccagccaccgcatcggcaaggtcttcgaaagctgcgaccagagcatcgccctggccgccatgtacaccgccaaccacttcccgggcgtgaaggcgatcattgccctgaccgaaagtggctatacgcctttgatcatgtcgcgcatccgttcctcggtgccgatctacgcgtttacccctcaccgcgaagcccaggcccgtgcggcgttgttccgtggtgtgtacaccatcccgttcgacccggcttcgctggcaccgaacgaagtcagccagaaggctatcgacgagctggtcaagcgcggcgtggtagagaaaggcgactgggtcatcctcaccaagggcgacagctaccacaccaccggtggcaccaatggcatgaagatcctgcacgtgggcgacccgcaggtctgattgacacgctgcaaacaaaagccccgttatgcgaatgacggggctttttgcatttcaggcacaccgagcctgggcggggtgccgagtggtggggcccacattggaatgcggtcaactgtgggagccgggcttgcccgcgatggcgccagaacagccaacaccgttttatcgccgggtgataaaccccgacaacgccgcaatcgcctccggcgatctcaagcgctgggtaaacaacgccccctcctcctcgattacctgccgcaactgctcgcgatcaacgcttttcatcaactgcttggtgacctgcaccgcccccggcgccaggctttcaaaacgttcggccatttcccgtgccttggccaaggccgcctcgccactgcccaacgcctcggtggcaatcccccacgctgcggcttgttcgccagtgaacccctcgcccaacaacagtagttcagccgccttcgcatgccccagcaaccgcggcaggatcaggctcgagccaaactccggacacaaacccaggttaacgaacggcatgcgcaagcgtgcatcgcggctgatatacaccaggtcgcaatgcagcaacagcgtggtgccaatgcccaccgccgctccagccacggcggcgatcaccggtttgcggcagttgagcaggcttttcataaagtgaaacggtgggctgtcgaggtcgttgggtggctgttcgagaaaatcgctgatgtcattgccggcggtaaaacactcgctgctgccctgtagcagtacggcgcgaatatccgagtttgcatcggcctgttccagcgcctcggccagttgcgtatacatggcacgggtcagggcgtttttcttgtcagggcgattgagctgcaaggtcagcaacccgcgttcgcgttgctgcaggatggcgtcggtcatggcgaatctcgcggcaaaaggtttcagcgctcaaccacggggcaggaacacatcggccagcagttgattgcgcggcagcccggccaggaacaggcgcttggaaaaagcctcgacgctgacagggtgaccgcagagtaaagccagcgtttgccgcgaaacaagccgcagttgcgccaatgcctggttcaactctgccgccgtccatagctccaccgtcaggttcccatgctgcgtggccagcgccgccaggggttcggccaggtaatgagcctcggcatcatgggccaggtgaatgacacggatggcaccttgatgatcctggcgcagcgcttcgcgcaatatgccccacaacgggcccaggccggtgccggcggccagcagccacaacggccgcgattgccagtcagggtcatagtgcagcgccccgccccgcaactcgcccaggcgcagaggctcaccaaccttgaaatggcgagcggcatcgctgaattcaccgggttgacggcaatcaatatgaaactccaggtatgcatcctcctggggcaagctcgccagggaatacgggcgcgccacctgccctgcccacaacaccagatgctgcccggcccgataccgcaggctacgctccggtagcaggcgcaggcaaagcaccgtggaactcagccaatcagcgcccaccacctgggccgccacgccgtcatgcagcggatcaaatgcttcgacctggaggtcgccgacgacccggcactgacacgccaggcgccaaccctgctgacgttgcgtcgggctcagggcttcgggctgctggtcatcgacctcgccctggcaacgcaccaggcacgcatggcagctgccggcccggcaactgtacggcacggcgactcccgcctggttcaaggcatccagcaggttagtgccggtgggcaccgaccaatggcgttcgccgacgtgcagttcaggcatatggaggctcaatcaataggtttgcgcacagggaatcacgcccggcagagtttgaccatagtcgggtgtatcggccaccgcgccgggttatactgccgcgcctttttagcgtcgcgcctgcaccactttggcgtgccttggaaagatggtttcagccgaccgacgcaatactgaagccacctttattgaatgttcccttatagaggagcgcgactcatgaccgtgatcaagcaagacgacctgattcagagcgttgccgacgccctgcaattcatttcctattaccaccccgttgacttcatccaggccatgcacgaagcctacctgcgcgaagaatcgccggcagcccgtgactccatcgcccagatcctgatcaactcgcgcatgtgcgccaccggccaccgcccgatctgccaggataccggtatcgtcaccgtgttcgtgcgcgtaggcatggatgtacgctgggacggcgccaccatgggcctggacgacatgatcaacgaaggcgtgcgtcgcgcctacaacctgccggaaaacgtcctgcgtgcatccatcctcgccgatccggcgggcgcgcggaaaaacaccaaggacaacaccccggcggtgatccactactccatcgtcccgggtaacaccgtggaagtggacgtggcggccaagggcggtggttccgagaacaagtcgaaaatggccatgctcaacccgtccgactccatcgtcgactgggtgctcaagaccgttccaaccatgggcgccggctggtgcccaccgggcatgctcggcatcggcatcggcggcaccgccgagaaagccgcggtgatggccaaggaagtgttgatggaatccatcgacatccacgagctgaaaaagcgcggcccgcagaaccgtatcgaagagatgcgcctggagctgttcgagaaggtcaaccaactgggcatcggcgcccagggcctgggtggcctgaccaccgtgctcgacgtgaagatcatggactacccgacccacgccgcgtccctgccggtgtgcatgatccccaactgcgccgccacccgtcatgcgcacttcgtgctcgacggttccggcccggcgtcgctggaagcgccatcgctggacgcctacccggaaatcgtctgggaagccggcccgtcggcccgccgcgtcaacctcgacaccctgaccccggaagaagtgcaaagctggaagccgggcgaaaccgtgttgctcaacggcaagatgctcaccggtcgcgacgccgcgcacaagcgcatggtcgagatgctcaacaagggcgagaccctgccggtggacctcaagggccgctttatctactacgtcggcccggttgatccggtgcgcgaagaagtggttggcccggctggcccgaccaccgcgacgcggatggacaagttcacccgccagatcctcgagcagactggcctgctgggcatgatcggcaaatccgagcgcggtccgaccgccatcgaagcgatcaaggaccacaaggccgtgtacctgatggccgtgggcggcgccgcttacctggtggcgcaagccatcaagaagtcgcgcgtggtagcgttcgccgaactgggcatggaagccatctacgagttcgacgtaaaagacatgccggtcaccgttgcagtggacagtcagggcgagtcggtacacatcaccggtcctgccatctggcagaaaaagatcagtgagagcctggcggtagaagtacagtaagtcgatgtgggaggggcttgccccctcccacacaagttccagacagctcatggtatggtgctcgcccttaccgtgcctgttcatcatcgtatgatcgtgatccctcgccccctgcgcctgaccttttactcgttattgatcatcgccggtgcggtgctggccgctgccttggccacacgccatgccgaacgccaggccctggtggatgacgccgctcgcgccaatcagcagcttgcgctgtatgccaactccctgcacaccctgatcgaacgctaccgcgccctgcccgccgtgctggccctggactcggaaatgatccgcgccttgaagggcccgctggatagcaccacccaggacgtgctcaatcgcaagctcgaacgcatcaacggcgccgcccaatcatccaccttggagctgatggaccgcagcggcctggcggtggccgccagcaactggaatttgcccagcagctatgtcggccacaactacgcatttcgcccgtatttcagccagaccctgagccaaggcaccgggcgtttttacgcggtgggggtgactactggcattccgggttacttcctttccagcgcggtggtcgatgagcacgagcagttcctcggcgccatggtggtcaagctggaattccctgagcttgaacgcgaatgggcccagggtaatgacttgctgttggtcagcgatgcgcggggcattgtgtttatcgccaaccagccgggctggcgttatcgcaacctgcgaccgttgtccgaaactgacctggctgaactcaaggccacccgccaatacgacaagaaacacctgcagccgctggagaccagcgtcttgcagcgcttcgacgacaacagccatttgatgcgcgtcaatggccccgacggtaatgccaactacatctgggagtccctgccgctcaaggcagaaggctggagcctgcacctgctgcgcaaacctcagttcccgtttgaagaccaacgcaacgctggcctagccgccgcgggttcctggctggcgctggtattcctggtgctgtttctcagccaacgctggcgcctggcccgcttgcgtcagcgcagccgcgaagagctggaacagttggtcgaggaacgcacccaggcgctgcgcaccgcccaggatggcctggtgcagtcggccaagctggcggcgctggggcagatgtccgccgccctcgcccatgaaatcaaccaaccgttgacggcccaacgcatgcaactggcaacactgcggctgttgctcgaccacggccgcgtcgacgatgcctacaaggcactcacgccgctggatgacatgctcacgcgcatggccgcgctcaccgggcacctcaagaccttcgcccgcaagagccccagcggcctgcgtgaacgcctggacctggccaccgtggtcgatcagtccctgcacttgctcgacgcgcgcctgcgtgatgaagccatcggcgtcgtgctcgacctgacgcgcccggcctgggtacgcggcgacgcgatccgcctggaacaggtattgatcaacctgctgcgcaacgcgctggacgccatggccgacaagccgcgcaagcgcctggaaatccgcctgcatgccgatcagcagctgtggcagttgacggtcagcgacagcggcggcgggatcgccgaagaacacctgaacaacgtgttcgatccgttcttcaccaccaagccggtcggcgacggcctcggcttggggctggcggtgtcctacgctatcgtgcatgaattgggcgggcgcctgagcgccggcaaccgtggcgacggcgcagtgtttaccctgaccttgccgattgcattggagacgccagcgccatgttgaacgctgtaattgtggtcgatgacgaagccagcattcgcaccgccgtcgagcaatggctgagcctttcggggtttgaggtgcaattgttcagtcgcgccgaagaatgcctggcgcatctgcccaaagactttcccggtgtgattttgagcgatgtacgcatgcccgggctcggcggccttgagctgctggccgaggtaaagcgtcgcgatgccgacctgccggtgattttgctcaccggccatggtgacgtgccgatggccgtcgaagccatgcgcgacggtgcctacgatttcctggagaaaccctttagccccgaggcactgctcaacagcctgcgccgggcattggacaagcgtggcctgatcctggaaaaccgccgcctgcatcaacaggccgatcaccgcgcacaactggagtccagcctgctgggggtgtcgcgcagcttgcagaacctgcgccgccaggtgctggacctggcgaccctgccggtcaacgtgttgatccgtggcgagaccggcagtggcaaggaattggttgctcgctgcctgcatgacttcggccccagggcgaaaaagccgtttgtagcactcaactgtgccgccatccccgagcagctgtttgaagccgagttgttcggccacgaaagcggcgcctttaccggcgcccagggcaaacgcatcggcaagctggaatacgcccatggcggcacgttgttcctggatgagatcgaaagcatgcccctggcccaacaggtgaaattgctgcgggtgttgcaggaacagaagctggagcggctgggttccaaccaaagcatccacgtggatctgcgcatcatcgccgccaccaagcctgacctgctggaagaggcccgcgccgggcgttttcgtgaagacctggcctatcgcctgaacgtcgcgcaactgcgcctgccgccgttgcgcgagcgccgcgaagatattccgttgctgtacgaccatttcgcgcagagtgctgctgaacgtctgggtcgtcatgtcgagcccttgagtgggccacagctggggcgcctgctcagtcatgactggccggggaacgtgcgtgagctggccaacgtcgccgagcgccaggtgttggggctcggcgatacggaaccggacggcatcgaggccgggcaatcgttggcggcgcaacaggaagcgttcgaggcacattgcctgaaagctgcattaactcggcataaaggcgatatcaaggcagtgctggccgagctgcaactgccgcgccggaccctcaatgaaaagatgcagcggcatgggttggcgagggagatgtttctctagcgaccttccgatcgccatcagggcttgccccagatggcgccagcaaccataagcggatttccgcttaccagccgaaaatcatcggcaactttccgctcaaaaaaatcctgcaacccttctattccgggccttcatctacctggcacagctcctgctatagcccgaaccaggcagtgctcaagcacgctccataaaaacaactagatgaaggatccttcaatggataactccaataccttgcctctggggtcggcggctgcgccggcaaaagaacgcaccacttccagtcgaatcaaatcgatcttcagcgggtcggtgggcaacatggtcgagtggtacgactggtacgtctacgccgccttctcgctgtacttcgccaagaccttcttccccaagggcgacaccaccgcccaattgctcaacaccgccgcgatcttcgccgtgggcttcctgatgcgcccgatcggtggctggctgatgggcctgtatgccgacaaagtcggacgtaaaaaagccctgatggcctcggtctacctgatgtgcttcggctccctgctgattgccctgagcccaagctatgaagtcattggtatcggcgcgccgatcctgctggtgtttgcccgtttgctgcagggcctgtcggtcggtggcgaatacggcacctctgccacttacctcagtgaaatggcgaccaaggaacgccgtggcttctactccagcttccagtacgtgaccctgatctccggccagctcatcgcgctggcggtgctgatcgtgctgcaacaactgctgaccaccgagcagctgtatgcctggggctggcgtatcccgttcgccatcggcgccttgtgtgcagtggtcgcgctgtacctgcgtcgtggtatggaagaaaccgagtcgttcaccaagaaggaaaaagccaaggaaagcgccatgcgcaccttgatgcgccaccccaaggaactgatgaccgtggtcggcctgaccatgggcggcaccctggcgttctacacctacaccacctacatgcagaaatacctggtgaacacggtcggcatgagcatctccgactccaccaccatctcggcggccacgctgttcctgttcatgtgcctgcaacccctggtcggcgggctgtcggacaagattggccggcggccgatcctgatcgccttcggtgtcctcggtaccctgttcaccgtgccgatcctcaccaccctgcacaccatccagtcctggtggggtgcgttcttcctgatcatggcggcgctgatcatcgtcagcggctacacatcgatcaacgccgtggtgaaagccgaactgttccccaccgaaatccgcgccctgggcgtgggcctgccgtatgccctgaccgtgtcgatcttcggcggtaccgctgaatacatcgcgctgtggttcaagagcatcggcatggaaactggctactactggtacgtgaccgcgtgtatcgcagtgtcgctgatggtctacgtgaccatgaaagacacgcgcaaacattcgcggattaccacggactaaaaaatgtgggaggggcaagccccctcccatattggatatgatgtgggctttagaactgagagcagaacaggtcatgtccgacgatatccacttctacgaacccgccaacggccacggcctgccccatgatccgttcaacgcgattgtcggcccgcggccgattggctggatttcgtcacacgaccgcgaaggtcgcctgaacctggcgccctacagtttcttcaatgcgttcaactacattccgccgatcattggtttttccagtgtcgggcgcaaagacagcctgaacaacatcgaacagaccggcgagttcgtatggaacctggccacccgcccgctggccgagcagatgaaccagagctgcgcggcggtctcgcctgaggtgaatgaattcgaactctccggcttgacgccggtggcttcgaaaatcgttggcgtaccacgggtgggcgagagcccggtgtcgttcgagtgcaaggtgacgcagatcctccagctgcaacgtgccgaccaacagttggtgccaagctggctggtgctgggcgaggtggttgcggtgcacatcgccaaatggttgctcaaggacgggatttacgacaccgctgccgccgagccgattttgcgtgggggtggcccggcggattatttccagctggggcctgaggccctgttcaaaatgcacagacctcaataacccctgtaggagcgagcttgctcgcgaagatcgtcaacgataacgcggggcaccaggctgaacgcggtgctcttgagtttttcgcgagcaagctcgctcctacagtgcggcgggggcccaggtcagttggccttctgcatccacatcgaccagacgctcaagttgcaacgtcgccgcatcatcggcatcggacgccgtcttgaacgtctgcccttcaaggatcttgtggaactgcggggcgcccatgccatccagtgccttgacggcgacggcggcgctgtagccaccttctcccggtactacggcggaaacggcttcgtggtgggcaaattgtctacgtgccatgttgcaggtcctggccaatggaaagtcgaccattgtaaccctcaaccggccagttgcaggtactcgccgtaggcatgggcggcagatgcatcggtgaaggtctggaagtccatgctgcggatcaccatgtcattcaacagctcggtgaggatcatcagggccggagagttgaagtaggcgctcatggcctgctcgctgctccagaaccccgagaccagccagacatcggggtcgacctgggaatgctgcaacgagaattgcaggcaaccctcggcctggcgtcctggttcgatcaaactgctcaagcgtgcaccgagttcggtgctgcacccgctacgggcgcggataaaggccatatggctcgcgggaatgggggtggacatgttcgactctcccgttgagaagtgatgctcggcaagcactgtgggggcgtgttgccacaggatcaaagataacggcgcgggtgtgggcgcggttagtcgattcctgcaggcttattgcacaatcctgcgaaaagcgtagataggacgttcggccccaggatttattccacgcgcctgcccagtgtttcagggagatgacaggcctggcgcttgcctgattcacgacagatcgcaggatcaggcaaggatcaggcagaatcgacgtaacactatttgaaaagccgccgctaagctgagcccatcaaagcagcgtgtagaggacgccccatgccgtcgcccgatccaaagtccactcccctcgatgccgagatggaaaagcaacgcgccgagttggccagtatcgtgcaccgccatacgtgggaagacggctcctatggcaccgcgattacctcgctgtacctgaaccgccacaatacaccgcgggatttcatgccggtgctggtggaacctgcgctgtgcatcctggccagcggcaacaaggaagtgcgcctggccgacgaaattttcgcctacgacccgctcaactacctggtcttctcggtggcgatgccggtggccgggcggattatcgatgccaccgccgagaaccctaacctctcggtgcgtatcaacatcgacccgacgcaactgacggcgctgatcgcggaggccgggcccatgggcgtgccctcacgcccgtcgacccggggaatgtacgtcgaccgcatcgaccaccaattgctcgacgccgtgctgcgtctgacccggctgctggatacgcccaaagatatcgccatgctcgcgccgttgatcaaccgtgaaatcctctaccgcttgctgcgtggcccacagggttatcgcctgtatgaaatcgccgtggccaacagccagagccatcgggtcagccaggcgatcaaatggttgaacggcaactatgaacaaccgctgcgcatcgacgacctggccaaggaagtgaacctgagcgtctcgaccttgcatcatcgctttaaggcgatcaccgccatgagcccgctgcagtaccagaaacaactgcgtttgcaggaagcccgacgactgatgattgccgaagggttggaagcctcggctgcgggctatcgggtgggatatgaaagcccgtcgcagttcagtcgggaatacagccggttgtttggcgcgccgccgctaagagacctggcccggctgcgccaaagtatctaaacggatggagatcaaaatgtgggagggggcttgctcccacatttaatcagcgtgtgttcaatcaagtccgcggggcagttgcagggtgacgcgaaggccaccttcacgtaaattctgcaaactcacttcccctccatggctatgggcaatattgcgcgcaatccccaaccccaacccatacccctgctgctggcctgccaggcgaaagtgcggttcgaagacttgctccaggcgctgttccggcacccccgggccttcatcatccacatgcagggtgaacagcgcgccatcgtcctcgatatgcaaatgcgcgttctgcccatacttcaaggcgttgtcgatcaggttgccgatgcaacgcttgagcgccagcggcttgcccgggtaggtcgtcagggccgcgccatccagggacacgcgaccgttgccattgggcgccaggtacggctccaccaggcattcgagtacgtggttgaggtccaccggctgaatgttttcgtgaatgtcggtgtctttcacgcattgcagcgcgcctttgaccagcaactccaactcatccaggtcgcggccgaacttggcttgcagattttcgtcttcaagcaattctacccgcagccgcaggcgagtaatcggtgtgcgcaaatcgtgggaaatcgcgctgaacaattggctgcgttcggtcaggtaacggctgatgcgttcgcgcatggcattgaaagcgcggcccacttccaccacttcactgccgccgccttcggccaccggctccacatcagcgcccagggacatgtcccgcgccgcccgcgccaggcgcttgagcggccggctttgccaatgcaccagcaggccgatgaacagcagcaagagaccgctggtcaacacgataaaccaaacctgctgggacggcaggctctgctcctcgaggctggtatagggctcgggcaacagcgaggcgatgtacagccattctccgggggcaagctggatctgggtgaccagtaccggcgggttcaccggttccagagtcaaggcgtaatgcgcccaggaacgcggcagttcgtcgagcttcaagccggcattgaagatacgcagctcctcggcgctgacgaactccaccgagataagcacgttggcgcccagggtctggcgcaacacctcatcgaccgcttccagcaccgcctgtttgcgcggggtctgcggcaacaaggccatgtccagcggacggtcattgagggtcacgacaaaacgcgtaccgcccatgctgcgcaactggtcgagcaccaaaggtcgataggccaccggcaacgaacggaaataactcacgctggcggtcatcgaatgcgccaggctacgggcgctggtgaccaggccctcaagttgggtggcgcgcaactgcgagacccagatcacgctggacaatgcctgggcgaacagcaccaccagcaaggtcagcagcagcatgcgccccagtagggagcgcggtaccggaaagcggcgacggcgttcagccgggtgttcagtgggcattgccggcaaccacgctggctgccagctggtaaccgctgccgcgcacggtgcggatcagccgcgggggtttttcagtatcgcgcaggcgttggcgcaggcggctgacggccatgtcgacgatacggtccaggggcatcaggtcacggccacgagtggcgttgccgatggtgtcgcggtcgaggatctgttgcgggtggtcgagaaataatttgagcaaggcaaagtcggcaccggagaggatcacctcttcaccatcaacgtggaacagccgatggctgatcatatccaggcgccactcgtcgaacaccagcacgtcgctactgctgccgcgttcctggccaaactggcaacgacgcagcagcgccttgatgcgcgcctgtaattctcgggggctgaatggcttgccgatatagtcatcggcgcccagctccagaccgatcacccggtcggcttcgtcggaactggcggtgagcatgatgatcggcacctgcgcctggcgagggtgctggcggatccagcgacaaaggctgaaaccgtcttcgtccggcagcattacatcgaggatgaccaggtcgcacggcgcctcgttcatcgcctggcggaaccccgcgccatccggcacgccacgcacctggaagccggcacgactgaggtaggtttgcagcaattcgcggatttcctggtcgtcgtcgacgaggagaatggatttactgattacgctcacggggtcctccttgttgttatggctgtaggagcgagcttgctcgcgaaaaacctgagggtggcgcgtataacctgatgcgctgcgttatcgttggcgtttttcgcgagcaagctcgctcctacatttgcctgcattccaaagttgaaaccaggtcgaatgtgaaagaggccattatgacctacgcaaaagcctgctcaagcgccacacccgccccggtcaacccggaatacggcgcggtcaccaaccacaccggaatgcccttgaagtagtcgctcatgcagcctttatccgcaaagctcttggcgaaaccgctggcgataaagaagtcggcaaacctcggtattaccccacccacgatgtaaacaccaccgcgcccacccgtggtcagtacgttattgcccgccacccggcccagccagatgctgaactggtccaacacttccatagccaccgggtcaccggccagccccgctgcggtaatagcctcgggactgtccagcaccggagtatgcccgtcgaccgcacagatggcgcggtacagacgcggcaacccaccgccactcaacgcggtttcggcgctgacatgaccaatctcgttgtaaatgtgctgccacagctgggtttcccgcgggctgctcaggggcaggtcgacatgtccgccctcccccggcagcgccgcgaagcggccagcgcccaaatccagcaacgtccccacaccaagacccgtgcccgggccaatcactacggccgggcgcaacggctccggcgtgccttggcagaccacgcggaattcgtcgggtttgaggcgagtcatgcccagggccatggcggagaaatcgttgaccagcagcagttcatccacctgcaacgcttggcaaaacgcagtcttgctcaagcgccaatgattgttggtgaatttaaattcatcaccgctcaccggcccggccaccgacaggcacaccgcgccgatatcgccgacttgcaggccctcttccttgaggtagaccttgatggcctcctcagggctcgagtgatctgcagtggcatgcacgcggatcgaatgcagttcctggtcccgccacaacgcaaagcgggcgttggtacccccgatgtcaccgaccagcgcaagtttcacttaagcgtctccaaggcagaggtaaaggcgctggcgccctgctctgcggagcttgcggccaagcgcatgaatgcaaacagctcgcgaccggcgcccacgttattgcccagcaggcccgtggcaggcgtgcgcgctgcaaaagttgcggcgtctaccttaagctccaaggtgccggtaacgccatccacgcggatgatatcgccatcctgcacccgcgccagcggcccgccgctctgggcttcggggttgacgtgaatcgcggcagggatcttacccgaggcgccggacatacgcccgtctgtcaccagcgcaactttgaaaccacggtcctgcaacacaccgaggaacggcgtcatcttgtgcaattcgggcatgccgttggagcgcgggccctgaaagcgcatcaccgcgacgaagtctttttccaactcgccagccttgaaggcgtcagccaggtcctgttgatcctggaacaccaccgctggcgcttcgacaacctgatgctccggcgccaccgcagaaactttcattacgccacgaccgaggttgccttccatcacgcgcaggccgccttcgggcgagaacgcacgggccaccgggcgcaggatggtttcgtcgaggctttcaatcggcccgtcgcgccagaccagttcgccatcgaccaggaacggttcctggatatagcggctcaggcccttgccggccacggtgttgacgtcttcgtggagcaggccggcttcgagcagttcgcggatcaggaacgacatgccgcccgccgcctggaagtggttgatgtcggccttgccatttggatacacgtgggacagggtcggcaccacctcggaaaggtcggccatgtcctgccaggtcaggatgatgcccgccgacatggcgatggccggcatgtgcagggtgtggttggtggaaccgcccgtggcgttgagggcgacgatggagttgacaatggacttctcgtcaacaatctcgccgatcggcgtgaagttgccattggccttggtcaagcgggtgacctggtgcgcggcctcgcgggtcagggcatcgcgcagcggcgtgtacgggttgacgaacgacgcgcccggcaagtgcaggcccatcacctccatcagcaactggttggtattggcggtgccgtagaaggtgcaggtaccggggctgtggtaggacttcatctccgattccagcagctcttcgcggctggccttgccttcggcatagcgctggcgcacatcggccttctgcttgttggagatacccgacggcattggcccgccgggcacgaagatcatcggcaggtggccgtagcgcagcgcgcccatcatcaggccggggacgatcttatcgcagatccccagcatcagcgcggcgtcgaacatgttgtgggacagcgctaccgccgtggacatggcaatgacttcacggctgagcaggctcagctccatgccgggctcgccctgggtcacgccgtcgcacatggcgggcgtgccgccggcgaactggccgaccgagcccacttcacgtagggctttctttatttgttcagggaaatgttcgtagggctggtgtgccgagagcatgtcgttataagaagaaacaattgccacgttggcggcgttcatcatgcgcaggctgtttttgtcttcggtgccgcaaccagccacgccgtgggcaaagttggcgcattgcagcttgccgcgcatcggaccgtcgctggcggcgccgcgaatgagcgcaaggtaagcctcacgggtggcgcggctgcgggcgataagccgttcggtgacctcaaggacgcggggatgcatgtatagaactccaggctaacggatgtggcgacctgagtgtctatgctgatcaaacgcccacggctcatgggatggcagggggtcgtttggatcatcggaccagttgattcaggtcactcgttgtagattgaacaaaatattgccactaaaaaggcttgttttctatttttatgcgaataatcttgtaattcttacaacaaatcgacgacaggcactttccaatgactctacgtatcgcaatcaatggttttggccgtatcggccgtaatgtcctgcgcgcactgtatacccaaggctatcgccaggatttgcagatcgtcgccatcaatgatctgggcgacagctcgatcaatgcccacctgctcaagtacgacaccgtacacggcactttcgatgcagaggttgcccacgatcaggaaagcctgaccgtcaatggtgaccggattgccgtcagtgccattcgcaaccccgccgacctgccgtgggctgcacacaagatcgacgtggtgttcgaatgcaccggtctgttcaccgaccgcgacaaggctgctgcccatattaccgccggcgcacgcaaggtgatcatctcggcaccggccaagggcgcggatgcgaccgtggtctacggggtaaaccatgacattttgcgtcaatcccaccagatcatctccaacgcctcgtgcaccaccaactgcctggcgccggtggcccaggtgctgcaccgtgagctgggtatcgaaagcggcctgatgaccaccattcacgcctacaccaacgatcagaacctcaccgacgtctaccacaccgacccgtaccgcgcgcgttcggccacccagaacatgatcccgagcaagaccggcgccgccgaagcggtgggcctggtgctgccggaactggcgggcaagctgaccggcatggcggtgcgtgtaccggtgatcaacgtgtctctggtggacctcaccgtgcaattgaagaaagaagccaccgccgatgaggtcaatgccctgctcaaacaggccagccaacattcgaagatcctcggctacaacaccctgccgctggtttccagtgacttcaaccataacccactgtcgtcgatcttcgacgccaaccacaccaaggtcagcggcaagctgctcaaggtgctggcgtggtacgacaacgagtggggcttctccaaccgcatgctggataactgcctggcgctctgcaacgccgagtaaccccacctgtgggagggagcaagccccctcccacagttacattttgtccagagtaggttcagggaaatagccacttgccatttcagttgatgataagcattatcattaactgcaaatcggtctggtatcactgtgagccaatctcgcttcaaccacgtctttctcacccaacgggtgattctgcttcgcactctgcagcgcatggtcaataaccacagcactgccgaagacctgttgcaggaaacctacctgcgcgtgactcgggccctgagcgagcggtcaatcgaccacctcgaaccttttgtctaccagacagcgcgcaacctggcgctggaccacctgcgctcgcgtcggatccaggcccgcacgttgcaggaagatgtgccactggacgtgctgcaaagcgtggccgccccggtcagtacgcccgaagaggccacccaggccgagcaactgctggaacacttgagcgtcagcctcggccaattgaccgcccgccagcaacggattttcatcctcagccgcctgcacggttgcagctaccaggagattgccgatcaattgggcgtgtccttgagcaccgtgcaaaaggaactgaaattgatcatggccatctgtgtaggtgtggccgaacggttggatcagccttaagcttcatccgacagagctatcgatccaagctgtaggagagatgaatagaacgtggcgaagacccgaggaacaccgtgacggacccgaataaactgcccccccatgagctggctcatgaggtgttgcaagacgcggccatggaccaagccctcgattggctgatcgccttgcagtgcccacaacccgggcagcaggccgcgttcgacgcttggctggccgcagacccggcccacgttcatgccttcagcaaggcccaggccgcctggagtggcgcgccagtacacagtgccgccgtggctctcgctgcgccgcgcaagccaagaggttggcgccgggtcaaaccgcattggaaacccctcgctaccgccgccgtgctgctgatcggcctgttcagtttcagcaacctgccggtgcgcctgcaggctgaccacctcaccgtggtcggcgagcgccagcgcctgcaactggacgatggctccaaggtgctgctgaacaccaactcggcgttttccagcagcatcaaggaccaccagcgcatggcccgtctgtaccagggcgaagcgtttttcgaaatcgcccccacccgtggcctgcccctggaaatcgatgccggccccgtacgcgccagcgtgcgcgacacggcgttcgccgtgcgctacctcaatggcgaagcccaggtacaggtgcagcgtggcgatgtcgacttgagcaacaccttcgacgatgtccgcgtgcgcctgagtgccgggcaaagcatccgcatcgggcccaaggggttcggccagccggccaagctggatgccagcaaggacctggcctgggtccagggccgcctggtattcgaaaactgcccgctgagcgaagtgctggccgaactgcggcgctattacccaggctggatcgtcaacaacaacgagcaactggccagcgtcgccgtcaccggcaactatcgcctcgaccagcccctggatgtggtgcgctcactggcccacatcacctcggccaagctgtcggaatacccggcattggtgatcttgaactaaatgagaattatttttactcgatagtacgcggtggtacgtctcgtcttagccaatgcaactgattcctatttggttcagtccgcaactataagattcgtatcccccggagcgctctcgatgtcctctcgtttcaaccgccggtgttcttcgcccgtcttgtccttgctgaccgccgcgatcctgctggctggcgcacctgccatggccgccaccgccgccgagccgatcctgcgcagccatgcaaattacaatttcagcatcgagcagcagccgctcgtgtcggcactcaatgcctttactgcggtaaccggctggcaagttggcttgccggccgagctcggccagggtgtgtcgtcccctggcgtacgcggcccgctgccgccagaaaaagccttggaccggctgttggtggggaccaatctgagctatcgcaaactgggcgataacaacatcgtgctggagaaacgggccgcaggcggcgccctgaacctgcaacaggtgaccatcagcgccacccgtaacgaacaggatgtgaacagcgtaccgagcagcgtcagcgtgcacgatcgcgaggaactggaacgccagaacgtcaacaacatccgcgaactggtgcgctacgagcccggtgtttccgtcggcggcgccggcacccgctcaggcaacgcgggctataacatccgtggtatcgatggtgaccgcatcctcacgcaggtcgacggcgtcgaagtgcccaacaactttttcaacggcccctacgccaagacccgccgcaactacgtcgacccggaaatcgtcaagcgcgtggagatcctgcgcggcccggcctcggccctgtacggcagcagcgccatcggcggcgcggtgagttatttcaccctcgacccggacgacatcatcaagccaggcaaagacgtcggcgcccgcctgaaaaccggctacagctccgccgatgaaagctggctgacctccggcaccttcgccgggcgtatacaggactttgacggcttgctgcatctgagccagcgcaacggccatgaaaccgaatcctacgacggcaacaacgccaccggcctggcccgtaccggcgccaacccggaagatgcgcgcaccaccaacgtactggcaaagctgggctggaactacggggatgacaatcgcctgggcctgacctacgagaagttcaaggatgaccgcgacgtcaacttgaagaacgccgtgggcggcccattcatcggcggtcggggcatgaacctctaccgtgcccgctcgggcaacgacaccattacccgcgagcgcttcggcctggaaaacagcttcgcccttgattcaccgattgccgaccgcatcaagaccagcctcaactaccagatcgccaagaccgaccagaccaccgccgaaatctaccaggctggccgtcgtgtcctacgcacccgcgacaccctttacgaagaaaaacagtgggtcttcgacgcccagctggacaaggctttcagcctcggtgagaccgatcaccaggtgacctacggcaccaccctcaagcagcagaaagtcaccggttcccgcgaaggctcggcctcgtgcctggcggttggcgccggatgcacggccatcggcgcgcccagcccctcagccggtgatagcgtgaaaaaggccagtgacttccccgaccctaccatcaacacctactcgctgttcgcccaggaccagatcacctgggacaaatggaccttcctgcccgccgtgcgttatgactacacccggctcaagcccaagctgacccaggaattcctcagcaccgtcaacccgactggcgagtatgcggtcgatggcaaagataaaacctggcaccgcgtcacgcccaagttcggtctgacctatgccctgaccgatcactacacctggttcggccaatacgccgagggcttccgcaccccgtcggccaaggccttgtacggtcgcttcgaaaacctcaacctgggctacaccgtcgaacccaaccccgacctcaagccggaaaccagcaaaggcatcgaaaccgggattcgcggcaaatttgacgaaggttcctttgatatcgcggtgtactacaacaagtaccgtgactttatcgacgaagacaacgccgtggtcgggggcaccgtggagcagttccaggctgtcaatatcaagcgcgccaccatcaagggcatggaagccaagggccgcctgaacctggacgccttcggcgcgccaaaaggtctgtatacccagggttccattgcctacgcccatggccgcaacgacgataacggcgagccattgaacagcgtcaatccgttcaagggtgtgtttggcctgggctacgaccaggacaactatggcggtctgctgagctggaccctggtgaagaaacaggaccgcgtcgacagcaccaccttccacgcgcccgacggcaacaccgacggcccgttcaagaccccgggcttcggcatcctcgacctgaccgcctactacaaggtcagcgacgacgtgaccatcaacggcggcctctacaacctcaccgacaagaagtactggaactgggatgacgtgcgcagctacgacagcgtcggcgaagccgcggtaaccggcccggccaacctcgaccgcctgacccagcccggtcgcaactttgcgatcaacctgatctgggacatctgacccacccgcctcacctcgccggaatccatcagcggcggggtgaggattttttactgtgccacgtcttcttgttcgtctagttgataacagctctctttaagggcacccaggcgcttaccttctcaaggactttttacatgaccgcttctcctaccgcagaacgcccgagcctgcgctcccagcgcctgaaccagatcaccaatgaaccgcacaccaagctggatgcgttggtgaaggctcatgcgccgttcgaaacacaagccaacttcgcccgcttcgtggtggcccagtacctgttccagtcagaactggtagcgctgtacaacgatgccgaactgatcaagatcgtccccgacctggccgcacgctgccgcgccgaagccgccaagctcgacctcgcggacctggacactgaaatcccggccccggtggccggcgcagtaaagaatccgagtaaagccgaagccctgggctggctgttcgtgtccgaaggctccaagctgggcgccgcgttcctgatcaagcgcgccgtcggcctgggcctgagcgaaaccttcggtgcccgccacctgggcgaaccggccggtggccgcgccgaaggctggaaaagcttcacccgcaccctcgacagcctggagttcagcgccgaagaagaagctgcggtagaaaaaggcgcgatcgatgcgtttgtgcgcttcaccgtgttgctggaacaggcgtacgctagcgcccctgaaatggcctgacctccagattgaaatgcaatcagaaaatgtgggagggggcttgctccctcccacactgagcactcatttcacattgattttttgtgatattcctacctatgaccggcaaaacccaatccacctccaaagtcgcccaagtcctcttcggcctgctggcctacgtcagcctggggatcggcctggtggcgattgtcataccgggtttgccgaccaccgaattcatcctcctcgccgcctgggccgccaccaaaagctcaccgcgcctgagcgcctggctggaaaaccaccgcctgttcgggcctatcctgttcaactggcgcaacggcaagatcattgcgcgccgggccaaggtcagcgccaccgtgagtatgttgctgtgtgccgtgttgatgctggtgatgctggatcatggctggccggtgtacctggccatcgccgggatgagcctgggcaacctgtggatctggtctcgccccgagcagctggcacgctccatatagggctgcatgtaggcgttatcctaccgctcatcgcctattcctcatgaatcgatttgtgacgccgatgtttcaggcatggcgccgaatggacttggctctgctgcccgcattccaacaagtcattcgtgagtgaacctatgttcgacaccctctccattcgcttgaaaatcgtgctgctgtccggtctttgcctgttgggggtcattgcactggtggtcggcatcaatatctacaacaccaaccagaacgacctattggtcagtgactcaagctcacgaatgctgaccgccagcgtggaacagctactgcaagccaaggcagccgaacaggccgggcacttgcaaaagacctttggtgaaaatctgctggtggtcacggccctcgccgaccagatcaaagacctgcgtaagctggggaccaagcgctctcttgaagccggcgccttgcgggaagaaatcaaccaaagcgtgaaaaccgcattcgagcgcaacaccaaggtgctgggcatttggctgtcgttcgaacccaacgggctggatggcaaagacagcgagttcgtcgacgacaaagcgcgcgtctccaacgaaaagggccgcttttccagctactggagccgtgcgggcggtgaaggcctcaacaccatcatggtcgaagatgatctgaccaagaccaccctcaacctcagcggcacgccctacaacatttggtatacctgcccacgagacacccgcagcacctgcttgctggacccctacgaagacacggtggccggcaaacctgtgctgatgaccaccatttccctgcccctgatcgtcgatgccaaagtcattggcgtcgtcggtgtcgatatcgctctcactgccctgcaagcgaccaccgatgccgcacagacagacctgttcaacggcgcagcgcacctggagattctgtccagcaccggcctgattgcggcctacagcggtgaaccggccaaggtgggcaagaacctgatcgacagcctcggcgccgaaggcaaggaaatcgtgcagctgctcaccaatgaccggcccgtgatccgcgagcagaacgacattattcgcgccgtttacccggtcaagccgattgccgacgccaagtcctggggtgtggtgatcaagctgccaaaaaccgtgatgctggccgataacgtcaagctgcaagcggtactcgacgaggcccaggccagcggcaccctcaaagccttgctggtggcagcggctgccggcctgttgggcttgctgctgatctggctgaccgccaccggcgtcacccggccgatcaacagcgtggccgccatgctcaaggacatcgccagcggcgacggcgacctcacccaacgcctggcgtacgccaagaaagacgaactgggcgagttggtgaactggttcaaccgcttcctcgacaagctgcaaccgaccatcgcgcagatcaagcaaagcatcaccgaagcccgtggtacggcagatcaatcgtcagccattgcgcgccagaccagcgaaggcatgcaggtgcagttccgcgaaatcgaccaggtggcgaccgcctccaatgaaatgagcgccactgcccatgacgtcgccaacagcgcctcgaatgccgccagcgcggcacgcggtgccgatcagtcggcccgtgaaggcatgtcgatcatcgagcagagcactcgcgacatcaccacccttgccgaggaagtcagcaaagcggtgagcgaagtcgaagccctggcggtcaacagtgaacagatcggttcagtcctggaggtgatccgcagcatcgccgaacagaccaacctgctcgcattgaacgccgcgattgaagcggcacgcgccggcgaaagcgggcgtggctttgcggtggtggccgacgaagtacgcaacctggccaaacgcacccaggattcggtcgaggaaatccgcctggtgatcgagcgtatccagagcggcacccgaggcgtggtagcgaccatgcactccagccagcaacaggcccagagcaatgccgggcagatccaccaggcggtgcaggccctgggcaagatcagtgacgcggtcaccgtgatcagcgacatgaacctgcaaattgccagtgccgccgaagagcagagcgcagtggccgaagaagtcaatcgcaacgtctcggcgattcgcaccgtgaccgaaaccctcaccggccaggccacggaatcggcggcgatcagcagccagctcaatgcactggccagccagcagatgaagttgatggatcagttcagggtgtaatcgatttcacagacgctggggtcaaatgtgggagggggcttgctccctcccacatttagatcactttttgtcttgaagaccggtccaggcctggacaaacggcgtcaggtcttccttcggtgccgtacgcggcgggttctgcggcgtgcccaggtaaaggaagccaatcacttcttcatccgccgtcagccccaaccctttggccacatgggccgagtaggacaattccccggtccgccacaccgcaccaatcccctgggcataggccgccaacaggatgccgtgggctgcacaagccgccgccagcaattgctcggacttgggcaccttgaagtgctcttgcaggcgcgcaatcaccaccaccaccaacggcgcacgcagcgggccgttctgggccttgtcgatgaccgcctggggagcgtcggcgtcctgcaggcgcgcggcctcggccaacagcgtgcccatctgctcacgtgctgcgccttctacggtaaggaaacgccaagggcgcagctgaccgtggtcgggcgcacgcatggcggcggcgaacaacaggtcgcgctgctcctgggtcggtgccggttccagcagacgtggcacggaaacacggttgagcaaagcgtcgagagcctgcattggccacctccagaaaaaaatgtgcagtcattctagcgggaatgaatccggatgccaccaaacgataattgctcttattcaaaccgccctgccctgttagactttgcgaccacattttccgaccgtttccaggaatttcgatgttccgtgcgtttttttgcctgtccgcagcgttgatggctttaagcctgaccgcttgcgacgacgccacccgcttcaccaaggccgagcctggtgagtcgcggtcaggtggcgccacgacggtgaacaagcgcgaccagaacgccttttccctgccctcggccaacctggcgcccacccgccgcctggatttcagcgtcggtaacagtttcttccgcagcccttgggtgattgcgccgtccaccaccacggcacgggatggcctgggcccgctgttcaataccaacgcctgccagaactgccatatcaaggacggtcggggccatccgccgctgcctgatgcgccgaatgcggtgtcgatgctggtgcgcctctccatccctatctccattacagagcggccgcactacgccaagctcatcgagcagctcggcgtggtcccagagccggtatatggcgggcagttgcaggacatgtccgtgccgggcgtcgttccggaaggcaaggtgcgggtcgactacagccctgtccaggtcagcttccaggacggcaccgttgtcgaactgcgcaaacccgacctgcaaataacccagctcggctacggcccgatgcatcctgatacacgcttctccgcacgggtagcgccgccgatgatcggcctgggcctgctcgaagcgatcagcgacgccgatatcctgcgcaacaccgaccccaagaccgccgacaaagacgccatcgtcggccgcgccaactgggtctgggatgacgcccagcataaaaccgtactcgggcgttttggctggaaagccgggcaacccaacctcaaccaacaaaatgttcacgcgttttctggtgatatgggcctcacaacctccctgagacccttcgatgactgcaccgacgcccaagtggcctgcaagcaggcgccaaacggcaatggccccgacggcgagccggaagtcagcgacaacatcctgcgtctggtgctgttctacacccgcaacctcgcggtgcccgcgcgccgaggcgtcaacacgccgcaggtgctggccggcaagaacctgttctaccaggccggttgccagggctgtcacaagccgacattcaccacggccgccaacgccgccgaacccgagctggccaaccaggtgatacgcccctacagcgacctgttgttgcacgatttgggcgaaggcctcgccgacaaccgtaccgaattcaaagccagtggccgcgactggcgcacgccgccgttgtggggcattggcctgacgcaagccgtgagtggtcatacccagtttttacatgacggccgcgcccgcaacctgcttgaagccgtgctgtggcatggcggtgaagcacaagcggcacagcagcatgtgttgtcgttcaatgccgagcagcgtgccgcgttgctggcgttcctgaattctttataagctttgccccacttacagaagggagctcgacatgtttcgtcccaagttgttgttcaccagcctggccgcccttgccctcggcgcctgctcgccccaggacccgcaagcggtaacctcggcggccatcgccaaacaagtcatcctgccgacctacagccgctgggttgaagccgaccgccaactggccgtcagcgccctggcctactgccagggcaaggaaagcctggacaccgcccgcgccgacttcctgcacgcgcaaaaagcctgggccgagttgcaaccgctgctgatcggcccgctggccgaaggcaaccgtgcgtggcaggtgcagttctggccggacaagaagaacctggtcggtcgccaggtcgagcaactggtcagcgcccagccgcagatcgatgcggccgccctggctaaatccagtgtcgtggtgcaaggcctgtcggcctacgaatacatcctctacgacgccaagcccgatgtcgccgacgaggcacagaaggcccgctactgcccactgttgatggccattggcgagcgtcagaaagctctggccgaagagattctcgccagctggaacagcaccgacggcatgctcgcgcagatgaccaagttcccgaaccagcgctacgctgattcccacgaggccatagccgacctgctgcgcgtacaagtaaccgccctggacaccctgaagaaaaaactcggcacgcccatgggtcgccagaccaaaggcattccgcaaccgttccaggccgatgcatggcgcagccagtcgtcgctgcaaagcctggaggcgagcctcgccgcggcccagaccgtgtgggtcggcgtcgacaacaaaggcttgcgtggcctgctgccggcggaccagaagccgttggccgagaagatcgacgccgcctatgccgcgtccttgaaactgttcgccagcaaccagcgcagcctcaacgaactgttgaacgatgacgccgggcgccagcagctcaacgacatctacgacagcctcaacgtggtccaccgcctgcacgaaggcgagctggccaaggccctgggaatccaactgggcttcaacgccaacgacggtgactgatgatgctcaggcgacaggctttggcggtgggcagcgtgctgctcagcgcccttacgttgggcggctggacgctgttcaaaggcaaggataaaggcccgctgctactgtcggcgcgggatgatgccgacggcaagcactacgccgtcggctatcgcctggatgggaagcaggtgtttgccacccaggtcggccagcgttgccacgacatcatcaatcaccctatgttgccgatcgcgctgttcgtcgcccgccgcccgggcaccgagagctacctgattgacctgcgtgatggcgcgctgctgcaaaccatcagctcgaacgccaaccgccacttctatgggcatgcggtgatccacaagagcggcgactggctgtacgccaccgagaacgacacctccgaccccggtcgcggcctgttgggtgtgtataagttcgaaggcgagcgactggtacacagcggcgagatttccacccacggcatcggcccgcaccaagtgtcctggatgcccgacggcgaaaccctggtggtggccaacggcggcattcgcaccgaagccgaaagccgggtagagatgaacctcaacgccatggagccgagcctggtgctgatgcaccgcgatggcaccttgatcagcaaggaaaccctgggccagcagatgaacagcgtgcgccatatgggcatcgccagcgatggcactatcctcaccgggcagcagttcatggggccgtcccaggagcgctcggagttgctggcgatcaagcgcccgggccatcctttcgtggcgttcccggtggccgatgagcaattgcaggcgatggggcactacaccgccagcgtggcggtgcacagcgaactgcgcctggtggcactgacggcgccccggggaaatcgcttcttcatttgggatatggacagcgccgagctgcgcctggatgggccactacccgactgcgccggtgtaggtgcagtggccgacgggttcgtcgtcacgtcaggccaagggcgttgccgcttctatgattgccgccaggaccaactgatggccaagccgttggaactaccggcgggcttttgggataaccacctgcacctgatctgaaattcccctctgtaggagcgagcttgctcgcgaaggtcgccaacgattacgcgcccttctggatacgcgccatcctcaggtttttcgcgagcaagcttgctcctacagttaaagcgtcaggcgtaaaaaaagggcctcgcatcgcaaggcccttttttgggggtcaatcatttcaactctgcggcttcatcgcttgagacatcccgaacatgaataacagcaattcatgatcaggcttggccgccacacttgccttggcaatgcgtggcagcaggcattgcccgccgccgtctaccgcactgagcacttgtgtgcgaggttgttcccacaccgccagggccagggctgaaacgcccaacgccccgatcaggaacaaacctcgtgccatttctagcttcatctggttaaacccttgatagcgctgccaaacgccgtctcgtaaaagtagctgagttttttccagtcggtatcattccacgacgaatggcggcgcaattgcagcatgtcatgggaagcggcccgataagcggtcaagcgttggcgacatttttcaaagtccagcagggccacttctacagtcgccgcttcgggctcgccggtgacccgcacgaagatgtgcttgatatacaggcaaccgtgctgccagcggcctttgtgcatgcgggccagggtgccggccaattcctgcagcaagcgctcgtggacggcctcgccatactgttcacggccgccagcggcgtaccagttttcgatctcgtcgaaaccgtccagggacgcggtgaccagcagggctttccattggtgctccgggtcgcgtcgcgcctcgcagaacaccaactccggcacgcgcacatccagcaaacgcaggcccttgagagcatcacgttcacgtagcacggtcgggcgcccaaaggggtgcagccaactgcggtaaatgtggccggtctggcgcttgctatagagcaaccgcccgttggggcctaccacacgctgcacgccactttcgccaccacgtcgacggttgggttcttcaacccattcaccttgctgacgccagaaaaaatcgaatcgttcttcgggagctacatgactgcctgctacgcactcaactgccatcctgttacctcttgcgcaatacatatactcgccacatggcgtagagcggtatgaagtccagggattcctgaacacggaaaccggcctgctcgaattctgcctcgacagtagcagccggtaacacaaaccggttttggtaaccttcctgctcacctcgtttgcgacgacgtacttcgttgcgcttgcgcttccaggccttgaaattgccgtctacccacaacgaaataatcacgctgtcacgggtaacccgctgaaactcacgcagtattgtcagcctgtgctcaggttcaccgatgtggtgcatcaagcgcatgcagaaaatactgtcgacggagttatctggcaaatcgatatcaaaggcagatgtctgcaaagggcgtacccgtttcaccacatccgccggttgggcggtggtggcgatcttcaacatcgacgccgaattgtcagccccgataattacacggttgggtttttcggccagcaacggccagaagcgtccagcgccacaaggcagatccagcaccaggccgggttcaccggccatggccagcgcaccgcgcgccagttgctcgtcgcgtttgtgggacaaccggcgagccagattgtcctgatgtttgagcaaatattgttgcgcgtgttgatcgtcgtacttttcggaaaattccaacttgattggggaaggcatcgcacgtctccagtaactgatgcctacaaccttatgcagcgaactgtgatcaacaggtcaactcattgtgaaaatcttgtcctgtccaactgcatacatttcaagactttacagaaacattcagtagcatggggccatcttcgctgaaaagcgggcagtctgcattagcaaaacgacagactgaacggtcagcttttgacctggctcaactccacatgaaaacgacagccattgggctccatcgtcgtcaagctcacgctccagccctggctctcgcagatccgttgcaccagcgacaggccgagccccagcccctcgccacggttctcgctgccgcgtacaaacggctcgaacatcgcttcgcgtttttcttcgggaatgccgacaccggtgtcctccaccacgaagccactgggctccaacgtgaggcggataaatccgtgctcggtgtagtgcagggcgttgcgcagcaggttgcccatcaccgcatgcaagaaggtggtgttgtagcgggtgtccagggggttgcctggtcggtagatcaactccaagccttttttctcgataggctcgcgccagatgccgagcaggtcttcggcgacctggctgaggttgccctggggcgcaacggcagcatcatcgtgcttggcgcgtgcgagcatcaggaaggtctgcaccagctcgcgcatttcttcacaggcacgggcgatgcgctccacctggcggcggccacgttcatcaatggccgggttttccagcaagagttcgcaggagctggctaataccatcaagggcgtgcgcaactcgtgactcacgtcgctggtaaacagttgctcgcgggacagcgcctggcgcaagcggcccagggtggcgtcgaacgccaccgccagctcacccacttcgtcggcggcataatccggggccagaggcggtgccaggcccagcagttggtcacggtgacgcacctggcgagccaaccgcaccaccggcgccatcaccttgcgggccagcacccaaccgaggaataccgccagtgccaggctgagcacgaaccccaccaacaccacggcaaacagcacacgctcacgttcttcgaaatcgctttggtcttgcagcagcacataacgccgaccgtcgatcacctcgaccatggcgtggtacgacagcgactcgcgaaatacttcgtggaagcccgggtccagatgccgaagatccttgggcagctcgaaatcgccttgcccgccgctgaaataaaacaactggtccggctccggccgatgtcgccagtcttccatgctgtccatcaacagcaggcgttgcaggtcaccgcccaggcccgccgagatcaacttctcttccaccaggtgcaccgtcgcaacgatccccatggcgaaggcccccgccaccaacgcactcatcaaggcaaaggcgatgatgatccgctgggcaaggctttgcttaaactccatcacgaccctcggccaagcggtaacccacgccgtgcaccgtttgcagcaacggcttggcgaatggcttatcgatcacctggcgcaattggtgaacgtggctgcgcaggctgtcgctgtccgggcaatcatcgccccataacgcctcttcgagtatttcccggcgcagtacgtgcgggctcttctgcatcaacaccgccagcagtttcaggccaacggggttgagcttgagcaggcgcccttcgcgggtgacttccaaggtatcgaggtcgtagttcaggtcacccacctgcagggcgcggcgcccgccaccctgggcacgacgcagcaccgcctcgatacgcgcggccagttccgacaaagcgaatggcttgagtaagtaatcatcggcgccagacttgaagccctgcaggcggtcatccaactggtcacgggcggtgagcatgatcacaggcgtatcgcggcgcgcgtcttcgcgcagacgtttgcagagggtgtagccatcgatgccgggcagcattatatcgagcacgatcaagtcgtaatgctcggtggccgccagatgcaggcccgacaagccgtcctgtgcacagtccactgtgtagcctttgagccccagataatcggccaggttggcgaggatatcgcggttgtcttcaaccaatagaattcgcatgggcagtgtctccgtacgcagtaacagccgtgttggctcgcgcagcttaaggccaagcggggctcagggatagagctgaaaggcccactgatgagggttttcaactgattacagggacaaacgagtttttcactatagcttcacaaacagaccacagtgtcagggtgaagatcgcgcccatcgatctaaggaacctggacatgggctttctcaaaacagcgccaatgcgctatttgctgttgataaccgctgcctggttattggttttcctgctcactcgcagcgtgttgctcgtgactcacctgaatgaagtgggcggcaacttgctgccggtgtttggcgtgggtctggtctacgacctgggcttcctcgcctatgcggccttgccgctgggcttgtatttgctgctctgcccacccgcactgtggcgccgccgcggccaccgctggtttttgcaggcgctgctgacgatcagcctgttcgccatgctgttcacctcggtggccgaatggctgttctgggatgagtttggggtgcgcttcaactttattgcggtcgactatctggtgtattccgatgaggtgctgaacaacctgctggagtcttacccgatcggcaagctgctgagcctgctggcaatgctggcgatcctcataagcctggccctgcgtaaacccttcaatgccgccatggcggcacctttgccggcactgcgtggccgtttggtcaatgccctgggcctgttggtggtcgccggcctcagcctgcaactgatcagccaggacagcccgcgtgcccagggcggtaacgcttacaagaacgaactggccagcaacggtccttatcaattcttcgctgcgttccgcaataacgaattggactacacccagttctatcagagcctgcccactgacatggtcgcccggcaactgcgcgccgaactcagcgagcccaatgcgcgctttatcgacccggacccgctggatattcgccgcgccatcaccaacccgggcacactgcgcaagcccaacatcgtgctggtcaccatcgaaagcttcagcgccaagtacatgggcagcaacggcgatcaacgcaacctcacgcccaacctggatgcattgcgcaaacaaagcctgtacttcaataacttctatgccaccggtacccgaaccgaccggggcctggaagccattaccctggcgatcccacccacgccaggccgctcgatcgtcaagcgcatcggtcgtgaaagcgggttcgcgagcctcggccaacaactcacggccatcggttacgacagcgtgtttgtctacggcggtcgcggttacttcgacaatatgaacgcgtttttcagcggcaacgggtatcgggtcgtggaccaaagcagcgtgcccgagtcagaaatctcgttcaaaaatgcctggggcatggcagacgaagacctgttcaaacagacgcttaaactggccgacgccgactacgccaagcaacagccgttcttgctgcaactgatgacgacttccaaccatcgcccctatacctacccggatgggcgcatcgatatcaaatccggcaagggtcgcgatggtgcagtgaaatacaccgactacgccatcaaccagttccttgaggctgcacgccagaaaccgtggttcgacaacaccatttttgtgttcgtcgccgaccacacggccggcagcgcaggcaaggaagacctgccgatcaccaactaccagattccgttgtttatctatgcgcccaagctgatcgacgcacgggagtccgcgcaactggccagccagatcgaccttgcgccgaccttgctgggcctgatcaacctcagctacgagtcgacgttcttcggccgtaatctgttgcaagacaacccgctgccaccgcgggtcgtggtgggcaactaccagcatctgggcttgtttgacggcaaggacctggcaatcctcagcccgcgccaaggcttgcgtcgccatgaccaggcccttggagaaagccaggagttgcgcgtcggtagcgatgacccattgatccagcgggcaattacctactatcaggccgccagctacgactacaaacagcaactgctgagctggaaagcgctcaaggaagaggctccagtcttaagcaaacgctaatcaaaagccccatgcaggtgagcacggggctttctcaccaaggttcgtgatgaaatccccctcttctttaccggtttccaaaccgctcaatttttggctgtgcctgggcctgcctgccggcgccgcagtggtcttgctgttgctggaactgacctcattggacatggacctggccaggcgcttctacagcgcggaggctggcggcttcatcggccgctatagcttcttccttgaagacatcctgcatgatcgggccaagcaactggtgattctgttttcggtactggcgattctggggctggtcggcagtttcattctgcaacgactcaagccgtaccgccgcgaactggtgtgcctggtgctgtcgctgggagtggcgacggcgttcgtgtcgccactgaaaaccatcaccgccgtgcaatgtccctggagcctcaaggaattcggcggccaggaaacctacagcgaactgctcagcccgcgcccgcctaccgataaacctggccgctgttggcccggcggacatgcagctaccggttttgccttgttcgcctggttcttcgcgctgagggatcggcgaccacggctggcgcgcaacgcgttcatttttgccgtcagcctgggcagtgtcttctcagtcagccgtatgctgcaaggggcacactttttttcccacaacgtgtggacagcgattttttgctggctgatttgcctgggtttgtattgcttgttgctgtaccggccttcacggcaagccgtaatgccgatcagttaagcgaatgcaatgctcaacgcaacgaagattccgtgtaggagcgggcttgcctgcgaaagccaacggtaaccacgatgcgaagcgagccgctcttgatcttgatctgcttttgatctcaggcgccccgttaaaccacgctgtcggattacgggcacaccgagcctgggcgaggtgccgagtggtggggcaagagcgttgcttactttggcctgggccggcatcccggcttttgcaaagtgagccgccgtcagggcggaaccctaagtggccattaccgcaggaatggatatgtactcggtataactgtgtcggctggcaggccgccatcgggagcaagccccctcccacatttggatcgcggcgtgtcaggtagataggcgtcggctgtcaggccgccagcgggagcaagctccctcgccacaggtccagtgtcataccgaagttgagtagatacagctcacaaaaaagccccgcctgcatcactgcaggcggggctttttatagcgccgggtaaggctggcttacatcataccgcccatgccacccatgccgcccatatctgacataccgccgccagctgcgccttcagccttcggcttttcagcgatagcagcttcggtggtcaggatcaggccaccgatggaggctgccgcttgcagcgcggaacgggtcaccttggtagggtccaggatgcccatttcgatcatgtcgccatagacgccagtcgcagcgttgtaaccgtagttacccttgccgttcttgacttcgttgaccacaacgcttggctcgtcaccggagttggcagcgatctggcgcagcggtgcttcaacggcacgacgcagtaccgcgataccgacgttctggtcagcgttgtcgccggtcaggttagtcagggcttccagggcacggatcagcgcaacgccaccgccaggtaccacgccttcttcaacggctgcacgggttgcgtgcagggcgtcttcaacgcgggctttcttctctttcatttcgacttcggagccagcgccaaccttgatcactgcaacgccgccggacagcttggccaggcgctcttgcagtttttcacggtcgtagtccgaggaggtttcagcaacctgtgcacggatctgggcgatacgggactcaatgtcgccttcaacgccagcaccgtcaacgatgatggtgttttccttggagatggttacgcgcttggcgctacccaggttttccagggtggcgctttccaggctcaggccgatctcttcggagataacggtaccgccggtcaatacagcgatgtcctgcagcatggccttgcgacgatcaccgaagcctggagccttgacggccgcgactttaacgatgccacgcatgttgttcacgaccagggtcgccagggcttcgccttcaacgtcttcggaaacgatcagcagtgggcggccagctttggcaacggcttccagcactggcagcatttcgcggatgttggagatcttcttgtcaaccagcaggatcagcgggttgtccagttcggcaaccatggtctcaggcttgttgacgaagtacggggacaggtagccgcggtcgaactgcatgccttctacaaccgacagttcgttttccaggcccgagccttcttcaacggtgatcacgccttctttaccgactttttccatcgcttgggcaatgatgtcgccgatggagctgtcggagttggcagagatggtacctacctgagcgatggccttggtgtcggcgcatggcttggacaggttcttcagctcagccacgatggcgatagtcgccttgtcgatgccgcgcttgaggtccatcgggttcatgccggcagcgacggccttgtagccttcgttgacgatcgcctgggccaggacggtagcggtggtggtgccgtcgcctgcgtcatcgttggcacgggaggcaacgtctttgaccagctgcgcacccatgttttcgaaacggtcttccagttcgatctctttggctacggaaacgccgtccttggtgatggtcggagcgccgaagctcttctcgatgatcacgttacgacctttcgggccgagggtcgcttttactgcgtcagccaggacgttgacaccggtgagcattttcttgcgggcggaatcgccgaatttaacttctttagcagccatgatcgatattccttaaatactttgtagtaacgggaaaatgagcgaggaaatcagtcttccagaacggcgagaatttcgttctcagccattaccaacaggtcttcgccgtctactttcacagtgttgctgccggagtaagggccgaaaacaaccttgtcacccactttcacggccagtgcgcgtacatcaccgttctccagggtcttgcctgggcctgcagcgacgatcacaccgtggttggctttttcagcagccgaacctggcagaacgatcccgccagcggttttcttttcttcttcgctgcgacggattacgacgcggtcgtgcagaggacgaagcttcattgtcgatctctcctaattgtgtttttcatcggccggtatcaattccggcgggttaaattccggcggtgccggtcgcgactcgctgggcgaatcgcggaagtctgtctagtgtcaccaccagaaaccttgcggtgaccgttacataagggcggctgtggttattacaaggggtcgaggatgaaattttttgtgtcggcggcggggtgaatgcaacacggcacccgagggtgccgtgccagtgaagcgcttatttgctgtcgcgatgttcgaattcgccttcgatcacatcgccttcgcgtcccaggggctggcgcggagccggaccgccgcggggttgcaggtcgtcggcgaaggcgcgttggcgaatcgcggcttcttcggcgcgctggcgcattttgcccgccagcagcttgcgcgtgaacggcagcagcaggaccaggccgaccacatcgctgacaaagcccggcaggatcaacaagccacctgccagcgccatcatcaagccctccagcatggtctgggcgggtaactcgccgcggttcaggctttcacgggcacgcagcgccgtggccaggccggcgacgcgcagcacgaggacgccgagcatcgagccggcgatgatcaacagcaatgccgggaaaaacccgatcgcaccgctgacttgaacgaatacgaacagctccaacaccgggaacagcagaaagagcaataaaaaagggcgcatcaaatggttcctcaacgcaagaatgccttgccagtccaccttagatgacgtcgccatttcgtgaattcaagcattggcggcggttattttcggccaggcctcggcgtgagccaatgaaaccaaggcttcgcgcacttgtgtcggcgtgttgcaaggcgttgcgaagggcaaccaatgcagggactggccgatacgcaggtgcatgccttcgctgtcgatgccagccaattgcgcaggctcggacgtgggcaacccgctgagcccgacgtaatgggcgatggccttggtgtgatcgctgttcatgtgctcgatcatgctgcgttcggccttgccggcaaacgggttggccaaggtcaactgatcgacccagtgaatcgcgccaaacccgccgatataccggtggcgcaccggcttgagcacccagaaatcgaaatcgtgggccttgtggtagttggccgaatcggggaaatagcggtaatagcgctcggcagcggcttcaatcactgcctggtcttcaagcttttcggcttcggccaggtaggtcaggcgccccacggcctgcacatcatcggccccgcgctcacctaccagcagcgagcacttgggatctttttgcaggttgtgggtgtgctgggcgatgcggctgatcaggatcagcgggcggccctgctcgtcaaggcaatagggcacgaccgagccaaagggaaacccgggcatggccttggacagtgtggagagagccccacggtattccttgagcaacagctctcgggcgttcttggcaacgtgcacgctcaacgtatgactcctcggtgttctgccgtccatggcatatgggaatggatctcaacacaaggtaatcaatatccgcgcaggttgccagggtggccgacgcaggttttaccaggccacaccaaagcctgcggtgtagcgggtcttgctcaagctgctgtcggagttgccgctgacctcgttgcgctcggccttcaagttgagcgaggcccattcggtgaccttgtagcgcaggcccatctcggcatccagggaatactcggccggcccggccaggggcttgcccaattcaccgttggtgaagaactcgacggtcttgcccaccaggtagcggttgtagttccacttcatggccagggaatagaagttgtccttgccgccgtcggcatattcataatcggtgcggttgaccagcgaacccagggagaaggcgcccagctcatcgtcccagaactgatagcccgggccggtgccgacaacgcgctggcgagccaggtcttcgaccttgtcgcgcttgtaggtcaagcggccctgccagaaccagtgctcggtgatgaagcggtccaggctatattccagcgcccagttgtcggtggtggtgacgtcatcctggaactcgcggttgtattcacccttgcccgtatgacgccactggccgtgacgggccgacgtcttgaagtcgacgtcgtagtcgttggtgtctttgtcggcacgcttgtagtccagcgccaggtcgacgttgcccttccacaccaggtcttcgatcactggcttgggcttcatgatctgctggatacttgccagctccacggtcttgggtgcctcgccgttggccagcaccaccttgccgtcatccgaggcgtgcaaggacttggccttttcgccgctgtaggcgtcctgcttgaccagcagttcctggtcgctttccagggtcttgacctgcttccagtccaccgggattgagccagcataggtggtctggatcagcaatttgccgccatcgaagactttgatcttgccggtcaggcgatcaccgtttttcaaccacacggtatcggcgagcaagggcgtggaagcactgaaaacagcaaggcacaacagggttctggacaacataagcagatacggggctcaggggtggcgaaaataaggggcgttatagtgttacatggctagaactgactcaaggatttatattgagttcaattctcatcgccatgtttacagacgtttctgacaaaacaacgacgatctcaacggatatccccacacagtgaatctacctgccgatacgccgcaaagccccgccgacatgcgtcgtaccgccttgtacctgacgctggcgcaagtgccggaaggctgcgtggtgagctacggcgagctggcccgactggccggcctgggccgcgccgcccgctgggtcgggcgcaccctgagccagttgcccgaggacacgcgattgccctggcatcgggtgctgggtgccggcggtcggataagcctgccggtgggcagtgcttcgggtgacgaacaacgtgggcgtttgcgtagcgaaggcgtcactatcttgaacaatcgcgttgatattcagcgtcatggctggcgcccggtagagcacagcggttagagtgcgcgctttgtttccgcgaatctgaggcagactccagcccatgccccgtaaaacctggcgcgccgcgctcgccgcctatgccagcccctcgacgttagtgctgttgttgctcggtttcgccgccggcatgccttacatgttggtgttctcgacgctttccgtgtggctgcgtgaagccggtgtggcccgcgagaccatcggttatgcgagcctgatcggtctggcctacgccttcaaatgggtctggtcgccgctgctcgaccaatggcgcctgccgctactcggaaaactggggcgtcgtcgttcctggctggtgctggcccagtcgctggtgatcctcggattgatcggcatgggcttctgcgatccgcaaaaacacttgtcctggttgatcgccattgcggtggtggtcgcgttcgcgtcggccacccaagacattgccgtggatgcctatcgcctggaaattgccgacgacagccgccaggccgccctggccgcaagctatatgtccggttatcgcattgccgcactgctggccacggccggcgcactgttctttgccgaaggcttcggctccaccggcttcaactataaacactcggcctggaccggcacctatgtgctgttcggcgtgttgatggttccggccctgctgaccaccctgttgatgcgtgagcccgatgtgcccctgcgcacccagttgcaggccgggcgctacagcttcgtgcaccaactggtgtcggtgttcgtgttgatcgtgctgctggtgtcggtgccggcgatgttcacccagctgtacaacactgacttcgccagcgtgctgttccagggtgtgagcctatgggaattgctgatggaagaccgcgcattcctgcgcgccatcctctatatcacgctcacttcgctgtgcctgtcggccatggggcgccggggcctggcgccggtgctgacgccggtcaacgacttcatcctgcgttatcgctggcaggcactgttgctgctcgggctgattgccacctatcgcatgtccgacacggtgatgggcgtgatggccaacgtgttctacatcgaccagggctttaccaaggaccagatcgccggggtgagcaaaatcttcggcctgatcatgaccctggtcggcgccggcatgggcggcctattgattgtgcggtttggtatcctgccgatcctgttcatcggcggcgtggcctcggccggcaccaacctgttgttcgtgatgctcgccgacatgggccccgacctgcagatgctgatcgtcaccatttccctggataacttcagctcgggcctggccacgtcggcgtttgtcgcctacctgtcgagcctgaccaacctcaagttctccgccacccagtacgcgttgctcagctcgatcatgctgttgctgccacgcctgatcggcgggtattcgggggtgatggtggagaagttcggttaccacaacttcttcatgatcacctgcctgctgggcctgccgacgctgttcctgattgcgttgcactggttccaggaaaataggcgtgcacggttgaacccctctgaagaaacggatcccttgtaggagcgagcttgctcgcgaagaactcacagacaccgcgttctccccggtttcccacgtcatcgttgacgatcttcgcgagcaagctcgctcctacatagctcatgcctgtacgcgagcagcaagcgcccgtacaatcccaagtcatttcaagtccaagcaaccgacaacggcctaccatgcgtaccagtcaatatttgctcgccacacagaaagaaacgccttccgacgcggtagtgatcagccaccagctgatgctgcgcgccggcatgatccgcaaactggcctccggcctgtacacctggttgcccatgggcttgaaggtgatgcgcaaggtcgaagccatcgttcgtgaagaaatgaacgccgccggctctctggaagtgttgatgccgagcacccaaccggctgagttgtggcaggaatccgggcgctgggaagagtacggccctgagttgctgcgcttcaaggaccgtcatggccgcgatttctgcgccggcccgacccatgaagaagtcatcaccgacctgatgcgcaacgagttgagcagctataagcagttgccactgaacctgtatcagatccagaccaagttccgtgatgaaatccgcccacgcttcggcctgatgcgtggccgcgagttcatcatgaaggatgcttattccttccacgccgacctcgcgtcgctgcaggtcacctacgaccgcatgcaccaggcctattgcaacgtgttcacgcgcctgggcctgaaattccgcccggttgaagcggacaacggctccatcggcggtgccggctcccacgaattccacgtgctggccgaatccggcgaagacgatatcgtgttcagcaacggctccgactacgcggccaacatcgagaaagccgaagccgtgccacgggaaacttcccgccccgcaccgaccgaggaactgcgcctggtcgatacccctgacaccaagaccatcgcggccctggtcgaaaaattcaatctgccgattgaaaagaccatcaagaccttgatcgtgcacgccgaagaagaaggcaagctgatcgccctggtcatacgtggcgaccacgagctcaacgaaatcaaggcggccaaccagcctggcgtcgccagcccgctggtcatggcctccgacgccgaactgcgtgacgccatcggcgccggtgccggttccctgggcccgctgaacctgccgctgccgatcatcatcgaccgttcggtagagctgatgagcgacttcggcatcggcgcgaacatcgacgacaagcactacttcggcgtgaactgggagcgcgacctgccggtgccgaccgtggccgacctgcgtaacgttgtcgccggcgacccaagcccggatggcaagggcaccctggaaatcaagcgcggcatcgaagtcgggcatatcttccagctgggcaacaagtacagcaaggcgatgaagtgcgaagtgctgggcgagaacggcaagccgatcaccctggaaatgggttgctacggcatcggcgtttctcgtgtggtagccgctgccatcgaacagaataacgacgaaaaaggcattatctggagtgacgccctcgcaccgttccaggtggccctggtgccactgcgctacgaaaccgagcaggtacgcgaagccaccgacaaactgtatgccgaactgacggccgccggttttgaagtgctgctggacgaccgggacaagaagaccagcccgggtatcaagtttgccgacatggaactgattggcatcccgcaccggatcgtggtcagtgaccgcggcctggccgatggcaacctggaatacaagagccggaccgaagccgaagcccaaccgttgccggtggctgacgtgctgtctttcctccaggcgcgcattcgtcgctgaaaaccagaccaagagacgtcatgttcaagccacacaccagagccctggggggcgccgccttgtgcggcgccctgctggtcagcggctgcgccaatcagatgtcgcaacgcagcgagcacgaggagcggatcgagcgcaagttgctcgaccacagcctgcagattgatgtcggcgaacccaaagtgctggagctgccgcaacgccgggttcgcatccatgagcagaagaccttcgaggtcaccgaattcgaagtcacccgtcgttacgaccgctacacgccctaccagccctggcgcaaactctatgagatgccgctgggcgccgtggcgttggtggctggcgtgggcgccaacgtggcgaatatcttcgccctcggcaacttgcccacgagcgtgacccgtgactggttgagctacggcgtggacggcatcaacccgttcatgaacgtgcaatcccacggccgtgcgcaacagaacctggcagccatcgatgaagtccagcgtgacaagcgcctggagtactcgagcctgccctggagcgaacgcccggtacaggtcaccgccggcaagcagacccatgagctgaccaccgaccgcaacggcatactgcgcctgaacctgttggacagcccatttgccgagcaagacctgaaccgcgtcaccaccttgaagatcagcgtcgaagacggccaggatgacgtgcatacggactcgaccctggcggtcagcaacagcctgcgcggcaaattgctggaagcccatgggctgatctacgacgacctggaagatgacgaggtgaaccagtgggtacaccgggtcaagcgcctgtcggaactgggcctggaagaagaagccagcgaactggagcaaagcctgatcgagctgacccgcaatgatccggaattgcagcaggagtttgtgcaggcactgaccaaggatgcggggcgcttggtggcagaccctggcgcacgctgatcccaggctttttttgtaggagcgagcttgctcgcgaaaaacgtcaacgataacgcgtgtttcctggaagaacgcggtgcctatgagtttttcgcgagcaagctcgctcctacagagagcacccggtttttaccaggaaaattcgagctgttcgttaccgccgctcaggtccagcaaccgcaccccaatccccagcaatcgcaccggtttccccccacggttaaacgcctgggtcagcaactgttgataactctccagatcccgccctgccccggcctgttccagtgtcgtctgggtaaagtcatgaaacttcacttttacaaacggcttgcctgcccggtagctgctgtctatgcgcgccatccgcccggccagggtttccatcagctcgggcagtttcgccaggcagcttgagagatccggcaagtccacgtcgtaggtattttccacactgatggattgtcgacggctgtcgttctgcaccacgcggtcatcaatcccacgggccaggctccacaggcgctcgccaaaactgccaaattcgcgcaccagcgccagtttgttccactcgcgcaactgcaggcagtcttcgatacccaggcgtgcgagcttatccgccgtgaccttgccgacgccgtgcaacttgctgacgcgcaactgcgaaacaaagtcttcgacctggtccggggtgatcacgaacaggccgttgggtttcttccagtcgctggcgatcttggccaagaacttgttcggcgccacaccggcagacacggtgatatgcagctggttggaaacacggcggcggatatcctgggcaatgcgcgtggcactgccgccaaaatgcgaactgtcggagacatcaaggtaggcttcatccagcgacaacggctcgatcaagtcggtgtagtcgcgaaagatcgtctggatttccttcgatgcttctttataggcatccatgcgcggcttgacgatggtcaggtccgggcacagcttcaaggcatggcgcgacgacatggcagaacgaaccccgtaagcccgtgcttcgtagttgcaagtagcgatcacgccccgacggtccgccgagccacccacggccaagggcttttgcgccaggctcgggtcatcgcgcatctcaatggcggcgtagaagcaatcacaatcgacgtggatgattttgcgctgcgtcatataaacggggtgtgaaccaacgggtgggcagtatcgcattcacacctgtatatagcaccagtagtttgattcttccttccaagtggtaggaaatttctcagatgaatttattttctcaatcgaattcagccttccgatagagctgaaagcctcggcctgactggccccgagcggttcaaggccgcacttttgagagctaaccgattgaagcacaagcgcttttcttcgattaacgggttgacacactcgcgttcctctgtagaatgccgacacacagacgcgggatggagcagtctggtagctcgtcgggctcataacccgaaggtcgtcggttcaaatccggctcccgcaaccaaacatcaagaaaggctactcgaaagagtggccttttttgtgcgcgtctgtttttcatccccctcttaccaaaaacgcgccaacaccttgatttcagaataattcgcactaattggccccatcggtgcattaacggttgacaccctgccgctgggctgtagaatgccgcccacagacgcgggatggagcagtctggtagctcgtcgggctcataacccgaaggtcgtcggttcaaatccggctcccgcaaccaaacatcaaaaaaggctactcgaaagagtggccttttttgtatccggtgaaaaagttctcctgaaacaatgacatggcatctttcatgaaaccgtacagggtttgtagagtccatctcattgcacgctaggctcaatgctcaagcgcttccctctacgaccaatggccgcagtcgccccacccggtgatccgcgttaatatttgtaattattttgtccatagggattggtaacttggctggatacccccatcctgtcgcgcacaatccacgaggtgattgatgcgcgccaactcgtctgaaccacaagacactgtcacagcagaacaaccgatcacgcccacccgcttgcgctggctggatctgttgagcaagtaccggcagcctatcggcctggcggttacgctgctgttgtttgctatcgccctgatcgcttgccgacacctgctgctggaactggatctctatgccctgcatgactcgatcctggaggtgcccaagccatccctgctcggcgcgtttgcagcggcggtcgccggcttcgtcatcctgctcggctatgaattctccggtgcccgttatgccggggtgaagttgcccgccaagaccctggccctgggtggcttcaccgcctttgccatcggcaacgccattggtttgtcgatgctctcgggcggctcggtgcgctaccgtctatatgcacggcatggcatcggcgcgtcggaagtagcgcacatgaccgtgttcgccagcctggccctgggctgtgccctgccgccactggccgcattggccaccttgagcaacctgccggcggcctcgacttacctgcatttaccgcaaggcctgctcggcggcatcgccggtgccgtgctgctgctgtcagccgcgttgtgcatcggtatctatcgccgccgcctgccggaacagccctatcccgacaacctgctggtcaaggccggacgccgtacgctgcgcctgcctggccgtcgcctgaccttcctgcaactgatcatcaccgcactggacgtcgccgctgccgctaccgtcctttatatgttgttgccggaagcaccgcccttcggtccgttcctgctggtgtacctgctggccctggccgccggcgtgctcagccatgtgccgggaggcgtgggtgtattcgaagcgatcctgctggcggccttcgccgacaaactcggtgccgcgcccctggctgcagccttgctgctgtaccggatgatctatgtggtcctgccgctgttgatcgcctgtgtgttcctgctggtcaacgaggcccagcgtctattccagacccagcaaagcctgcgggtggcctcggggctggcggcgccagtactggccgtactggtttttttgtccggcgtggtcctgctgttttccggcgccacgccagaaatcgactcacgcctggaaaacatcggcttcctgattccccaccgcctgattgacgcttcgcactttggtgccagcctgatcggcgtgttgtgcctgctgctcgcccagggcctgcgtcgacgtttgtcggcagcctggatgctgaccatggtgttgctgctggtgggggccctgctctcgctgcttaaaggtttcgactgggaagaagccagcctgatgaccatgacagcggtgctgctggcgatcttccgtcgctcgttctaccgcgccagccgcctgaccgaattgcctttttcgccgctgtacctggtggccagtgtctgtgtactcggcgcttcgatctggctgctgctgttcgcctatcaggacgtgccctacagccatcaactgtggtggcagttcaccctcgacgccaacgccccacgtggcttgcgctcattgctgggtgccgcggtactgctggtaatcgtgtcgctgacctggctgctgcgcactgcacgcccggtcatccacttgccgacgtcggaagaactggagcgcgccaccaagatcctgatggcctcctcccagcccgacggcggcctggcgctgactggcgacaaggcgctgctgttccaccccaacgacgaagccttcctgatgtacgcccgtcgcggacgcagcctggtggccctgtacgacccgatcggcccgacccaaccgcgtgccgagatgatctggcagttccgtgacctgtgcgacatccatcatgcccgcccggtgttctatcaggtccgtgccgagaacctgccgtactacatggacatcggcctcaccgcgatcaagttgggcgaagaagcccgcgtcgacctgaaacgctttgacctggaagccaagggcaaagagatgaaggatttgcgctacacctggaaccgtggcacccgggacggcctgtccctggaaatcttcgaacccggccaggcgccgatggatgaattaaaagttatctccgatgcctggctgacaggtaagaatgtgcgggaaaagggcttctccctgggccgtttcagcgacgactacctcaagcacttccgtatcgcgatcattcgcttcgaagggcgcccggtggcctttgccaacctgctcgaaacctacaaccatgacctggccagccttgacctgatgcgtgcccacccggacgcgcccaagctgaccatggagttcatgatggtgggcctgattcaacattataagaaccacggctacgcccgcttcagcctcggcatggtgccgctgtcgggcctgcaaccgcggcgtggcgcaccgttgacccagcgcctgggctcgatggtgttccgtcgtggcgagcaactgtataactttcaaggtctgcgccgcttcaaagacaagttccagcctgactgggaaccccgttacatggccgtgcccgcaggacttgatccgctggtggcactggccgataccgccgccctgatcgcgggcggcttgactggattggtgaaacgctgatgattcgacgctcctggcggtatgtattggcctttgtagtgctgctcgccctgatcctgggtggcggctattggtactggaaccgccctgctccgcaaccgaccctggagcaattgccccaggccgacggctcggtgatgacccgcgtgaccccggccagcaccgcgaaagctcgtgtagccgtggcggtgatggctgatgaagccctgaccgacagccagctgattgccctgagccagggtggcgcggcacagatcatccaggtggtgctgcccaaggctgactgcacagtgcaggaacaagccctgcaaggcgccctggcccagcttaagggcccggcgaccctggtcagcggcatcggccctggcgccgcactcgcctggcgctggctggccacccagaacgatgacaaggccaacgccatctcggtgggcttcgcattgacccaggaaggctgcaaggacccgctgccgaaaaccgccgcccatggcaactggctggtagcgtggaacgataatcctgacgatgaaagcgccagcttcgtacgcgacactccgcgtgccaccaccagcatcagcgattacgacattcattacccgcaaatcctgaacaacgagttgcgcaagcaactggtaggttcggacaacggcggcctggccattccagtggtggaagtacccgctggccaagccaaggacaccgtaaccctgttcctctccggtgacggcggctggcgcgacctggatcgcgacgtggccggcgagatggccaagatcggttacccggtggtcggcatcgacaccctgcgctactactggcagcacaagaccccggaacaaagcgccaaggacctcactgagctgatgcagcactaccggcagaaatggggcaccaaacgcttcgtgctgaccggttattcgtttggcgccgatgtactgccggccatttacaaccgtatgccggaaaacgaacagcaacgggtcgacgcaatcatcctgctggccttcgcccgcaccggcagctttgaaatcgaagtggagggttggctgggtaacgccggcaaagaagccgcgaccggcccggaaatggccaagctgccgccagaaaaggtcgtatgcatctacggcgcggaagaagtcgatgagagtggctgcaccgacaagactgcggtgggcgaagccatgaagctgccgggcgggcaccacttcgatgaaaactacccggcgctggccaagcgcttggtggacattatcgtcaagcaccagggcaaaaccgagtagctccagggctgtacacaaaaccaaatgtgggagggggcttgctcccgatagcggtggatcagtcatacatcattgactgacaccctgctatcgggagcaagccccctcccacatttgttttgtattgtcagtaatatctagcgcggttcgatgtgggcaatcatcagctgtacagtctcattgccgcgaaactcgtttacatccagcttataagccaactctacccaccgcacggtcgggttcggccacacctcgcggtccacgccaaaggcgataccatcgagcttcactgacccgcattcgctcttgagcaccaccttcaggtgccgctcccccactacccgctgctccaccaactgaaacacaccatgaaacaacggctcgggaaagtgctgcccccatgggccggcatggcgcagggcgcgggccagctccaggtggaactcttccacggccaaggtgccgtcggagagcaggcggccggtgaggtcctcttcacgcagctgccgacgcacttcggcatcgaaggcttcggcaaacagtgggaagttcgcttcgggcaaggtcagccccgccgccatggcgtgaccgccgtatttggtgatcaggttgggatgttggctggcaacgaccgccagtgcatcgcgaatatgaaagccttgcaccgagcggccagagcccttgagcaggccatcgcctgcatcggcgaaagcgatggtcgggcggaaatagcgctccttcatgcgcgacgcgaggatgccgattaccccttggtgccactccgggtcgaacaggcacaagccgtacggcatcgactccaccggcaagtccttgagctgggccagggcctcgcgctgcatgccttgttcgatggatttgcggtcttgattcatgccgtccagttgcgcggccatttcccgtgcggcggcaacgtcggtagtgagcaggcattcgatgcccaggctcatatcatccaggcgcccggccgcattcagacgcgggccgaggataaaacccaggtcggtggaggtgatacgggcatgatcgcgcttggctacttcgaggatcgccttgatcccgggtcgcgcccgacccgcacggatacgctccaggccctgatggacgaggatgcggttgttggcgtccagcggcaccacgtcggcgacactgcccagggccaccaggtcgagcagttcaccgatgttcggctgtgggctgttgtcataccagcccaagctgcgcaaacgcgcacgcaaggccatcagcacgtagaaaatcaccccgaccccggccagggccttgctgggaaacccgcagcccggctggttcggattgacgatggcgtccgccgccggcagttcatcgcccggcaggtgatggtcggtcaccagcacttttaatcccgccgcctttgccgccgccacgccttcgacgctggagataccgttgtccacggtgatcagcaactgcggttcgcgttgcagcgccaccgcgacaatctccggggtcaggccgtagccgtattcgaagcggttgggcaccaggtagtcgacatgggccgccccgagcaagcgcaggcccagggtgcccacggtgctcgccgtggcgccatcagcgtcgaagtcaccgacgatcaggatgcgctggcgctgctccagggcggtcaccagcaagtccaccgccgcatcgatgcccttgagctgctggtagggaatcaatcgcgccagactcttgtccagttcggcttccgattgcaccccgcgtgcggcgtagagacgggtcaacagcggcggcaattcaccgaggaatggcaagacggcgggcaatgggcggggatcgatacgcatacggtggtgataacttctctttaataattgtaggagcgagcttgctcgcgaaggtggttaacgatgacgcgggatgtctgggtgatcgcggtgcccggaggtttttcgcgagcaagctcgctcctacagggagccgtgctcagccacgattcaaccgcgctcgccaaccagccattgcagttgcacttcatgctggccacggtcgtcggtcacgaagatcgtgccttcactgatcatcacgtcccacttaatcacccgcggcatgtcctttgccagggtctcgagcacctcctggggcacggcagcgatgtgcacgttcttcaggttgttggccaccggcaccaccttgccttcccaaacacgcaggctgccataggccagcaggctggtgcgttcggtgcggcgcgaacaccaggtcaggcggtcggcatccggctggccgacttcgatccagtgcaaaacccgatcatccaggcttttttcccacagggccggctcgtctacatctgacaggccacgcccgaacgccaactgctcgttgtaccaaagggcgtaggccagcagacgcacggtcatgcgctcttcggtttccgaagggtggcgggcgatggtctgtttgacgctctcatacaccgagcggtcgaggtcggtgaggttgagttcgaatttgtaggtcgtggacggctgggccatgaacgggcttctagagacagggaaaggtggccagtctaaccgatggcggggtcattcaacgaatctgcgctgcatctgctcacctatgttaaaaagcaagacacctccgtcccgtgcttgtaaggatccccatgtcgcttaatgccaaaccccttgccggtctgaaagtcatcgaactgggcacattgattgccggcccattcgcgtcgcggatctgcgctgaattcggtgccgaggtgatcaaggtcgaatcgccggacggcggtgacccgctgcgcaagtggcgcaagctgtatgagggtacctcgttgtggtggttcgtgcaggcgcgtaacaagcagtcgctgaccctcaacctcaagcaccccgatggcctggcgatcctcaagcaactgctggccgacgccgacatcctgatcgaaaacttccgccccggcgtgctggaaaaactcggcctgagctgggaaaccctgcacgcattgaaccccaagctggtgatggtgcggctctcgggcttcggccagaccgggccgatgaaggatcagccggggtttggcgcggtgggcgagtccatggggggcttgcgctatatcaccggcttcgaggaccgcccgcccgtgcgcaccgggatctccatcggcgactcgattgccgcgctgtgggcggtgatcggtgcgttgatggcgctgcgtcatcgcgaagtcaacggcggcctgggccaggtggtggatgtggcgttgtatgaagccatcttcgccatgatggaaagcatgatccccgagttcgacgtattcgggtttattcgcgaacgcaccggcaacatcatgcccggcatcaccccctcctcgatccacaccagtgcggacggcaagcatgtgcagatcggcgccaacggcgatgcgattttcaaacgcttcatggccaccatcgggcgtgacgacttggcgaatgacccacagttggccagcaatgacgggcgagacctgcgccgcgacgagctgtacggcgtgatcgaccgctgggtcaattcgctgccgctggaccaggtggttgagcaactgaacaaggccgaggtgcccgccagccgcatctacagcgccgaagacatgctgggcgacccgcaattcctggcccgggaaatgttcctcaaggcgcaacttccaggcggcaaggacttcaagatgccgggcatagtgcccaagctctcggatacaccgggcagctgcgaatgggtcgggccgcaattgggtgaacacaacagcgtggtgctcaatgccctgggctacgacgcggcggctattacccgcctgcgtgagaatggtgcgatctgaaagtcgcgggcaaaaagaaaccccgagcagtggggagacaactcggggttaaacgtggcctacaaaaaaggcccgcacagcaagcaacaaacaccggagcacaatgattgctcttgctgataccaactctgactgaccgccccgtaggaaggttccgaagaaaaataatgtttcacgccagtgcgccgccacgggtctgggcggcgttgcgcaaggctgcaatgaccgagggttccagacgcccttcggcgatcttcaggtcgcgaagcaggcaatccaccacatctaccaacgcacgtttatcgatcaactgcccacggtcgacttcacgttcaaccacaatggcgccaccgggattcttcacggttaccaggcagtcgtcccgcacaccagaagtggtcagcgtaacctgataagggctcagtgcctcactgagcaataggttgatactttccatctcgatcaccactcaatcattcgaaaaaggttcgaaaaacaaaaatgtcacgaagatgctgacattcaagtgacccctgctcaaagcagaaagttctaccttttgtgtaatccgctgcttgagggaaacgagcatgcacggaaaacatgacagagaaaaaacacccgctcacaggctagaatccctgaattagcctgggagcctgccttgagagccgcgtctgaaacacctttgcgcgtcgtcattgccgacgatcatccgattttcctgattggcctgcgcgccgtgctcgagcgcgacccgcacctcagcatcgtcggcgaggcgaactcaccccaggctctcagtgcgttgctgcaacactgtgcctgcgatgtgctggtgaccgacttcatgatgcccgccgaaccggaggccgacgggttgcgcctgatcgagcaactgcgccggcaccatccgaacctgcccgttgtggtggtgaccatgctcaataacgccgggctgtttcattccatcctggcgttgggcgtcatgggcctgctgagcaaggccagcctggccgatgaactgccgcaggcaatccgccaagtgcgccagcaacgcacctatgtggcccagaccattcgccaggcgctgagcctggccggagaagtcggcgctgatcgcctgcactcccgggaacagctgtcaccccgggagctggaggtgattcgcctgttggccagtggcatgaccgtaggcgcgatcgccgcacacctgcatcgcagcaagcagaccgtcagcgcacaaaaagtcagcgccatgcgcaagctggggctgggcaacgatgccgcgttgtttatttatgtacaggaacacgggctggcctagcctgaaatgcgatccattgcttgatcgcctcggcatccatcggtcgggcaatgaagcagccttgcagccacgcggctcccagctcacccacagcgtgatagtcggcgacagtttccacgccagtgaccaccacggcgatgttcagccgcttggccatactcatggcacccgccaccaccgcggccttgcggtcgtcattggccatcccgcaggcaaaggccggggggatcttcagttcggtgaacggcaattccagcaaatgttgcaagctggtgccgcccatgccgaaatcaccgatagataactggcaacccaacatgcgcaggcgcagaaggccggtgacatgcgcgctgtcggttttcaacgtcgaggcttccaccagctccagagtcaggctgtgggcgggcacgccgtgaagttgcagcaagccttgcagcacctggggaaagtgcgctcgctcgagcatgcgcccaggaatgttcaccgctaccggcaacacttggccggtctcgcccatgaccaggttcgcgaggccgagcgcctgttccagcacgtgccaggtaaaggcctcctccatgccggcaaactcgagcaccggcaggaattcatcaggcagcagcagctcgccttccgataactgccaacgcgccagcgcctctacaccttgaagcacaccggcctggctgacgatgggctgataccagaccctgccacacgccgcgatagcgacctggctgatatcggccgacggcggcaactgctcgctgtcgctcaagcccagcaactggcgcacgcgctcccaggacagcaccagtggcccaggacgcaagtgcgcctggcagtcggccaagacttgcccgatcaacgttgccgaggccggcttgggcaggcacgccaataccttgagtcccatctgccgtgccatattcgcaacgccttccaacacatcaggctcggcattactgagcaggaccagcacttgggccagacggcgctcggccaattcgcggatcagctccaggccatcgccctgctccaggtatagatcgcaaatggcgatatccaccgggcctttgctgtccagggattggcgggccgtttcgacattctcggcggtcagtacgttgaacacgccattggcattgagcatctggtgcagtgccatcagttgaaacgggttgtcttctaggatcaggacgttgagagagcgcatgggtcattgagtcggcatcggggcagaggctgacacactactcagatgtcccgcacagccccataggacatgtcttaaatgcggtctcagggatgatcaaatgtgggagagggcctgcccccgctgagcatgggtatctacacaactgtgtagccgccgacggtaactacgatgcgcagcgagccgcccttgatcttgcttttgatcttaggcgccccgttaaaccacgctggccgtaagggcggaacccataaacgccgttacctaaataacggatatgtactcggtctgatccaacatcctggtcggctctcagaccgccatcgggagcaagccccctcccacacttggatcgcggtgcatcagtcatatagctataagctgccagggagcagcagcgcaccaaagttgtgtagatccctatgcctcgatgagggagtgtcagcaagcacatctgtgactgagccgccgccattgggggcaaaccccctcccacattgcatcgcgtcggcagtcaatccagatagggctgcaggtcgcgacgaaacactttcaacgcctcggacaacttcaaccaaggctcctccagctcagcgccgcgctgctctcgtgcacatttttccagggccatgcacgccttggccagtggcagggcatccaccagcgagcaaatacccttgagccggtgcagcgccgcattcaggcgcgcaacgtcacgctcggccagggcgctcgccaatacctcatgttcgtgatccaggctctttgccagttcctgcaacatgctgtgcagcaccggcccgtcggcctgggtcatggtgcgcaaggcctggatgtcgaacgagcgctgcgacgccacgcgggccagcacacgggtccagtgctccagggtcacaggcttgaccagcagctcatccatgccagcctcctcgcagcgttgtagctcatcgttcatggcgttcgcggtacaaccgattacggcgcaacgggaccgttgttgcccggcttcgatgcgccggatcgcctcgctcaaggcatacccggacatgcccggcatctggcaatcggtcaccaccacgtcgaaatgttgctcacgccaacgttgcaacgcggcgtcggctgaatccaatgcaatcacctgatgcccgaggaactgcaactgctgggccagcaccaggcgattggccgccaggtcatcgaccaccagcaccgagaggctgcgccccaggggtggcaacgttgcggtcggcgtcgccggcacatcatcggtgctgacccgatccaggcgcaggtcaatgcacaccaccgtgccctcgcccaccacgctgtcgaggtgaatgcgcccgcccatcaactccaccaattgcttgcagatactcaggcccaacccggtaccgccatgttccgccgtggtcaatgcgctcacctgggtaaacggcttgaacacacgcggctgctgctcggcgctgatccccgggccgctgtcctcgacgcaaaggtgcagatgctcggcgtcgttctcatcgcgctggcaactgacactgaggcgaaccccgccccgctcggtaaacttcaacgcgttgcccaacaggttgtgcatgacctggcgcaagcgcagcgggtcgaaccagtaatagccctgggcggccggatcaaatgccagggtcaaatgcagaccctttttttgtgccgtagcttcgaacaggcgctggatgccttcaaaaaagcccttcaactcgacggtctgcggaaccagttgcaggtgaccggcctcgatcttggccaggtccaggctgtcacccatcaaggcgatcagctcccgtgccgaacgatgggccacctgcagcgcttcagacaccgcctggccgcttgccaggcagcgctcttgttccagctcgagcaaaccaatgatggcggtcatgggtgtacgaatctcgtggctcaaggaggagagaaacgcacttttggcgtagttcgcttcgtcggcggcctggcgggcattcatcagttggtgctccaggtctttgcgttcgctgatgtcgatccaaccgcccagcagcccctgcaagcggccctgggcgtcgaagaagggcacggtccactggtagacgtgcaagctgccgccgttgaactccagctgccgatcaacaaacaacggctgttgcgtggccagttgttccatgtgtcctgcgtgcaggcgcgccgccgtggcttcgggcatgaccctgctctccatcagcgtgaggccctggatcagctccagccgggtcgccagttgctgttcataactcttgttgcaggtcatcagccgcccggccaggtcgcggacgaacaacggattgggcatgccatcgagcaaggcgcgcttgaacgccaattggtcattgaggcgctgctcggcttccagccgctggcggatctggcgcttgagccggctgttccacaccagcgacaccagcacaaacaatagcgccgtggccaccgtccaataagcccatggcggcacccgctgccaggccggcaacggaatcgccacggcgccgatccaacgcaggcgcaacgcgctcaactcggccaccggcaaggcctccagggctttgttcaggatgctcaacagctcaggctgatccttgcgcaccgacaggcagtttgacgaccacttgccatcgacactgcggccgattcgcaaaccgtcctcggtataactctgcacctccacttcggtctgcacggtggcggccgcttcaccccgttgcaccaactcacgggcctgggcgtaattgtccaccagccgcagctcgatccgggggtacatctggcggatatcattctccagcacatggcgcgccggcagcgccaggaccttgccctccaactgcttcaaaccggtcagcggcgccgtatcggcgcgttcgacaaacacccagccggagccgccaaaaccgtggctgaagtcgagcaacgccctgcgttcctgattcgccgccagggtggtgttcatctgcgccctgcccgtttccagccactccagggtttgcgcggtggaatgcacttcttcgatgacaaactgcaaaccggtcatgcgcgaaatgcgatgcaacaggtcgacgttcaagcccacccagtgaccgtccttgtccttgaatatgtagggcgacatctgttgggccactaccacgacatggggatgctgcaataaccaagtgcgttccgaggccgacagctcaacacgctcgccgctgaaaccgacgccgagcccggtggtccagcgtgcgaggatttcgcgctgcaccgactcatcgatactcgccagggcacggttcatcatcgcccccagcaacggctcggccgcacgggtggcgaaggcaaaaccgatgggggccagccggctctgctccttgatctgcaagcccagataaggccgcagcgacttataggcccgaacaatcacttcattgccgataaacgcatcggcatcgccttgcttgagtgcttccaggccgctgtaaaggttgggagcaagcatgatgtggctatcagggtaagccgcctgcacgttatgcacattggcgtagccgtcgagcaacaccactttcttgcccgccagatcgtcgtcttgaaactcgtcacgacgcaacaccaccacggattgatcgggcatgtagtcctgggtgaagtgcaacccggggacatcgcgttcatagccattggcgctggtcaggatatcgatggccccactgcgcagcgcctcaaccgcctgggcccgctcggcaaagcccagtacctgcatgggcacctgcaaccgagcaccgaccaggctcaggtaatcggcactgatgccctggtagcgattgcggtcgcgggtgatatcaatcggctggtagtcatcaatggaaatgcccaccttcaatggtcggtgcgtcgccagccactgctgctcggcgggcgccaggggcaacggctcaagggggataaatgccggcaccagtttgaagggcaggctcacggccgccaggcctgccggtatttgggtaagccacagcatgcatatcagccgccatgtccattggatcaaaacctgcaccgattggatttccttgattgggcaagtgagcaagtatggctcgccaaaataaaaaagcccgtcacgaggacgggcttggccgactgcaaaagcgatatttgccggatgaattcggatcaaatgtgagaggaacagcagatagatgcctctcaatattcaggccgaactatcgatcagagcggcttgccgcgattaccgtgctggctgacaaacgcctgcacagccttcaggtcgttagccagcacggtgcagcgctcttcacgctcgaacaggtcgaccaagtgctctggcaattccaaggccttgccaacaccggccttctccaccgcttcggggaatttcaccgggtgcgcagtgccgaggatcaccatcgggatgtccaggctgcggcggcattcgcgggcggccttcacaccgattgccgtgtgcgggtcgagcacttcgccggtctgggcatagacctcagcaatggtttcgcaagtctgcgcatcgtccacggccagggagtcgaacagcttgcgggtttcggtccagcgttcctcatcaacgctgaaaccgccaccttgcttgaagctgctcatcagttcggccagggccgcgccgttgcgaccgtgcatgtcgaacagcaggcgttcgaagttcgacgacaccatgatgtccatggacggcgacagcgtggcgtgcagggtttccttgacgtactggttgccgctcatgaagcggtgcaggatgtcgttgcggttggtggcgacgatcagctggttgatcggcaggcccatgttgcgcgccaggtaaccggcgaagatgtcgccgaagttgccggtgggtaccgagaacgacaccgaacgcgctgggccgcccagttgcagggaggcgtggaagtagtagacgatctgggccatgatccgcgcccagttgatcgagttcactgccaccaggcgggtgcccttgaggaaactctggtcagcgaagctgttcttgaccatttcctggcagtcgtcgaagttgccttcgatggcgatgttgtggatgttctcaccgaagatggtggtcatctgccggcgctgcacctccgacacgcgcttgtgcgggtgcaggatgaagatgtcgacgttttcgcagtgcttgcacccttcgatggccgccgagccggtatcaccggaagtggcgccgatgatcaccacgcgttcgccgcgcttctccagtacataatcgagcaaacgccccagcaattgcagggcgaagtccttgaacgccagggtcgggccgtggaacagttcaaggacccactcgttgccgttcagttggcgcaagggtgcgatggcgttgtgggaaaacacgccgtacgtctcttccaggatcttcttgaaatccgcatccggaatgctgccggtaacgaacgggcgcatcacccggaacgccagctcgtggtacggcaggccggcccaggaagcgatttcttcctgggtgaagcgcggcaggttttccggcacgtacaggccgccgtcggtggcaaggcctgccagcaggacgtcttcgaaattcagggccggtgcctggccgcgggtgctgatgtaacgcatgactggctcctctaaaacattctcgaacagaggccgccaaacagtcggggcccctggaacaatcggttagttcaggtgttcgactcgaatacgcaccaccgggccaaccacaccttgcagggcttccagggcgtggatggcatcgttgatatgctgctcgagcacgcggtgggtcagcaggatcatcggcacctggccgttttgctcctcgacttccttctgcatgatcgactcgatattgatgccgcgctccgacaggatgctcgccacctgggccagcacgccgggatgatcctgggcctggatgcgcaggtagtaggcgctttcgcaggcttcgatcggcaaaatcggatgggccgacagcgagtccggctggaaggccaggtgcggtacgcggttttccgggtcgctggtcatagcgcggaccacgtccaccaggtcggcgatcaccgacgaggcggtcggctccatgccggcgccggcgccgtagaacagggtggagccggcggcgtcgccgttgaccatcaccgcattcatcacgccattgacgttggcgatcaggcggtcggccgggatcagcgtcgggtgcacacgcaactcgatgcctgccggggtgctgcgcgccacgcccaggtgcttgatgcggtagcccagggcttcggcgtagttcacgtcggcagtggtcagcttggtgatgccttcggtgtaggccttgtcgaactgcagcgggataccaaaggcaatggaggccaggatggtgagcttgtgcgctgcgtcgatgccttccacgtcaaaggtcgggtcggcctcggcgtaacccagggcctgggcttcggccagtacgtcttcgaaggtacggcccttctcgcgcatttcggtgaggatgaagttgccggtgccgttgatgatgccggccacccagttgatacggttggcagacaggccttcacggatcgccttgatcaccgggataccaccggccaccgcggcttcgaacgcgacaatcacgcctttttcgcgggccttggcgaagatctcgttgccatgcacggcgatcagcgccttgttggcggtgaccacgtgcttgccgttctcgatggccttgagcaccagctcgcgggccacggtatagccgcccaccagttcgatgacgatatcgatttcagggttggtggctacggcgaagacatcgttggtaatcgcaataccggtcgtttcgtactgaggctttggcgaacgcgtggcaatttgcgccacttcaatcccacgccctgcacggcgggaaatttcttcagcgttacgctgaagtacgttgaaggtaccgccaccgacggtccctaacccacagatgcctactttgaccggtttcactgaagaactccccatgaaacggccgacgctaggtcggccgtgaaaacagccgcacaactgcggctctcaattaatgacccgtcgacagttcggcgggtcatgatcgtcaaaggctcgacgattaatgcttacttggcacccagtgccagtttggcaacttgcggcgccggctggtagcccggaatcacctggccgtcggccaaaacgatggccggtgtaccgttcacaccaatggactggccgagggcgaactgcttggaaaccgggttggcgcatttggccgccttgatttccttgccatcgaccatcttgtccatggccgctttcttgtcggccgagcaccatacggcttgcaactgctcgtcacccggcgaacccaggccctggcgcgggaacgctacatagcgcacttccacacccagcttgttcagtgccggtatctcggcgtgcagcttgtggcagtacgggcaggtggtgtcggtgaacacggtgatgtgggtcttggtctcgccgatggccgggtacaccacggtttcagccaccgggataccgttgatcagcttggacacgcccaggcgctcggccttctcggtcaggttgaccggcttgccgtccttgagctggaacaggtagccctgcacgatgtactggccatcggcactggcatacagcacacggctgcccttgagcttgacttcatacaggccggccatggggctggcgctgatgctttcgatcggggtgtcgagcgccaggttggccaggctcttgcgaatggtctgctcggccgcatcatcggcgacagcaaaggtggaaaccaacgcaatggctgcggcggcaataatctgggtcaaacgcatgggaactcctgaaggcagaggcagggacgggagcagaatatcgatctggaacccaactcgggtcgtcccctttgcgaaccggcaaagcctaccacagttgggccggggggcagacacagctaaagaattgaagctgctccctgcgcacagatagatcaatgcatgaagtgtctgtaaggcttttctagcaagcacatcagaccattcctgatttaagaaggccccacaattgtttgtgccaggtcgttagcctcctctgagcaacgggtcatacccacgcagaatgggggattaagagaaatggatgcttggcattacataccgtcatggaaacagattgaagatagccttcttagccacttccccagccatcgacaaactcagcattctacccaagcatcactcggtggcagctataagcaacaaatgttcaatccaagacttatcccacagcgcatccaatgagttaaccaagcgttttttttcgcccgctcagagacaatacggaacctgcaaggtcgcttcgcagatattgatttaaatgcggtcattgacgacctgatccgcaccgtagccgatatggcaatgatcctggttggcgctacattagccggtgctgctatcggtggcgggatcggggcattgggttttggtgcaggcgcgctcccgggtgcgacggtcggggctggcctgggcgcacaggcgggtacttggatactggcgattgtggggcttcaatccatcgccgagttttttctagatggtctgcccgacattattgagcagtacttgcgaggcatcacaattgcttgggaaagcccccgcgattcggcaaccggtctactcggagacatgggggcgggcttcgaatacagcggtgtgcatcatgcagctactgaaatcgccagcgcccacaccgccgtcattcttttgctattaagcgcgatggttgcttatctgacccgaggacggggtgaggcgacactactcgccagccaaatgagcaatagccgccgcggaagccgcttggcacagtggatgctcaagcatgaagaacgattgaagcagcatccagacttgcagccgcgtgaaccacgtaggggtgtatttgggccacaggaacagttgacgccttctcgtcgcgagaataccaatcagccgctacctaaacccagggtcatgccgctcgtcaaagtaccctgctttaacgcctccaatatgccgtcctcaaagattccggaatttgatcggcaattggcaggacaggaaaaggggcttaacaatctgacggtggcggaatatcttaaagcgcgcgatgcgttcaaagatcggctcaatgtacgtgatccaaaaatcgccaaacaggcccgtgtagacattcaaaataattttcaaagtgaattattcgagaaatttcgttcggagggcctgtcacccgctagcgctatgtcaaaggcaacagaaattgcgcgcgacaaaatgaaaaaattagccgctcttcataatccggatctttattcaggaggcatggatgttattggggactttggtgatcgacaagtaaattcaagtattggagctcgatggcgaagtagggtttctgaattggataaggttgcgggtagtattgcccaagtagagcaggagcgcacaaaaatcaatactcagttaaaacggtgtaaataggtgaattatggatgaagatttcgacttttttctaagtactttcggtcccggttatgatcgacggtatgtccccccctcgaccatcgaccggtatagggggaaattacccgaccaactattaacctattggaaaacctatggatggtgtgggtatgcagaaggggctttctggaccgtaaatccacaagaatatgaaactgttgtcggtgattggcttaaaggaacaaagctagggggtggcgatgtgtatcatgtcattgctcgaagcgcttttggcactttgtacttgtggggggagcagtcaggatattctctaaaaatatcctcggtagatgcctattacattcgtcgagtgccaatttctaaaggtgaccagtttgattttggtgtacggtgtttttttagtggcctgactgttaaaagtaatgactacgaaaatttgtttgatgccgcgaaaaataaattaggcagactgcacgaaggggaaatgtacggatttacaccgactcttgcattaggcggtcaaagcacacttgcaaggatagaaaaacttagcgctattgaacacctgacttttttatctcaggcgtccgagttagaggagctgatagttccaaaaatataattttttcagtttcagatacattcagtgcgcaaggtaaatcgcctatttcaaaaacagcacttttggtgtcgcaggaaaaagaaaaaactccggccaaactgatgcgcaatctgccaggaagggcggtggagctaatttcaactgatgcctgctcctacaggggtgaggcttggttgcttcaggccacaaattatctcgcagagtggcaagccacctggcggttatccaactgccgcaacaacggctcctcggcgctgcaccgctcggccgcaaatcaatgcacctctgtatcgctgtaaataaggagggaaatatggatgatgcgtttgcgtgcttcctggaagaatttggcccaagcgtcgataaaacagaggtttcagactaaaccttgaacttctacaagaacaaacttccaagtcagttattaaagtattggaaaatgtagggttggtgcggctatgctgacggactgtttttgaccgtcaaccccggtccctatgaggcagtattaagcaattggctcaaggaaacaaaactttcaaaaacagataactatcatgttatcgccatcagcgcattcggcaacttgtctctttggggcgaaactactggggactcactcaccatttccagttcggtagcgcattattcatccacccccccgtttttttcggtgaccgaatagacatcggcgtcaaaaactttttcgcatccaatatatttcaacatgcactaaaaaatagggcgtctgaaccatggtgagctatatggctttgttcctgcattagcattgggaagccaaagtactattaaccacttggaaaaagtcaactctgtagagcatctcatttttctctcccaactttgcgagcgacgagaatgggagttcccacccgaataatattgtgcgccatgtcagccgcgggggtgatgcttggcgtgcatgtcctgcaaacgtgcgcgggccacatgggtatagatctgcgtggtggataagtcgctgtgaccgagcagcatttgaaccacacgcaaatcggcgccgtggttgagcaaatgggtagcgaatgcatggcgcaaggtgtggggcgacagggccttgccgattccagccactttggcctggtgcttgatgcggtgccagaaggtctggcgggtcatctgctcgccgcgcaggctggggaacagcacatcactggggcgcccaccgagcaattcgtggcgcgcatcgcgcatgtagcgttcgacccacacgatcgcttcctcacccatgggcaccagccgctccttgctgcccttacccatcacccgcagcacgccctggcgcaggttgacttgctccagggtcaggctgatcagctcggtcacacgtaggccgcaggcgtacaacacttccagcatggcgcggtcgcgttggccgatggcttcactgagatccggcgcagccaacagagcatccacgtcagcttccgacaaagatttaggaagaggcctacctaattgcggcatatcgatttgtagagtgggatcggtcgcaatgagcttttcccgcagcaggtagcggtaaaagccgcgcacgccggaaaggaatcgtgcagtagagcgtggtttatagttctgctccaggcgccaggccaagtgatcgaggatcaactcgcgcccggcgttgatcagctcaaggtttttttcctgcaaccagccattgaacagggccagatcactgcggtaggcctggcgcgtgttgtccgacaggcctttttccagccagagggcgtcgaggaagcggtcgatcaaagggtggtcgatggcgggcatgggtactcaagctacgcagcacggggctttgcgcaaattatttagtgaactgtggcaagggtcgctagtctttcatagcccgctacttcaaggaacaggaagcttcaatgaatgaacaacagattttgctggcctttggcggcattggagtggcggcattgggttgccaatggctggcgtggcggctcaagttgccggcgatcctgtttctgttattgacgggtattttggcggggccggtactgggctggctcgacccgcaggagatgttcggccctctgttaatgccgttggtgtccctggccgtggcgttgatcctgttcgaaggcagcctgaccctgcacctgtcggaatggaaggaaatcggcagcgtggtgcatcgcctggtcacggtcggtgccctgtcgacttgggcggtgatcaccctggccactcactggctgttgggctttgactggatgctcgcgctgctgttcggcacgctgaccctggtgaccgggccgaccgtgatcgtgccgatgctgcgcgtggtacgccccaaagcctccatcgccaatatcctgcgctgggaaggcatcgtcatcgacccgatcggcgcgctgctggcggtagtggtctacagcttcatcattgcccgggcttcgggcgacggcttgagccatagcctgctgacctttggcggcgtcatcctctgcggtagcctgttcgggatcgccggcggctgggtactggggcagatcatgcgccgccagtggttgccggaatacctgcataacttggcgacgctggcgggtgtgctgggcatcttcattgccgccaaccaggtgatgcatgagtccggcctgctggcggtcacgctgatgggcatgtggatggcgaacatgaagggtgtggatgtaagacacatcctgcacttcaaagaaaacctcagtgtgctgctgatttccgggctgttcatcctgttggcggcgcgcctggacctgaatgccttgatcgccctgggtccattcgtgctgattctgctggtgatcatccagtttattgcccgcccgctgaacgtggcgctctcgaccttcggctccggactgaactggcgcgagcgtgcactgctggcctggatcgcgccacggggcattgtggcggcggcggtgtcggcgatctttgcgatccgcctggatgaggcgggtcatgaaggcgcgttattgctggtgccgcttaccttcgcggtgattatcggcaccgtggtgctgcaaagtgccacggcgcgccccttggcgcgcttgctcaaagtcgccgagccagcgcccagcggtttcctgatcgtcggcgcaaacggcccggcgcgggcactcggcaaggcattgcagcaattgggcagccgggtgttgctgacagattcaagctgggaaaacatccgcgccagtcgcatggagggcctgccgacttacttcggtaaccctgcctcccaacatgccgagtcgcatctggacctggtcggcctggggcatttgcttgcgctctccccgtccggcgagttgaacgccttggcgaccatgcgttttcgacatgatttcggccagcgattgttcgccctggccagcagccaggagaaccgtcgcaccgacaaacacaaggccagccacgaacaccgcggccacctgttgggcagccaacccctgagctataccaaattggcaagcctgctgggccagggtgccgagctatatagcaccaacctcaccgatggctttggctgggagcagtaccaggcgttgcacggggagcgcgccaccttgctgtttgcccgggacaccagcggctgggtacatgtggtcacgcccgagagcagcctgaagcccgtggccggctggacgctgctggcggtgattcaaccgcaaaacagcaccactgcgtaatcagtcggcaaacccaggcagtaccggtacagggcgtttgtccgcgtcaatcgcgacaaagctgaacacgccctggatcgccttttcacggccatcagcgctcatgctctcgacaaacacttccacttcaaccttgaggctggtgttgccgactttgatcactcggccgatcagctcaacaatggagccggccgggattgcgtgattgaagtcgatacggtcggtggagaccgtcaccaacggcaagcgacagaagcgcgtggcggcgatgaacgacacttcgtccatccatgccaaggcggtgccgccgaacagggtgttgtggtggttggtagtcggcgggaacacggccttggtcacgtgggtaacggacaggtcggtgcggcgctggatttcttcgaggcgggtggtcatggacaaataccggcagatagacaaatttcaggcacaaaaaagcagcccgtaggctgcttttttctgcatcgggaagctggacttaagccagtttttccttgatgcgagctgctttaccggacaggtcacgcaggtagtacagcttggctttacgtacgtcaccgcgacgcttaacggccatgctgtcgatttgcgggctgtaggtctggaaagtacgctctacgccaacaccgttggagattttacgaacagtgaaagcactgttcacaccacggttacgcttggcgattaccacgccttcgaacgcttgcagacgcgaacggtcgccttccttcactttcacctgaacgacaatggtgtcgcccggggcaaaggtagggatctctttggtcatctgctctgcttcgagtgcaaggatgattttgttagtcatgctgtgctcctaaggtaagtcaatggacctaccatcgatacgttgttaactatcgtcccgcgcgaggatgtattcctcgagcagcttcttctcttctccagaaagcgagcggctttccagaagatcggcgcgtcgttcataggtccgaccaagggactgctgtaaacgccaacgccggatgtgtgcgtgattgccacttagcaatacgtcgggaacacgctgatccgcatacacctccggtcgggtgtagtgcgggcaatccagcaaaccatccgtgaaggaatcttcctccgcagagtccacatgccctaaagctccaggcagcagtcgtgtaaccgcatctatcaggaccattgccggcagctcgccgccagacaatacatagtccccaatcgaccactcttcatcgacatgagcttcaataaaacgctcgtcaatgccttcatagcgaccggcaatcaggatcaaactttcctcattcgccagttcgcgtaccgccgcctgtttcagctgacggccttgaggggacaggtaaatcaccttcgccttctccccggcggctgccttggcctgaaccaacgcatcttccaggggcttgatcttcatcaccatgcccgggccaccgccaaatgggcggtcatccacagtgtgatgtcgatccgtcgtgtagtctcgcgggttccaacaggtaagctgcaacagcccctgtttcaccgcccgactggtgatgccgtactcgctgatggcggaaaacatctcgggaaacaaactgatcacttcaatgcgcaaattagccacgcttagaagtccgcgtcccattccaccttcatctcgcccgctgccaggtcgacggccaacacgcattgctcggtatagggcaacaggcgttcgcgatcatccaggctgccagcgcaaggcttgaccaccattacatcattggcgccggtttccagaagatggtcgattttccccagcaattgcccgagttgatcgataaccttcagaccttcgagctggtaccagtagtactcgccgtcggtcaattcagggaacaggttgcgcggcacgcagatctcataaccggccagaagacgagcttcttcacgatcatcaagacccttgagcttcgcgaccaggaacttatcgctcccgcgtccactgaccagctcaacctgcttcacactaccctcgcgcttgagcgtccaggtcttgtactgcaacaggttttcagtcggatcagtaaaggaatacaccttcacttcgccgcgaacgccatgaacagagtaaatcttgccgataacgatcaaatcatcagcaacagctggcgtcgcgttcatattgctcaggctgcggccttagccgagtccttcaacagttttgcaacgcgctcggatggctgtgcaccaacgctcagccagtaggctacgcgctcttggttcacggacagacgaacttcttgaccacgagcaacagggttgaagaaaccaacctgttccttgtgcgaaccgtcgcgcgggttgcggctgtcggttacggtcaagtggtaaaacgggcgctttttggagccgccaagggcaagacggattgttagcatgtgaacatcgttcctgtagtcggtgctgcaaatctaaatgcacagcgggcataggtgcccgaaaggccgcatattctaaggaatatccggacttttgcaaatgtctttttctggcgcctagtcagcgtgccactcagatctgctatagagccgtcggttaaaacggcgagtcagcccccgccaacggcgggtttgctggagatcccacatccctgtgggtcggagcaggagtgaactcccgctcgaaacttttacattttcggcataccgccgccgggcaacataccgcccatgccgcgcatcatcttggccataccgcctttggcggagaatttcttcatcatcttctgcatctgcttgtgctgcttgatcaagcgaccgatgtcctgcacctgggtgccggagcccatggcgatccgacgcttgcgcgaaccactgatcagctcagggtcgcggcgctcggccggggtcatggagttgatgatggcttccatctgcttgaactgcttctctgccgcgccttgggcattgcccatctgcgccaggtttacaccaccgatgttcggcagcttgtccatcaggccgccgaggccgcccatgttcttcatctgttgcagctggtcacggaagtcttcgagatcgaagcccttgcccttcttcagcttcttggccagcttgtcggccttgtccttgtccagcgtggcttcggcctgctcgatcaggctgagcacgtcgcccatgccgaggatgcgcgaggcgatacgctcggggtggaacggctcgagcgcgtcgctcttctcgcccataccgatgaacttgatcggtttgccggtgatggcacgcaccgagagcgcagcaccgccacgggcgtcgccgtcgaccttggtgaggatcacgccggtcagcggcagtgcgtcaccaaaggccttggcggtgttggccgcatcctggccggtcatggcatcgaccacgaacagcgtctcgaccgggttgatcgcggcatgcagcgccttgatctcacccatcatctcttcgtcgatgtgcaggcgaccggcggtatcgacgatgaccacgtcgatgaacttgagcttggcttctttaattgccgcgttggcgatgtcgaccggcttctggctcaggtcggacgggaagaaggtcacgcccacttcacctgcgagcatttccaactgcttgatggccgccggacggtacacgtcggccgacaccaccatcacggatttcttcttgcgctctttaaggaagcgcgccagtttgccggcggtggtggttttacctgcgccctgcaaacccgccatcagcacgacggccggtggcacggcactgaggttcaaatcttcgttggccgcgcccatcaggctttcgagttcggcctggacgaccttcacgaaggcctggcccggggtcaggctgcgggacacttcggtgccgaccgcgcgctctttgaccgagttgacgaagtccttcaccaccggcaaggccacgtcggcttccaacaacgccatgcgcacttcacgcagggtgtctttaatattgtcctcggtcagcttggccttgccggtaacgtggcgcagcgtctgcgagagacggtcagtcaagttttcaaacatgcgcgatcctttcaggccctactcatcgaaatgcaggtagaccgaggtaatggcggcccaggctgtagtcaatcgctattaaaaacagcgctcaccgagcctgcggcgtgggcaggtcgcggattatagcgaagactgcgcccatgcacacccgctgtctggcccgggagtctttcttgcagcgcaggtgtgtgccaaactcaacgcctttcgggcttgcctaccaggatttatgctccccttgtcacccagtttgctacccagcctcgccgccgccatcttgtatgccgctgcgaccctctatcagggcactcgtctggcccaaggcaccaaagcggacaaacgtctgctcgtcggccttggcgtgctggccctgctggcccatgccgccagcctgttcacccacctgatgaccccggtgggcctgggcctggactttttcagcgccgccagcctgatcgccgcggccgtgatcgcgctgacgctgctggcctgctaccgcattccagtcgagaacctgcttgtgctgctattccccttgggcatgctgacagtgctgctggcgcaattcgcgcccactggcaccgtgcaggtgattgacgaggaaccgggcatccttgcccatatcctgttgtcgatcctcgcctacggcatgttcaccatcgcggtattccaggccctgctcctgctgctgcaggaccaccagctcaagcacaagcacccgtccgggctgatcaagaacttcccgccgctgcaaaccatggaaagcctgctgttcgggttcctgtgggccggctggaccctgctgtcgctgtcgctgatctccggctggctgttcgtcgagaacctgttcgcccagcacctggtgcacaagaccttgctggcgtgcctggcctgggtggtgttcagcgtgttgctgtggggccgcaaccgcctcggctggcgcggccacaaggcaatccgctggaccctggccggtttctgcctgctgatgctggcctatttcggcagcaagctggttcgcgaatacatcctgcatatctgacgagcggcgatcatggacaacttgcccttagggccgatgctcgccgtaattgccctgctggttttatgggcggcgctgtttaccgccatcgaagcagcacaacagcatctgttggccctgcgccccggtacacgccagggcgacaaggcagccgcacgcctgagcttcccgcgccatagcctgattctgtgcaacagcctgtgccgtgccgcggtggtgatcctttgcacgctgctggcaatctatgcctgggcgcagaacggcccatggctgggttggctgatatcctgcgccctgctgctgatactcgccgactacctgccccgcgccctggccacccgccatccacaggcggtgctgggttttggtaacaccctgctgggtgtaccgctgaaaatcctctaccccctggcctggctgctcaatggcatcagcctgttactgctgcgcccgtttgcccgcaaggccggcgtggtgaaacacagcgacgagccgcagccccaccacgacaacgaaccgcagcccgaagccgacgaagaccgcatgcccggcatgcctggtatccacgccctggataacatcaccgtcaacgacatcctggtgccgcgcagcgaagtggacggtatcaacctggatgactcgatcgaggaaatcatcgagcaactgcgcagctcccaacgcactcgcctgccagtgttccatagcgatatcaaccaggtcgaagcagtactcaacacgcgccaggtccagcacctgctgcctgacgccagcctgaccaaagaggcgctgctcgctgcctgccacgaaccttacttcgtccccgaaagcacgccattgcaactgcaactgctgaacttccacaagcagcagcggcgcctgggcatggtggtggacgaatacggcgaagtgctgggcatcgttaccttggaagacattcttgaagagatcgtcggcgaattcgaaagcgaccaggctgtggataacccgcatatcgaagcccagcccgatggccgctacatcatcgacggcgccgcctcgatccgcgaactgaacaagagcctgggctggcacctgcccagcgatggccccaagaccctcaacggcctggtgaccgaagccctggaaaccattccggattgcgcggtgtgcctgaagatcggtcgctatcgcctggaaatcctcgaaaccgaggacaaccgggtgagcaaggtattgatctggcataccagccatgtgccggtggccgcataacttcctgacagcacacatttccaatgccctctgtaggagcgagcttgctcgcgagaaatccgtaggcgccgcgtttattcagaaagcgcgcgttatcgttgacgtttttcgcgagcaagctcgctcctacagaagtcacttgttgtatctccaaaccccttcctataatccctgcggcttacccgagccccgcccgaccgcgtgctacccgcactcagcgcgtccaggcaccgcttcaccttgtccgaccggtgccggttcccatcccgagccgccccgcgcacaaccctgatccatgggtgttcgaccaataataatccgcgtccaaacgcgcaatgaccttcagggatactgccatgagcaccacctaccaagaggccgcgaccgccgcccctaccaattcgaccgcccgtgtcgccacagcgagcatcgtcggcaccgccatcgagttctacgatttctatatctacgccacggctgccgcactggtgatcggcccggtgttctttccccagagctccggtacggcgcagatgctggcctcgttcctgaccttcggcatcgcttttatcgcccgcccgctgggctcggcgttgttcggccacttcggcgaccgtatcgggcgtaaatccacactggtggcctcgctgctgctgatgggcgtgtgcaccaccttgatcggcttgctgccaggctatgacagcatcggcgcctgggcaccgatcctcttgtgcgtattgcgcttcggccagggcctgggccttggcggggaatggggcggcgcggcattgctggcgaccgagaacgcgcccaagggcaagcgcgcctggttcggcatgttcccgcaactgggcccatcgattggctttctggcggccaacggcttgttcctgatcttggccatgagcctggatgacgagcagttccgcagctggggttggcgcattccgttcatcctcagcgctgcactggtgatggtgggcctgtatgcacgcctgaagctgcatgaaaccccagtattcgccaacgccgtcgctaaagaagcagcggtgaaggtgccactggtggaactgttcagccaacattggctgccggtgctgctgggcgctgcgtcgatggtggtgtgctacgcgctgttctacatcaccacggcgttttccctgagctacggcgtttccacactgggctacagccgcgagacgttcctcggcttactgtgctttgccgtgctgttcatgggcttggcgacgccgctggcagcgctggccagtgatcgttatggacgtaagccggtgctgatcgttggggcgatcctggcgattctctcgggctttaccatggagccactgctgacccacggctcgacctgggccgtggcgctgttcctggctttggagctgtttctgatgggtgtgaccttcgcaccgatgggtgccctgctgccggagttgttcccgacgcgtgtgcgttataccggtgcttcggcggcgtataacctgggtgggattgtcggggcgtctgcagcacctttcttcgcgaccaagctggtggcgatgggtgggctcagttatgtcggagggtatgtgtcggcggcagcgttgttgagtttgattgcggtgctgtgcctgaaagagacgcgggataatgatttgaacaaggtcgccggataaaccgctatcgggagcaagccgcctcccacattcgaccgcattccagaagttatacgcggttaaatgtgggagggggcttgctcccgatgcttttagagctctacaacaaccgcttgggaggcccgggtcgccttggcacgagccgcttcaatcgactcatcccgcgccaacgccacacccatgcggcgctggccgttgacctctggcttgccaaacagacgcaacgccgtgtccggctcgctcaatgcaacgccgaggttggcaaacgccgtctgggtcgactgcccctctaccaggatcaccgccgatgccgaaggcccgaactgacggatcaacgggatcggcaagcccaggatggcgcgagcgtgcagcgcgaactgcgacaggtcctgagaaatcagtgtgaccaaaccggtgtcatgtgggcgcggcgacacttcgctgaaccacacctgatcgcccttgatgaacaactccacaccaaacaggccacggccacccagggcttcggtcactgccttggcaacgcgctcggattcggccaaggcaatcgggctcatggcctgaggctgccaggattcctgatagtcgcccttctcctgacggtggccaaccggcgcgcagaaggtggtaccgccaatgtggcgcacggtcagcagggtgatttcgtagtcgaaatcgataaagccctcgatgattacccggcctttaccggcacgcccgccttcctgggcgtaatcccaggctttctgcacatcatcggtgctgcgcagcaggctctgacccttgcccgacgaactcatcaccggcttgaccacgcaggggaagcccaggtcctggacggccttgctgtagtcttcgaaggtgtcggcgaagtggtacggcgaggtcggcagatccagttcttcggcggccaggcgacggatgccctcacggttcatggtcaacgacgtggcgcgggcggtcgggataaccgtgaagccttcagcctccagttccaccagagtggcggtggcgatggcttcgatttccggcacgatgaagtgcggcttctccgcctcgatgactgcacgcagcgccgcaccgtcgagcatgttgatcacgtggctacggtgcgccacctgcatggccggcgcgttggcgtagcgatccacggcaatcacttcaacgcccaggcgttgcagttcgattaccacttccttgcccagctcaccgcagccacacagcaaaacgcgggtcgcggttggcgacaatggagttccgattcgggtcatctcaggtcctcaggggagcggatcatggggagaaaggccggcattttacatgaactgcaagaattggcctcaggtggcgacggcacgcttgcgcaggcgccaagccatgatcaaccacaccaccgtgaccccggcgaacttcgacaccagcgccgtgcccgccaccgccggcgtcagcgcaccgatcaggccgaaaaagataaaggtatcgagggggatgctcagggccgaacttatccacaggcgatcatgcagcgggcgtttggtaatgctgaacaccagccagtcgatgcactcggacaccgcgaacgccgtagcgctggccagggcgatggacggatcggaagtgatatacgacagcaccagcgccgccagcatggcgatgatcgcgccgtggccgaagcgggtttgcaccatgtcgcgaaggataaataccaggccaccccaggcggaccagatcacatccaggtgcggggcggtggaaaaggcgaagttgatcagcacgacgctgctgatgtaggcgatcaggaaaaacatggatgaatgacctgtgaacaaggcacacaggggatacttcacaattagacatatgtcgtctgggagggcctcatcgggggcaagtcgaaccgtcgcaccgcccctcccacattttgatctgtgaacacattcaagtgtgggagggggcttgctcccgatagcaatcgatcaggcacccgagcttttgggcgtcatccacaccatcccactggccaccgcccgctcatgacacaaccccaacaccacccgccgctcggcattatccatgcggctccaacgcgtaatctcgtccacgctacgctggcaaccggtacagatatcgtcctcatccaacgcgcagatactcacgcatggcgaggctacaggccgttcaaccgcactcattcttcctgctcaaccaagtctcgggcatagcgctgcgagttatgcacatagtgcgcggcactggcttcgagcatgcgtttctgcgcctcggtcagctcacgtaccaccttgcccggcgagcccatcaccagcgaaccgtcgggaatttccttaccttcgccgatcagcgaattggcgccgatgatgcaatgtttgccgatcttggcgccgttgaggatcaccgcgttgatgccgatcaggctgtagtctccgacggtgcagccatgcagcatggcgttatggccgatggtcacgccagtgccgagggtcagcgggtagcccatgtcggtgtgcatcacgctgccatcctgcacgttgctgttcttgccgatcaggatcagctcgttatcaccgcgcaacaccgcgttgaaccagacgttggcgccctcctccagcttgaccttgcctaccagcgtggcattcggtgctacccaactgttgggatgggtctcgacacgggcgtcgcccaggcggtatttcatggtttttcctcacggtttgccattcaagcgatggcttagatattgatgaagctcttgggcggctggtgcaggctgatcttggcgtcgtcatagagcagattgatcagctcgacaatcatgatcgccgtcaggccccagatcttatattcgccgaaccggtagctgggcacataccaactgcggccctggtaatcgatccggtgggtatgttcgcgtgggtcctgtcggaaaaactccaggggcacactgaagactgcggcgatttcggcgtcgttggccaggtattcgacgtaatcggggatgacaccgacgtagggcgttacgcggatgccatgcagggaaatcagcgggctcaacggcccgatcacctcgaccagcccgggtggcaggccgatttcttcttcggcctcgcgcaaggcggtgaagatcaggtccgggtcgtcagggtcgcggcgcccgccaggaaaggccacttcgccaccatgggtcgacaggccgctggcgcgcagggtcaggatcagctcaggttcgtcactgcgggtaatcggcaccagtaccgcggcctcggggaaacgcccgtcagtttccaaggtgtgaggggtgtgattgcttacccggcgaagtagctcgtccagcatgagtcatctcggtctgttggctaccttgcatcatgcaccaaagcgtgcgggcgcccaagcccaaaacccggtgcatgtcgcgaaacgacaacttgcaggaacgcccggcaccaagccaagatgtgcccattctccaggaaccccagcatgaatttctgcagccagtgcggtaaaccggttacccaacgtattcccgaaggcgacgcacgcctgcgttttgtgtgtgatcactgttcgaccattcactatcagaaccccaatatcgtcgccggcaccgtgcccgtgtggggcgatcaagtgctgctgtgccgccgtgccatcgagccgcgcctgggttactggaccctgcccgcaggctttatggaaaacggcgagaccgtggaacaggcggccatgcgtgaaaccctggaagaagcctgtgcccgggtgcgtaacctgagcatctataccctgatcgatgtgccgcacatcagccaggtgcacattttctaccgcgccgagctgatcgacctggactttgccgcaggccccgaaagccttgaggtgaagctgttcgatgaagccgatatcccgtggtccgagctggctttccgcacggtcgggcgtaccttagaatgctttttcgctgaccgccggcagcagctgttcccggtgcgcagcgagtcggtgccaccgatggcacgcccagccaaataaccttccaggcagcatctttatcagggataccgtttcaatgcgttggttgcttgttcttatctgcctgtcgttcgccacgctgtcccccgcttccacggtggagaccctcggcggtaaaaccgtcgagaaagtcctggtgctcaagtccgcccaccagttgcaactgatcaacgacggcaagcccctcaagacctatcgcatctccctgggcaagaaccccaagggccacaagctgatcgaaggcgaccgccgcacgcccgaaggtctctactggatcgactggcgcaagaccagcgatcgcttcaacctggccatgcacatctcctacccgaacatcagcgacgccgcccgcgcccgccgcgaaggggtgaaaccgggcagcatgatcatgattcacggcacccccgacacagaagactacccggagcagtggttccacaccctggactggaccgacggctgcatcggcatgcgtaatgtggatatgcgtgaagtctggaacctggtcaaggacggcaccctgatcgagatccggccgtaatctcgtaccgttcgtaaattaattcgaaaataattcctgcctccagcagcgcctgccggtgaataccagttcaccgcgcgggacagtgcacttgtgcgcgacacaaagacctctctaataccacttgataccaagccccattaaagagccctgaaaccggggcttgcaccgttttggtagcattgacatggtatttaagtggtattaatttccggccattaccgggcgacaacactccaataaccgcatcggaaacttcacagatgaaccccatcctgacgctgcgccccgacgacaagcaatccacgccgttgtacctgcaactggcccgcaaccttgaagcggcgatccacgccggccagtggaaatccgagcaggccctgccgtcggaacgcgccctcagcgagcagttgagcatctcgcgggtcaccgcccgcaaagccttggaagtgctgtttgcccagggtttgatccgacgcagccaaggctctggcaccttcatcacaccgcgcctggaacaacccttgtcgcgcttgtcggggttcagcgaaatgctgcggctcaagggctttgttcccacgtcgcagtggctggagcgcgacatcaccccgccgacccacgaagagctgatccgcctgtgcctgtcgcccaccgacaaagtggcgcgcctcaagcgtttgcgcaaagccgatgacacggtgatggcgattgaaatgaccgccatgcccgcctcggtgttgccgcacccgcaagccatcggcaattcgctgtacgaatacctggaaggcatcggcaagcccatcgtgcgcgccctgcaacatatccaggcgatcaacgcctcggacgagttcgccaagctggtgggcatcgcccccggcaccgccatgctgctgatgacccgagtgggctacaccgccgacaacacgccgattgaaatcaccgacacctactgccgcaacgactactacgactttgtcgcagagctgcgtcgccatgactattccgctgaattgcgactctagagaactgcccatgccagaagacaatatcctcacgcccagtggctggattcgcggccgcctggtgcacgagcacggcaaagtggttgccatcgaaggcacgccttgcgacccggctgacaacgacctgccttacctgctgccaggctttatcgacctgcacgtgcacggcggtggcggtgccgacatcatggaaggtgcgcaagcctttgagaccattacccgcacccacgtgcgctttggtaccacctcgctgctggccaccaccatgactgctccggtggatgaaatctcccaggtcctcagtgaactcggcaacttctgcgaacaacgtcctgccggcagtgcgcgggtgctcggtgtgcacctggaaggcccctatatcaacccgggcaaactcggcgcccaacccaacttcgcccacaccgcgttgatggccgaagtcgaagcctatttgcgcctggcgccgatccgggtgatcaccatcgccccggaaatcgccggccacgacgctctgatccgcgccctcagcgaacgcggcgtgcgcatgcagatcggccacaccctgggcagctatgaagaaggcgttgccgccctggccgctggcgccaccagcttcacccacttgtacaacgccatgagcccgctgcatcaccgcgaacccggcatcgtcggcgccgcgctggcccacgcccagtacgccgagctgatcccggacttgctgcatgtgcaccccggcgccatgcgcgtggccttgcgttcgatcccgtgcctgtactgcgtcactgactccaccgccgccgccggtatgcccgacggcgaatacaagctgggcagccacaccgtgaccaaatgcctgggtggcgtacgcctggccgacggcaccctggccggcagcaccctgaccatggaccaggcgctgcgcaacctggtgaaaatcggcctgcccatcagtgaagcctcacagcgcctgtcgcaatttcctgcggactacctgggcctggaagaacgcggccgcctgcaacccggtagctttgccgactgcgtgcgcctggaccgttccctgacactcaccgacgtaatggtcgaaggagacaccattgacttcaaaaatgcttgaagaggccctggcctcctgcgacgccgtcacggcacaactgcaacgcctgaacccgctgctggaagaagtggccggtcgcctgcgtcgccagccgccgcaagtggcgatgaccattgcccgcggcagctccgaccacgccgccagctacttcgcctacctggccatgcagcatgtgggcatcccggtggcgtcgttgccgatgtcggtggtgaccctgttgcaggcaccgatgaaagtcagcggccaagtggcgtttgggttctcccagtcggggcagagcccggacctggtcaacagcctgcgactgctgcgcaagcgcggcgccctgagcatctcgctggtgaacgccgaagactcgccgctggaagccgcctgtgaattccacgtgccactgtgcgccggcccggaacaaagcgtggccgcgaccaagagctttatcgccaccctcagcgccagcgcgcaattgatcggccactggaaccaggaaaccgagttgctccaagcctgccaggcgctgcccgacggtttgcgtgaagccgccaggcaagattggacccaagccatcgaggccctgcgcggctgccagcaattgatggtaatcggccgcggcgccgggtttgcaatcgcccaggaagctgcgctcaagctcaaggaaacctcggcgatccaggccgaagccttcagcagcgccgaggtacgccacgggccgatggccttgatcgacgaaaactacccgctactggtgttcgccccacgcggcgccgagcagcccggcctgttgagcctggccgccgatatgcgccaacgcggcgcccgcgtgctgctggccgcaccggacgatatcgccgaacgcgacctgacccttagtcgcgccgaacacccgagcctggacccgatcctggcgatccagagcttctacgtgatggccgcaggcttggctgaggcacggggcatggacccggaccagccacgccacctgagcaaagtcacccgcacgcactaaagcggcgttttcctgatgagtaccgtgcccatgcccaacaacaataatccattgaccttaagcgcccccttgagtgggccgttgctggccctgaacagcgtccccgacgaagtgttcgccagcggcgccatgggcggcgggattgccatcgacccgttgaacgattgcctgcatgcgccctgtgacggcgtaatcatccatgtcgcccgcaccgggcatgcactcaccatccgcgccgacaacggtgccgaagtgctgatgcacgtgggcatcgacaccgtggagctcaatggcgaaggctttgccttgctggtgaaggatggcgcacgggtgagcgagggccagccgttggtgcagtttgacctggaccgcatagcgcgccagtgcaaaagcctggtgagcctgatcatcctgaccaacagtgaccgcttcgagctgcaacccatcgcgagcaagaccgtgaagctcggtgaatcactgatgcggattgccctgcgcacatccgcaccggttcaaaccgctgtggataactcggtcacgcaagtgagcgccacggtacgcatcacccatcgtggcggcttgcatgcgcgccctgccgcgctgatccgcaagactgcccagggcttcagcagccaatcgcagctgcacttcggtgataagaccgcggcttgcgacagcctgatcggcctgatggggctgggtattggcgaaggtgacgaggtacgggtgacctctcgcggcaaggattgcgaggcggcgttacaggcattggtcgccgcgctgtccgtgacgatccaagaggagcagcacgcgccggtcattgccacaccacgccgggcgaataccgaagccaatgtgctgcaaggcgtatgcgcggcaccgggcctggtatgtgggccattgttccgcatgacgggcatcgaactgccgcaagacagcggcaatcatagcgtcgacgaacaactgcaacgcctggatgccgcccttgagcaagtgcgcggcgaaatccgcaatacgctggaccaggcgcgccaacgcaagaacgtcgaagaagaagagatctttgccgcccacctcgccctgctggaagacccggcattactcgacgcagccaccgctaccatcgaacaaggcagcgccgccacccatgcctggcgtgatgcgatccaggcccaatgcgccgtgctgctggcgttgggcaaaccactgtttgccgagcgcgccaatgacctgcgtgacctgcaacaacgggtgctgcgggcgttgctgggtgaagcctggcatttcgaattgccggcgggggcgatcgtcagcgcccatgagctgacgccctcggacttactgcaactgaacgcgcaacaggcggcaggcatctgcatggccgaaggcggtgcgacctcccatgtggcgattttggcccggggcaaaggcctgccgtgtctcgtcgccctgggcagtgaagtgctcgatgtgcctcaaggccaacgggtggtactcgatgcctccaacggccgcctggaactggcccccagcgaagcgcgtcatgccgaagttcaccagactcgcgaaacgcagaaacagcggcgccaacagcaacagacccaagcccggcaaccggcactcaccaccgacggcgtgacggttgaagtggcggcgaatgtcgcctccagcgccgaagcccaaatggcgtttgacaacggcgccgacggcgtcggcctgctgcgcactgaattcctcttcgtcgaccgccgcactgcgccggatgaacaggagcaacgccaggcctatcaagccgtgctggatgccatgggcgacaagtcggtgatcatccgcaccatcgatgtgggtggcgacaagcagctcgactacctgccgctgcctgtcgaggccaacccggtactgggcctgcgcggtattcgcatggctcaggtgcgcccggaactgctcgaccagcaactgcgcgccctgctgcaagtttcgccgctggcgcgttgccgcatccttctgccgatggtcagtgaggtggatgaattgctgcagattcgccagcgcctggatgaactgtgcgtggagctggagctgacgcagcgccccgagctgggcgtgatgatcgaagtgcccgccgccgcgctgatggccgagcagttggccaagcatgcggacttcttgtccatcggcaccaatgacctgtcccaatacaccttggccatggaccgcgaccacgcaggcctcgccgcccgggtcgatgccctgcacccggcgctgctgcggctgatagcccagacctgcgcgggtgcggcgaaacatgggcgttgggtcggcgtgtgtggcgccctggcgtccgacccactggccacgccggtactggtcggcctgggggtcagcgaactgtcggtgagcgcgccgcagatcggcgaaatcaaggaccgcgtccgccacctggacgcggcgcaatgccggcaactgagccttgagctgctcgacctgagcagcgccaaggccgttcgccaagcctgtcaacaccactggccgctgagctgaaaacaacaagaatagggagacacgccatgtaccaacactttatcgaaggcctgcaacgcctgggccgcgcgctgatgctgccgattgcgatcctgccaatcgccggcctcttgctgcgcctgggcgacaccgacttgctcaacatcgcggtgatgcacgacgccgggcaagcgatcttcgccaacctggcgctgatcttcgccatcggcatcgccgtgggctttgcccgcgacaacaacggcacggccggcctggccggggcgattggctatctggtgatgatctccacactcaaggtgatggacacgtccatcaacatgggcatgctcgccggtatcgccagtggcctgatggcgggcgggctgtataaccgcttcaaggacatcaagctgccggagtacctggcgttctttggtgggcgacgctttgtgccgattgtcaccggtttttcggcggtgggcctgggcgtgatctttggtctgatctggccgccgatccagcacggcatcaacagcttcggcgtattgctgatggaaagcggcagcctgggtgcgttcgtgtttggcgtgttcaaccgcctgctgatcgtcactggcttgcaccatatcctcaacaatatggcgtggttcgtgttcggcacgtttaccgacccggcaaccggcgcggtcgtgaccggcgacctgacccgctacttcgccggcgacccgaaaggcggccagttcatgaccggcatgttcccggtgatgctcttcggcctgcccgctgcatgcctggcgatgtaccgcaatgcgttgccggagcgccgtaaagtgatgggcgggattttcctgtccatggcgctgacgtcattcttgaccggggtgaccgagccgattgaatttgccttcatgttcctggcaccgttcctgtacctgatccacgccgtgctgacgggcctgtcgatggcagtcaccaatatgttgaatatccacctcgggtttaccttctccggtgggtttatcgacatggtgctgggttggggcaagtccaccaatggctggctggtggtaccggtgggcctggcctactcggtgatctactacacggtgttcagctactgcatccgccgctttaacctcaagacaccggggcgtgaagatatccaggtggtgcaggctgaagcgatgagtgataaccagcgtgccacggcatatatccaggcgctgggtggtgcagagaacttgctgagtgtgggtgcatgcaccacgcggctgcggttggacatggttgatcgcaacaaggcggtggacgctaaactgaaagcactgggcgccatggctgtagtgcgcccgggtaacggcgggagtttgcaggtggtggtcgggccgatggccgatagcattgctgatgaaattcgtttggccatgccagggtttgttgcagcagcgcctgtagcggttgcacctgtggataagcccctgacggtgaatgtgcaagaggccgagcaatggctgaatgcgctgggtggccgagggaatttgcgccagctggaagctgtggcgatgacccggttgcgggtggagttgggggatgattcggggttgtctgaagctcagctcactgcgctcggttgccaaggtgtgagtcagcttgagagcggtgtttggcacttgttggttggtgacaaggcctctgggctgggtgaggcgttggagcggttggtcagtggtcgtgaggtcggcgccagggtttagagaggtagtgactgttctggcctcatcgggagcaagccccctcccacatttgaacgtattcacaattcaaaatgtgggagggggcttgctcccgattggccctcacaagcgcctgattacttctgctcaggcacctcaactaaatccagcacccgatccaccatcaactgaataccctccaccatccgatgaatccccagcaccgcatcacgctgggggccatcgacatcaaaagccagattacccgccagtgcctgcacggatgccaggtcttgggaagcattggcgagcagggtttcgctgttcagactgggtattacggtgaagatctggtcggacggtaaatcaccagcttggcgggactcggcttgagatgagattgaaccagttagcaagttgtcgctgatcatcattaaactccatatggaataggctcctagtgatttttcaggcttgcagtcccggtcactgaattggcagcgactcgagaaggttagttgtgcgagttccgacggacaacctgaaaggcttgtcggaaagttctgaggcgcttgcaccgacgccatcgcaggcaagccagctcccacatgggattgatgtacggtctgacaacggggtcaaatgtgggagctggcttgcctgcgattggcacttacagccaacaaaaaacccgctgaccaaactggcccagcgggtttcttgtttatgcagccagccgattaaaaatccgccaactgccacacctcatacgccggtgtctcatacggatggctaagcttgagtgcagccacaaccgccacaatcaactcatccgccaccaccagctcaaccttccattcctcaaccacttcaacctgccccacctgcccgataaacggctggctgccgtccaacgcgcggaattggccctggcccagcacttgccaggcgcagtggtcgtagtcgccgatgcgcccgccgccggctgcgaagacggcggttttcaccgtctctacatggctgtcgggcacgaagaaggcgagcttgtacacggccttagttcacccacacgcgagcgttgcggaacatgcgcatccaggcgccgtcttcgttccactcttccgggcgccacgagttttgcacggcgcggaatacgcgttccgggtgcggcatcatgatggtgacgcgaccgtcgcggctggtgaggccggtaatgccgcgtggcgagccgttcgggttggctgggtaggtttcggtgaccttgccgtggttgtcgacaaaacgcagggccacggtgccggacagatcggcttcaagcagcgcttcttcgctggcgaattcggcatggccttcaccgtgggcgatggcgattggcatacgcgaaccggccatgccttgcaggaagatcgagttggactcctgcacctgcaccatggcgacgcgggcttcgaactgctcggaacggttgcgcacaaagtgcggccagaactcgctgcccgggatcagttcgctgaggttggacatcatctggcaaccgttgcacacacccagggtgaagctgtcgttgcgttcgaagaagccctggaacgcgtcgcgagcgcggctgttgaacagcgccgacttggcccagccttcaccggcacccagcacgtcgccgtaggagaaaccaccgcaggccaccaggcctttgaactcgttgagatcaacgcgaccggcgaggatgtcgctcatgtgcacgtcaatcgcattgaaaccggcgcgatcgaacgccgcggccatttccacctgaccgttgacgccctgctcacgcagcacggcgacctgtgggcggatgcccttcttgatgtacggcgcggcgatgtcctggttgacgtcgaagctgagcatggtgctcaggcccgggttgtcttcttccaggatcgcgtcaaactcctgctcggcgcactcgacgttgtcgcgcaggcgctggatctggtagctggtttcggcccactggcgttgcagcaggcggcgctggccggcaaacaccgtatcgccattgaaggagatgttgacttcaccgttgttgatcggctggccgatgacggccacgcagtcgtccaggccggcggcgctgaattgtgcgagtacgtccggagtcgcgtcctggcgaacctggatcacggcgcccaactcttcgttgaacaggatgccattgatctcggcggcatcctcggcaacgctgtcgagcacgatgttcaggccgcagtggccagcgaaggccatctcgacaacgctggtcagcaaaccaccgtcggagcggtcgtggtaagccagcaggtgaccgtcggcgttgaggccctggatcacggcgaagaaggctttcaggtcttcggcgtcatcgacgtccggtgcctgtttgcccaacttgccatgggtctgcgccaggatcgaagcgcccatgcggttctggccacggcccaggtcgatcaggatcaggtcggtgatgcccttgtccatgcgcagttgcggggtcagggtctggcggatgtcggtgaccggcgcaaagccggtaacgatcagcgacagcggcgaggtcacgctcttgtcggtgccatcttcgttccaacgggtggccatggacatggagtccttgcccaccggaatggtgatacccagttccgggcacagctccatgccgacggctttgaccgtatcgtacaggcgcgcatcttcaccggggtggccggcagcggacatccagttggccgacagcttgatgtcggacagcttgccaatacgcgaggcagcgatgttggtcagggtttcgccaatggccatgcggcccgacgccggagcgtccagcagggccagcggcgtgcgctcgcccatggccatggcttcaccggtgtaaacgtcgaagctggtggcggtgacggcaacgtcggctaccggcacctgccatgggccaaccatttggtcacgggccaccaggccggtgatggtgcggtcgccgatggttatcaaaaagcttttgctcgccacggccgggtggtgcagcacgcgctcaatgctgtcggccagctccagcgtgcttgggtcgaaatcatcgcccagctcggtttcgcgcacggccgaacggtgcatgcgcggggctttgcccagcagcacttccagcggcatgtctaccgggctgttgccgaagtggctatcggtaaccgtcagctgcggctcggcagtggcttcgccgaccacggcaaacgggcaacgctcacgttcgcagatggcctggaagcgtgcgaagtcttcagggccgacggccaacacgtaacgttcctgggattcgttgctccagatttcgtgcggggccatgcccggctcgtcgtttggaatgttgcgcagttcgaaacggccaccgcggtcgccatcgttgaccagttccgggaaggcgttggacaaaccgccggcgccgacgtcgtggatgaagctgatcgggttcttgtcgcccaattgccagcaacggtcgatgacttcctggcagcggcgttccatctcagggttttcgcgctgtacggaagcaaaatccaggtctgccgagctggtgccggtggccatggaggaagccgcgccgccgcccaggccgatcaacatcgccgggccgccaagcacgatcagcttggagccgaccagaatctcgcctttcttgacgtgttcttcgcggatgttgcccatgccgccggccaacatgatcggcttgtgatagccgcgcacttcatcgccacggggggtggtgatggactgttcgaaggtacggaaataaccggtcagcgccgggcgcccgaattcgttgttgaacgcggcgccgcccagggggccttcgatcatgatgtccagcgcggtgacgatgcgctcaggcttgccgtacggcacttcccacggctgttcgaagcccggaatctgcaggttggacacggtaaaaccggtgaggcccgccttgggcttggcgccacggccggtggcgccttcgtcacggatttcgccgccagacccggtggctgcgcccgggaacggggcaatcgcggtcgggtggttgtgggtttcaaccttcatcaggatgtgcaccggctcctgcaccgcgccgtactggcgggtttccgggtccgggaagaagcggccggcgacggagccgacgatgaccgaggcgttgtctttataagccgacagaacgccttcgctgtgcatcacgtaggtgttcttgatcatgccgaacaggcttttttcctggctctcgccgtcgatgtcccaactggcgttgaagatcttgtgacggcagtgctcggagttggcctgggcgaacatcatcagttcgatgtcgtgggggttgcgcttcaagccgttgaaggcgttgaccagatagtcgatctcgtcttcggccagggccaggcccagttcggtgttggccttctcgagggcggcgcggccaccgccgagcacgtcaatcgcggtcagcggcttgggctcagcgtggctgaacaggccggcagcctgttccaactggctgacgatgatctgggtcatgcggtcgtgcaggctgctggcgatcagctcggcttcggcatcgctgaactggccagcgacgtaaaaggcgatcccacgctccaggcgctggattttatccaggccgcagttgcgggcgatgtcgctggccttgctcgaccagggcgagatggtgccgaaccgcggcagaaccaggaacaagcggccggtcggctcttgcacgggaacgctggggccgtacttcagaaggcgtgccagcacttgctgttcgtcggcggtcaagacgccggttacgtcggcgaagtgagcaaattcagcataaaggcctgtaacagctggaaccttctggctcagttgttcaaggagtttgctgtggcgaaaggcagaaagggcaggagcgccgcgcaggatcaacatcttcgggacagcctcggaagggggtgtgctttgaggccgtgcattctagcgtaaaccttcgccaacggcacccgaaacgctaccggtggccgctgccgaacgtcagttggcagggtttgcacgcgatcgtggcgttatccacggcgttgggcgcagttattttaaccgtcacaatcgctcgccaagccgcgtttctgcgggctgcagcacagttttagcggcgctagcagacaagtgcgccgctgtcgagatatggcgccgtgggccgtttgcgtatactgcgcagatgttctccccaaccgttttgcgcccgcgatgggtcaaatggctcatcgccaccttgctcttcctgatgctcagtgcctgtgttgacaaacccagcaccctcgagcgaatcaaggaggatggcgtattgcgggtggtcacccggaacagcccggccacgtatttccaggaccgcaacggtgaaaccggtttcgaatacgaactggtcaagcgctttgccgacgaactgggcgttaagctggaaatcgagaccgccgataacctcgacgagctgttcaaccagttgggcaagcccaacggcccggtacttgccgctgccggcctggtcagcagcgaacagcgccaacagcaggtgcgattttcccacccatacctggaagtgaccccgcagatcatctaccgcaacggccaatcgcgcccgaccaatgccgttgaccttgtgggcaagaagatcatggtgctcaagggcagcacccacgccgagcagctggcggcgttgaaaaagcagaatcctgcaatcgaatacgaagaatccgacgccgttgaggtagttgatctgctgcgcatggtggacgaggggcaaatcgacctgaccctggtggactccaatgaagtggcgatgaatcaggtgtactttcccaacgtgcgcgtggcgttcgacctcggcaatgccagccaccagagctgggccgtggccgccggcgacgacaacagcctgctcaatgagatcaacggctacctggacaaagtcgaaaagaatggcacgctgcagcgtctgaaagatcgctattacgggcacgtcgatgtactcggttatgtgggcgcctataccttcgcccagcacctgcaacagcgcctgcccaagtacgagaagcattttcgcgcctatgccaaggccgaaaaggtcgattggcggctgttggcagccatcggttaccaggaatcgctgtggcaacctaccgtcacctccaagaccggcgtgcgcggcctgatgatgctgacccagaacacggcacaggccatgggcgtgtccaaccgcctggatgccaagcagagcatcatgggcggcgccaaatacctggccaagatcaaggatgaactggacgacaagatcgctgagcctgaccgcacctggttcgccctcgccgcttataacgtgggtaccggccacctggaagacgcacgcctgctggcgaagaaagaaggcctgaacccgaacaagtggctggacgtgaagaagatgctgccacgcctgtcgcagaagcagtggtacagcaagacccgctacggctacgcccggggtggcgagccggtgcactttgtggcgaacatccggcgttactacgacatcctcacctgggtgacccagccgcagctggaaggcgaccaagtggtcgaaggcaacctgcatgtgccgggtgtggacaagaccaagccgccgcaggacagcccgcaattataagaacactgaataccaatgtgggagggggcttgctcccgatagcctggtgccagtcactactacagtgactgatccatcgccatcgggagcaagccccctcccacattttgatctgcgcttggcttagaggccggtgattagatggactacgccgcccgacaacaccatcacgcctgctacacccgccgccttcaacgccgcctcatccaaccgccccgcatcctgcaactgcaccctcacccgcgtcagcgccacacgctgttgtgacttgagattctcggcgccgcccaaggcactcagcacatcggtggccaacaggctcggggtcgtcggtgcaaccgtctcggccaccaaatcaggtgtcagggctttccagaatgcccgctgcaatttctcgaacatgctcagtgctccatgacaggtgaggtttcaacggtggccgcgtggtacaggcgcagggcctcacgcacttggccggcttcttccaggcccagcacctggcgggcgatgagttggcagtcgaccagttccagttcgcgcacggtggccttgatgctcgggatcagcggcacgctgaccgacagttcatccacgccaagtccgatcaacaccggcaccgccaatggttcagaggccagcgcaccacacacgcccacccacttgccatgggcgtgggccgccttgacggtgctggcgatcaggcgcaacacagcggggtggaagctgtcggcctggctggccaggcgcgggtgatcgcggtccatggccagggtgtattgggtcaggtcgttggtgccgatggaaaagaaatccacatggggcgcaaacacatccgccatcaacgccgccgaaggcacttcaatcatgatgcccagcttgggcaattcggtgagcccgagcgccagcgcttcttcttcgagcatccggcgcgccaggtgcagctcgcagagctggctgaccatcggcagcatgatatgcagccgcgccaagcccgcactggcgaggatcgcgcgaaactgttcgcgcagcagttcggggcgttccaggcacagccgaataccccgcaaacccaggaacgggttggtctcgctttccatcggcacataggccaagggtttgtcgcctcccacgtccagggtgcgcaccaccagattgcgctcggtgccaagggcacgggcgatggcgctgtaggtgccggcttgttcctccgggctcggggcacggttgcggtcaaggtagaggaactccgaacgcagcaggcccacgccttcaccgcccagggtcagggactgctcgacttcctgcagcgaggcgacgttggccgtgacttcgacgtgatggccgtcgcgagtgattgccgccagggatgcctgtgcgatttcacgctgcagccgcagcttttgctgctggcgaaccgcttgcagttgttcgatttcagccaggtccggttccaggtgcagctcgcctttatcggcgtcaagcagtacccgtttgccgttggccagagccaatacttgagccggcaccccgcaaatggacggcaggccgagcgcccgagcgaggatggccacgtggctggtagccccaccggccaccgtgacgaaacccagcactttactggtatccaggccggcggtttgtgagggcgtcagttgttcggcgaccaggatggcgcactcaggcaggtccaatgagcgttcgggaacacccaggatcagtttgagcacgcgctggccgacatcggccaggtccgccgcacgctcggcgagcagcgccttgcccaagccttcgaagagtttcgccgtcgccagcgtggcgctgttccaggcaaaggcggcgctcttgccttgggcgagcaggccttgggcttgctccagcagggtcgggtcttcgagcaattcctggtgggcgcggaaaatttcggcctgggcactgccggcggccttggcttgcaaggcttgcagcgcttcggctgccgtccgcaggccacgcgccaatgcggcacgctcgaaggtttcgccggcaccggcttcgggaatattcagcgccggttcggccacttggacgacctgcccaaacgccgagcccggcgacgcacacacgccccgcatcaaggttgccgatgacaccggcgcggcaggcttgactacttcgaccgccgccaccgtctcgccacagccgtccagcaacaacgccaccagcgcctggatcgccgcctcggcatccgcgcccgccgcgctcacttgcaggctgtctccccgggacgtctgcagcgccatgatcgccaccagcgacttggcattcgcgctctgggtttgcttgtgcaggtagatgcttgaactgaaccctttcgccgcctgggcaagcactgccgctgggcgagcgtgcaaaccgttggcgttgggcaaggtcaggggcttggagaacagcgcatcgccctcctcttcatcggcttccgatgacacttgcccgggggacactcgtaacagtggctggccttcctcgacggcgccctgatcgggcaccagcaacacaaatggctcgccactgacgaccagcatcagggtcagcaggctacgtgcatgcagtgccacatagtcggcgtcgaactcaatcagcggctgcccggcttccacccgctggccctcctcaaccagacgggtgaagccctgacccgccaggttcacggtgtccaggccgatatgcaacagcacctgcacgccgttgtcgtcggtgacactcacagcatgaccgctgtcctggatattgctgatcaccccggccagcggcgcgcagagcgtctgcgaggtgggatcgatgcacaggccgtcgccgatcacgcggctggaaaacactgggtcgggtacctgatccagcgccagcagcatcccggacaggggcgccagcagttccaggggttgagatggggtcatgacttcacctgttgggttgttctgtaaaaatcattgggtgggatggcacagatcaaatgtgggagcgggcttgctcgcgcccacattagttcgcggttatttccaccagtattcgacttgcacgcccatgttcgatccatgccgtgccgtgccataggcaccggtatcggataacgccgagcccgccgcgagttcattcgctgcgcgcttggccgcctggttccagctggcataggtgtagtacaaccgcacttccggccgcgcccagaattccgggcctttgggcgaccaggtcggcgcgaacgtgaatttgctcagcttgcgtgtaccgccggtagcctcgacctgatcgtggcccagttcagcgaccagcttgaattgctcgctgatggcatacgccgggcgtacacccagggacatccagttctggtcctgacgccccgggcgtacatccttctggtaaaccgcctggacttgcccaccgaaacgcggggtcacctgccagtcgaagaattccacggcacggtagcttttgctgctcttgtccaaccgggtattgccggtgtagcccaacccagtgcctggaccttcgccgtactgcaaggcaaatttgttcttgccgcccaggaacgcggtttgcacatgctgcgcggtcagcgcccaaccgctgttggtgtcacgcccaccggccttggcgatataactcaaaccaagctccagctcgccgcccgggttggtgttgaaaccggccacgttgaagtcgtgacgggtggcgtattccttctggtacaggttgtccttgcgcgacagggcgtagctgtatttcaagccgccgatcagcacatcctcgatcccgccaccggtggcgctctggttccagtagtagaagtcggagatatggatgtcgttacgtttgtagtagcgccgcccggcccacagcgaaccgccgttgaggctgggcaggttggaccattgcgcatacatctgcggcatgcgtgccgagccgttgttttcaccctggaacttcagggcgcggtcgtacttgttgtagagggaggccatggcatccacgctgagcactgagccgtcatcgaacgtcagcaggtcctggcgcagttccagttcggcatattgctcgcattcgttacccaagcggtatttggtttgcgcccccggcagttggaagcactgctgcttgccgctgcccgttgacgtgcccgcgccactgcgcaagtaaccggcgaactccagggcctgggcgccaaacggcacagcaaggcacgacgtaataaggcccagttttattgttgttttcatgaagcgctcctttatttttattgttttttcttactttgatgcgtgatgcgattaccggtagaggcggctcagtccttgagatgcagcacaaacgattcgtaagggcgcaacaccaccgtgctcgtgcgcgccgggcaatcggggtaattgctgatgagcagccgctgcgcgctcgacggattgatcacctggtcgggcagctggatttcgcacggcgtgccgtagaagttgttgagcaccagcaggcgctcgccatggccttcgcgcacgtacgcccagacctggcgatggtcttgcagcagtgggcgataaacgccttcctggatcagcggttcgcggcgccgcagggcgatcagggcgcggtagtgatgcagcaccgaatccgggtcatccagctggttttcaacgttgatctgcgcagcgttggccgcaacgccaatccagggctcgccacgactgaaaccggcattggcctggttgctccactgcatcggcgtgcgaccgttgtcgcgggatttctgcatgatcgccgccatgctcgacgcctcggactccccggcatcacgcttgaggcggaaaatgttcagagtttccacatcgcggtactgttcgatcttgtcgaagcccgggttggtcatgcccagttcctcgccctggtacacatacggcgtgccctggaggaagtgcagcgccgtggcgagcatcttggccgagaccacgcggtattcgccgtcatcaccaaaacgcgagaccacccgcggctggtcgtggttacaccagaacagcgcgttccaaccgccaccggcctgcatacccagttgccagtcggagaaaatctgcttgagttgcaggaaatcgaagtcggccttcacccacttctgcaggttggggtaatcgactttcaggtggtggaagttgaaagtcatcgacagctctttcgaggccggattcgagtagcggatgcagtgttccaggctggtggacgacatctcgccgacgttgatcaggtcgtggccttcgaagacttcgcggtgcatttgctgcaggtaggcgtgcacattcgggccgtcggtatagaaacggcggccgtcgctgttgtcttcggggaagtcggcgggcttggagatcaggttgatcacatccaggcggaaaccgcccacgcctttgtcacgccagaagcgcatcaacttgaacacttcggcacgcaccttggggttgtcccaattgaggtcggcctgggtatggtcgaacaggtgcaggtagtactgcccggtctgcgcttcgtattcccaggccgagccgccgaacttggattcccagttgttcggctggtcgcgccagatgtagaagtcgcggtaggggttgtcgagactgctgcgcgcctgctggaaccactcgtgctcgacggaggtgtggttgaccacgatatcgagcatcagcttgatgccacgcttggccgcttcgctgatcagcaggtcacagtcagccatggtcccgtagctggggtcgatggcgtagtagtcgctgatgtcgtagccgttgtcgcgttgcggcgacctcaggaacggggtgatccacaggcagtccacccccagccatttcaggtagtcaagcttatccacgatgcccagcaggtcaccggtggcgttacccgcgtggctgtggaagcttttggggtagatctggtagatcaccgagtgttgccagttttgcatggtggggttccttcaattaattgtgtgctggctttgagcctcatcgggggcttacccccgatggcggtggatcaggcgacccgatacccaggccggataatcttcatgctcaacacacaggtcagtacaaagggcacgacgatcgcgacggccatgccgatcacaaacaccgggatgtactgcgggatgatcgagataaacccgggcaggccgccgacgccaatggccgaggcagtgaccttgttcaacgacaggaaaatactgcccagcgccgaacccagcagcgcggcatagaacggaaacttgaagcgcaggttcaccccgaacatcgccggctcggtgatgccgaaataggcggaaatcgccgaggtcgaggccatgcttttgtcccgcgcattgcgggtcatgtagaacaccccgagtgcggcgctgccctgggccaggttggacatgacgatcatcggccagataaaggtgccgccctgggtggagatcagctgcaggtccacggccaggaacatgtggtgcatgccggtgatcaccagcggcgcatagagcaggccgaagatcgctccaccgagcatcggcgccaggtcgaacagcgtgaccaccccttcggtgatgaggatgccgaggtgacgggtcaccgggccgatgatcgccagggccagcacgccagtgacgacgatggtagtgatcggcaccacgagcagttggatcgcattgggcacccgcgcgcgcagccacttctcgatgacgctcatcacataggccgcgagcaggatcggcaggatctgcccctgatacccgaccttctcgatctggaaccagccgaaaatatcgaaatacggcaggctctggccgtcgaggccggcgaccgccttgccgtagttccaggcattgagcagatcggggtgcaccagcatcaggccaagcacgatgccgaggatttcactgccaccgaaacgtttggccgccgaccagcccaccagtgccggcaggaacacgaaggaggtattggccatcaggttgatcaggctccacaggccatccaggttcggataggcctccagcagcgtctggccctcgatgaacatgcccttggcgcccatcaggttgttgatgcccatgagcaggccggcaatgatcagcgctggcaggatcggcatgaacacgtcggagaacacgcgcaccaggcgctgcatggcgttggtcttgtcagcgcccttctgcttcacatcagcaatggtcgatgccgcaagaccggtgacttcacgcaaggcggcatagaccctttccacttcgcctgggccgatcactacctggaacagaccgccggtaaagaacgatcccttgaccaggtcgacctggttcaacgcgctgctgttgaccaggctcgggtccttgagcgccaggcgcaggcgggtcacgcaatgggcagcttgctcaaggttgtcgcgcccaccgaggttctcgagaatctcgcgggcgatagtcggatagtcgtggctcatgctcgttttccactgtgattgtttttatgggtggcagtcgttggcagcacgccgagggcaaaagtactcgtctgtacgagttaaatcaacaactcgtctgtacgagttacacttttgtttattaatgcgaacttcccgtcagatttttcccctggctacacggctgcccaatggacaaaccccacctctgccactaaggttcctgccttgaatgcaagccgggcatagagccatctcatgagcaaatacaaccagatctatacggatctgcttgccagcatcaccaccgaacgcctgcaacgcggtacgcgcctgccctctgaaaccgagctgatggacgcctaccaagccagccgtggcaccgtgcgacgcgccattgagcagttgcaggaacgtggctttgcccaaaagatccatggcaagggcacctttgtgttgtcgcccaacccgatcgagttccagctgggcggtatcgtcagcttccatgagacccacgccgacctgggcaatgacgtacgcaccgaggtggttgaattcacccagctcccgctcgaagggccactgctgcaacacttcgaggccgacccaggcacgctgatcacccgtatcaagcgggtacgacgcatcggcggcaaacgggtgatcctggacatcaaccacttcatcgccgagctgattcccggcctggatcgcgagatcgccgaacagtcgatctacgcgtttatagagcagacgttgcagctgcagatcagctatgcgcagcgcaccatcgaggccttgccgcgcagcaaggacgaccaggcgcacctggaccttgacgggcaaagccatgtgatcgtggtgagtaaccagacgttcttgcaggacgggcggcagttcgagtacaccgaatcgcgccataccctggacaagttctacttttcggatatcgcacggcgctgagcacagccccttagcctaactatgtagcgccctccccgtgccagcctgggggaatctcgcccttcatttttgaaggatgagcactcccatgagttcgagcgaaacccacaccctgcccaacatcgccgacaaggcggccctcaaggccctggccggacgcgtgatcctggcttgccccagcctgcacgatacggctcacgaaaccgcccgcggcattctgaaaaagcacggcgtcgagggcctcgacccggacgaggtgtactaccaccgcttcaaggcagcccaaagcaattcgctgacctttaccggctgggaacatgtcctggaaaaaccctacgagtcgacgaccctgaccgagttggtgattcatcgattccgtgccaccgactatgacaacgccgacctgctggacctgtacggtggtttctacaccaaaggcccggaatacggcgatttcaaccagaccaatgaagtgcgcctgcatggcaacgaagtgctcaaggacttctgggccctcaagttcagtgacctttaccgcgacaagctcgacagcttctggcaggaccacgccgaagcctttcgcacccaggccaaatgcaatttcctcagcaaggcggtgcaagccctcgaactcaagcacctgagtgccgaagacttccacacttgcatcacggccgtggccccgcacctgagctggccggtcagcctggccatgctgcaaaccgacgtggcgccaggcgccgatgcgcaggtcgccgcccttgacctggacggtcacgtggctaccaacctgttgcgcatcactgacgccgccggccggcaaatactctatgtgccaggtgagcagcaggccttcaaagtgttcgacaccgcggggcaattgcactggtggttgctcgggcttatggacgacaagaagacccgtgacctgttcctttgccacttttccctgactgaccgcgaggccatgaccgacggcatcactgacctgatgaatcgcctggtgcagacctggggcaagtcggatcatcacatgatcaaccagaagaaccaggcggtcaccacggacgccttcagttggttgcgagaccgcacccgcgcagcgatgtatgacgaagccgagcagttgctgaccaccaatgcgcaactgagcaagaaaatctggatcggttacctgagtgccggcctcaagatattcgggccgctggctgtcattggatggccgatagccttgccggttctgggcgccagcatcgccaacctggccctgaacatcgaccaggcggtgaatggccgaaccagtgccgagcgcaaggccggggtgaccggttcggtgttcagcgcgatcgacaccctgttcaacctggcagcgctgcatgggcccgggcccatcgccgaagtgggtgccgacgtcgacgccgcggaagcggccgagatggccaagtacgacgaggcgttgaaccccgaggctgccgaaccggcaagccctgccgtgccggcgccccccgcactgccccagctgcccggcgacggccttgggcaaataccctcgagctggcggcgcctgcaagggctggagggtgccacggcgatgaccgaaggcggccgttttgcacagatctaccgcataaatgccaacccttcgaccctgatcaagctcaaggacgcggtgttttacgtgcgttatgaagcggacgtaaacggcggcggcacctgggccatcatcgacccgctgaacccccacgccagcaccggctcactgccggtacgcctgaatgccgagggcgaatgggagcgggtgctgcgcccctccgaggcggtgcgcggtggcagccccatggacaccccgaccacaagtacccggctgacgcccgcgagcgactatcgccgaccaacctcatatggggcaccgggttttgaaaacccgccctccagcttgccgaccccttttgatctgaagaaccagaacagtttcgatatcggcctcgccatgtctggggggccggactacatcaagccaatcatcacccccacgggcgaagctggcagcttcagcacctcggactacttcatcaaccccatgcgggcaaaaatcctcaccagcgcgcgcaacttctacgcccgtccacttttcgccagcaacctgcccgcgaagccggcattgcctgccattacgccagggatggacgccgaccaattgtttgataaatgcctggcaaacggcccggggctggtcgtcgccgagagccccaaacgcgttgccagcacctacatgctgatcaagcagatgccgcgcctggccaagcagggcgtcaagaccctgcacttgcatcggctctacaacgaccttcatcaggcagatctcgatgcgttcgcccgcagtggcgtcatgcccgaccgcctgggtaaatacctgcgcgagctggaccccgtcgagatgggccgcttcaacaccctggagctgctgcacgccgcccgcgacaaccatatacgcatccaggccagcgaatgcctggccaactacctgcccaaagggtcagcggtggatgagcaaatgtccaagaacttcatcaccagtgaaatcctgcgccttgaccaggccaaaaacggcgtcggcaaatgggtggtgctcaccggggcgcaaaacaccaacaccttcagaggggtggctggaatcagtgaaataaacggtgggaccagtctgcgcattaccgaggaactcggcggcgaaggcagccagatcaaggtcgcttatgggcccaaggtgaacaacctgccaacgttcgatcagatgaagccgccgctcgaggcgctggacaccgacctttccctgcaagtaccgatgcgtgagagcgaacaagtacacccctatatctttgaacagaaagaccttgaaagaaccctcggctcacctggggactgcgtcatgcaacagacccgcgatgagctgacgcttattcaccgcaaccgcctgaacaagcttgtacgcaaccgcatccaacactcggacgccggttatttcattgatcgcgatgccttcccaaggctcaacggggctgtctacaagacgctgcctgagctgcgcggcgccctgcgcgcaaacggcctcacgctcaaaggcctgccgccggccaagacgctggttcccgcaatagagctggagcgccctgtcgagcaggccgttgttgaaaccaccgccgaaacgggcgcggccctggcgccttcggccattcccaccggcgcggtggaggccggcctacggccagaaattccaccagcgtgggaagccaatgaaatcctcgagggccgcgacccggtcagcgagcccggccgggatcaaggtatctatcgtctggagtccaacccggcggcggccatcctgctcaacgacacgccgtattacgtgcagtatgtgaatgacgtcaatggcggcgggcattgggcgattgtcagccctgaacatccacttgccctctcggaagccatcccggtgcgcttcaacgcccagggtgaatgggaagtgctgcccaggcctggcttgaaaggcggcgccgggcagctgctcaaccgggtgccgggccgccgaccggtgccgacggtgcaaagcccggccatcgcctatgagataccgccggacctgcgtgcccccctggaaaatgccgccgcagggcctggcactacgaaatatgccctgagcgacgagggcgtgaacctctttgacaacggcgccgacccgtacgcgccgttcaaaagtagaaggcagcaactgttcaaggatgcggtggccttcctgcgtcggttccgtgcagccaatcgcccgcccattccctcggtgccagccaaagcccccacagcaacctggctgcaggcactgctggaggatggccgtggcatcgtggtcggcgaagcccacaacggcgtgggcagcaaacaactgctgatcgagcacatggagttactggcgcagaaaaacgtcaagacgttgtactgcgagcacctgctgcgcgactttcaccaggcagccctggacagcttcttcgaaagcggcgaaatgcccgagacgctcaggcgttacctgcagagcctcgataccggcatgggcaccgatccgctgggccaatacaacttcatggagctgatcaaagccgcccgcgcgcacaagatccgcatccaggccatcgattgcctggccagttaccgtaccgacggatttatcccggccgtgaccgatagccagatcgcccgaggtgcgcaacgccacgccttgatgaactactacgcaagcaccgtgatccgtgccgaccaggcggcccaaggtgcgcacaaatgggtggcactggtgggcaatacccacgtcagcagctacaagggggttcccgggctgagcgaactggaagaagtgcatggcctgagggtagaggatgtcgcgcccgggcaatcccaaggcatcatcccggaccctggcatcccggcaaccggcgaggaaggcgcggtgaaaagcgacctgttgtttcagtcgcagatcccccggaaacctgcaaccgccgcggagttcgacgccctgctgcaacgcgccggaacgtttaccgtcgactcgtcatcggtgtcgcccatcctgaaacatcgcagcaaactgggggagttggtctctacggatattcgtaagcagaacggctacttcttcatcgagcgacccaattggccgagcgtgagcggtaagcgcttcgacagcctcaaagcgttatttgccgcgcttgaagacatgggtatggtgatggttggcaaaccggtgccgctatgagcagcgcagctgaaaccaggaaatgagaacactgtgaatatcccgaacacatggcgcgaacagttcccccatgcactgattgaacaacagtctatcggcgagtcgcgcgcagacgtctatcgactgcgcagcgaacaaggcgaagacctgttcctgaagtccgagccccttggagagttcgctgagctggcggacgaaatcgagcgcctgcgctggctgcggcaacaagggctaccggcaccaattgtcgtggatgaggtgatagaccaggatcgtcactggctactgatgagcgccatgccgggaaaggacctggcgacggtcgacgaccttcctgtggcgcacatcatagaaatcctggcgagtgccctgcgcacgctgcatcaggttcccaccgctctgtgcccgttcgatcactcccttgaagtgcgcatcgcgaccgcacggggccacgtcaacgcgggcttggtcgacgagaccgatttcgacgatgaacgacaagggcaaagcggcgagcaaatgttggacgaactggtatcgacacggccaatcatccaggacttggtggtgacccataacgacgcctgcttgccgaacttcatgacagcagacggtcgtttcagcggttttatcgattgtggtcgcttaggcgtcagtgaccgctaccaggacctggccctggcagcgcgcagcattacccagaactttggacaagcgtgggtggcgccgttcttcgaacgctacggcgtggagcccgatgagcagcgcattgcgtattactgcttgcttgacgagttctattgaaggctgccgcgaatccagaaagcagcggctcgtaaggtatggccgctttcagccccttttctgacgaagcagtttgttaccgttgggacacgcagcaacctgccaaacagatacaaccttacgtagaatgcctgcgtggctatggaacaccttccttctaacctcctatgacctaggggtttcgctctccacaccgcgcctgcgtcttgcaggcgtttttacatccgttgtagaaccacgcagctcatccattacggcgccgaagggagaaaatcaagcatgaatcaagatatgttcctgaatcgccgtactaaagtccacgttccggtgggcactggcggtgccacgcgcgcacaggtcgcatcggctgtccgcgaagtcgcagcgttcggatgcgtattttcagagcctctgattgagcaaatcggcacattgtcgccgatagaactgaagtactggctgcgcgaaatcgtcggagtccttcgcagggaaaatggcgctcatgtacaccacaggccattttatcctgattttccagagcaggttctgacggcctcagaggcgcagttgtacctaaatgccgtcctgcattacctcacgcttcagcgcctaccaccgactgaaaactctcgacctgcaatgcttgagggcaactgcatagcccgcgtgatcgaaccgggaagcatccccgagttcgagtcactgctcgagccgctggtttcagcgcgtacctcgctctccgagagggacactgccgacgtcgtctggtttatccgaaagtacaagagtgatgtattccggctactgccggacaccgtcccgttccgggagatccgtgcgcaggttggcagcgcacttattcagaatgtagctggggatgcacgggtagacgcgttcctgcagcgaaacgtcgaaacagcgactgacgtgctacggctcgctgtcgcgctgaatggtggagacgtgtcactcgcgacagcttcgacacgtttcacggcgatgaagcgctcaatgcgccgcctgctattacgcttgctcgatcatgtacccaacgctgcagaagacgtaatgcaccatgctgagcgatggaaacgcttggctgaagtactgcatccgggcgattacgccgacaagtacccacgagccctaaccgccatcacggcagcgcgtcgcaatgaagcgccagactcatttggatcacgtgtcgaaacattacttgcccagcgtcaaatcgccacgcttacccccatactacaaaaccgtcctggcgagttcgcacgacggctggacgtgaccctaaggcgcgcgacggaaccagaatcggtactcgacgcgttcgaggcggttgcgcccctagtgtcctcaccaattctgcttcaattactggcccacgtacgtgctccgcgccccctacccctgcgagcgttcacaccgaaaggcgcattcgccaaggtctatggtgttgaggatcgacgtgaacatctcgctccagaagtattggctcgtacggccaggatctgcgaggaggctctcgtaacgcgttttgcatcgcttgtgccattaggccgctgtttcatcgatcctgcattacgcgaatataacgtgccgctggcgcagcgggcctcatcaaagtcgctacgtacgctggtgcggggcagtcggctgcctatgcctgacactcgtttcatacgcctgttcctgtggtggaagaacggccgtggacgcacggatgtcgacttgtctgccgcattttttgacgccaacttcgtgttcaaacaaacggtggcgtactacaacctgaagggcttcggcggctaccacagcggcgacatcgtcgacgcgccccaaggggcttcggagttcatcgaacttgaccttgatgtcctcgtcaaaatgggcgttcgttacgtggtcacctctatcaactcatacaccgagcagccgtattgcgatcttccagaatgcttcgctggttggatggcccgtgccgacgtagcgtcgggtgaagtattcgagccgcgctctgtgttcgaccgtatcgacatcgcctccgacacaggcatctgcctgccattcgtgatggacctgcaggaaaggcgcatgatctgggccgatctcgggcttacttcatctgcgcgatggaacaacgtccagaacaacctcagtggggtatcgttgatgctgcgagcgctggtacatacaccaaagccggatttagaaacactgttcgatttacatgttcgagcacggggagaacgagcggcttcaccgcagcaggcagagacggtgttttcgcctgatcaggggataacgccgttcgatacggatttgatccgatcagagtttctctaatacctaccccagccttcgccgctcgttatagtaacaactcttgcttcatagctttatgcccagaacaaaaatgccagtcagcataactgactggcactggttaaccccattcctgcgctccggacttagcgctgcactctagtgaggttcgggcgccctatttcaaccagtagctcagcttagacagatcagcctggcaaactcagctattgcctaatcatgactacggcaaatcgagccagtgaatttgccaagccttcctggtgctaagcctgatttttagaagcgatgaagcaggagtagagaatatcagcgaaatcatgctcgttgatatcgccgataaccaaatccctaacggcatccgctatcagatcattatctagagtaatttcataatcatttagaaaggtactccaagccgactgcaagcccggtgcgcttgttggcatcgggcagtgcatggccttgcgcgatatcggcagtgtacttggcagcgatttcaaatacgtcgtcgaggccattataggcgatcgcattgtcgattcgggccagcgcgccttgcaaggtcggaatacttaccggccccttcatgccgggctcggtagtcaagatttgagtgtttatctcaatgacccgttcaaatggaaagaagatcaattccattacatatcagccaacttctgaaaggtcttcttgtgagttctgagaacaagcttggtttctgaataaacgatctgtttacccgactcgccacccaagtccagctttttgatagctttaactttaggcctgtctactatggatacaccataggtattcagcttgtggttcatggcttgagtaccccaaacggattgatcaatttctgctcacacggtagcacactgggaggcaagatacaccgagccatcgacagcttcgtacgccgcttgccgattggcatcagcaccacgccagcgcgcaactcagtatcagccattgctgacagataaagcatctgcagcggtagtgtgtcgatacattcaatcaagttggcctcaggcgaacaccctaacggcttcgaaatcacattcgtatcaagaacatcattgaaaggctaccgtctgagcgggcgtctagtcgcgcgtactctcaaaggccgcaaactcttcatccgtcgggctggccttacccacctcagctcgcagcgaaccctgcttcacccggccttgcggtttcaccgaagattccaaaatgtctcgcatttcggcatcgagactgcgaccgtgctgagcagcccgcaatggacttcatcaagtgcatctcgaacggtaacagaatgcgccggtttcggaaggtgacaaatgcaaaataccaaaagcccgcaattacgcgggctccagagcatttcttgctagttggtgccggacaatgccggacatccaatcattcccactctattgtaaatagctgcataatcccctttagattcaatagattgagagataccaaactataaataccatgaaaaaaaccatgccaaccttacgtatcgagcatatcccactcgtctccgagtacccaacgtattgcagacagcttgccattgatcatcccccactcgaagtcggtccaaggccccagcccttcggggcccaactcttcttccgctctcttcatcgatgcgagcatcccctcccaaatcgtatgcacaagtaaatttggccgctcttccggcgcggcttggtcccacacatctttggttacaagcttttcttcaccgtcttcgacgcgagcgataatgttccattttctgttgtaccaaacctgcgttgtcagcttactctccgcctcaagcagttcagaaagctgtcgtggatcttgactgtattcgcgctcaaatctggtctcttcgatcaggtcgctcgcaaactcgctaagcagcgcacttaggttggtctcgtatcgcgatcgcacaccatcaaaaagggaggccaaatcgggatgagggaaacgcgtgtcagctcccttttggctgaagtcgtggatgttgtgggtcacaaaggcaaaaacatcatcatctttgcgcacggctagcgcatcaatgtaagtctcgataatgatggcatcgccaatcccgttcatttgccggtgaaaaggggcaatcttggcaatagctcgatccgcagcgcgcaccttgatgttatcgctgacagggactggcgttgtctgcccgaacaatttttcgatcaaacccaccgcttcgttcacagcctctccgccagtagcaacccgatgatcgacctcgtttagctgcttcagcgtcgcttccagcccttcttctggggcaaattgcacaatcgcctctctgacactcttaaagtggctagaaagactggctcgactagccgccatgactcgatcccgattccgagcaaattcctcaataacgatctgcggcatgataagaatgacctcgtcggcttcggccattgcggacaaagcatccagtaaaggaaggtgtcgggggtctttcgtaaggtcgagccataccgacgtatcgatcaacaggttcaatctcattcccactcgctccatgtcgcgctgaccgtgccgacgcgatccttaccgcccatcccttgtagctgacgcaacaggatggccaattcggcgagatcgccgccgcgacgaacttcggcaagcagcgcctctgcataggccggatttgcgaagaaatagtcaatcatagcgtcgtcatgcgacctatctttcattggtgtcttactccttgtaagagcaggtttcgataaccgaatgcagcgccagaccagctagaaggggaatactatcgtcccagctgacctgtttacacgctgaaaatattgctttgcatccaacggttacagcgatattcgtgagcgatccgaccatggaggatgagctctgcgagatcacgctcatgtccagtttacggatcttcagaaacctgtgatggctctgtgatatcgtcccaatgcccaagtacagcatgcccgtgtggtgaaaggagtcaacatgagcgacgaggaagcaagcaaatacccgcatagcgctatttccacctggagcggatttgtctaccaaggcaaagtggcgctctatcattccctcaagctaatcaatgaaggcgatactcgattcgagctacaactggatagcactgacgatttcgccatttacaaagataacaaactaattagcgcccatcaggtgaaagcaaaaataggtgattaccgtagcaattacaaggaggctttagaaaaatcagccgccttggagctagatagagttgccggaatcaaaagattttttcatatatcgctaccaattaatgaccatagcgactacgtgcatccttcaactggcgaacgcgttgaattctactcatatggtaagtccaaacattgcgcacttgataaaatagaagagctgacgaagcaaatcatcaaagaaatttatgccagtcaaaatgtaatctttgatgacagtctactggacgcaaattactgcctgctatcagacagaatcagctcagaggctttagccattcatgcaaaaattcaaaatgaaggtgacactcaacgtcaggcagcttacaaaaatcgaatagatgctacgagcattctttcaggcataacggatacgaatccgtatcaacgaaaagactattacgcaattgaacttaaagcgcgccttcacgcttaccttgaagaaagactggtcgagtcattaccaggcatgtcggacgcagcatatgaaagagccagaaatatttatgcgctgataagactctcagagggcggtgacttcaagatactttgccaactaatgaaaccttcagagaagttctcacgcattcaaagttcagacatacgtcgatattccgacctcgtccacacgattagtgctgacccaatcttaaaacgactgccgcactatttagacagcaataacaaattctacgccccaacggcgctttacctaccagaaccaacagataaaaaatattgtacctctgagattatcgctgaaataaaagataacgacgaccttggcagactgctcttcgaatttaataatctgattgcagccaaggccacagaaagctttacaatcgacaccaagtatacaaactgtttcgatgaaagttctatagtcgctcaagaacgcatcgacagcaatattacgagaagtttgtgcatcagtattttaacaagagacgacgcagaggcgcgacttaaatgattattgacctgatccaccaagccctagcaagtcacgggttttcaaaagttaaaaacaatgatacgactggcttctatgttcgagaaaaagatacagcgatccgatttgcagtcttgcacaggttagacgagctgatgaagcctggagatctcaacgcagccatcaatcagtgtgcgccggaggagttccttactgacccagcctttaaaaagaactgcgacctgatctgtattcatcacctagacaagttagccgaatttaaaagtcatgaagaacagatttttgaaattgaagaagatccacatttttataaaaaatatgtgctttactatagcgaagccgaagttgaagctatcaaggggctagatttcggcaagctaaatgaattaatctcagacaaatcgcaattcaacatttataaaaaagaccccacagcagccactaaatatagtgcagctgcaaaaatcttcatcaaactgcccttcctagcacttcacatcaaaaaggtagaactagtacctcttcgcctacaaattgaggaagcagtggccgaaatcgacctcgccaacatttatggaacagtacaaaaactcggccaaattaacgccgacgatataatcaaggagctgattagctatgaactggcaaatatccaaaattgagatctctagtttcaaagccttcaaaaaaattaatctcgacttcggcgactcatcgcttttaacattagacggccccaacgggttcggcaaaactagcgttttcgacgctatcgagttgctattgaccggtagcatcaaacgtattcgccagctctttaacacattaatgatgggtaacagaaccaactatgaggataacttactctggaataaacgatccggaaagaaagatttagcgataaaaattgagttcttcaatggcgatcgaaaacttatattggcaaggcatactgccgcagcagaatttgaggagcaggccaacaatcgcgccgaccaattcaaccacctcatcctctacgaacttcccgactttgaatcaaacaactacgtatcagaaaatctccgcgacgagagtttcattgaggagcttttcggaaaaaacttcaaagaaaactttccatacctaaattatttggagcagggccaaaaccagcttctgcacacgagggtggacaagcgtaaggaggcgctaaacaacctctttaatattcgcgacgtgaaggcagagactgacaactgcagagctatcgctacgcggctgacaaaattcatcggcgatccgaaacgtgccaccgatttatcaaggcttaaaattgaggctgactcgcttaaaggaatgattcaagctgacttaggaggaattgaatatagaaaaatctcaaccgctgtactccaaccaggctgggacaaagagctacccttccctacctacgctgtcgaaatccacgctgagtatgttgaaaatcttcggcggcttgaagagttagttacactaaagaacgctatacagattaaagataaaaacgaggggattgaaaagtacattgagataaacacagactttgtgaaaagcttggcacgctttggcagcgatctagaaaagctaaatggtctcgacgtcaccaaaaatgaattaaacgaactaaataaatccgtgggcatcataaaacggggcgtcattgtcattaaggccgatgaggccaaaagccttcctggatggggccaagaacgcttgggctggttcttagagcaaatagtcatccgtgacgcgcttcagcaaaaaagcaactcgaacgccaatgctgctgtcgagctgaatcatctaaaagcagaactgcttgcagagcacgccaagctctatgctgacgatcaacactgcccgctgtgtggtgcagattggcaaactcatgacactatgctgcaaaagattgagttcaggtcaaagcagatcaatgacgcgctaagcgctgatagcctgaacctgatcaatctcaccggggttatgactgcagagctagccacgattgaagctcaaatccacgctagggttgcgcagttatccgtggggtacaacatcgcgctacatgatgccctgctccttgataaagctcgtttgcctgcaatcaccaaactcgcagcccggcttcaggctttaggtgtgcagctcaactacgcattctccgaaaatgaggcggtggtagacactagggttcagcaactgacagcttccattagaagccagaaaacacctgaaacagaaccgctgccggaagactggagaacggtaatcactgcagccttcaaagagctccaagagttctacatcgtcgagcctcaagccctgaaagacaaggggctatacatcgcagttaaagctaacgaagctaagagcaacaggctaaaactttgtgttgatgagcttcaggtaatccagcgtgagaacgaagcagcgagaatcgctaaggacaaggtcaatacgctaaagacaaccttggagaagacggagcgcagctactctgaacaaaccattgctgagattgagctgattttccatatctacagcggacggcttatccagaactatcagcgcggattggggctgttcattgaaagcaaagacggaaaagaacttagattcctgacagcagaaaagtctgagcatgatgcgattttgtcaatgagctccgggcaggtgtcagctctcagcctaggtttcttccttgcgcttaatagagtctactcgagtgtaccgcttatcctgatcgatgacccttcccagtcgctggatgaagtcaacatcgcctctctgactgacctgctacgctgtgagtttagcaatcgtcaactgatcgtttcctcgcatgaggatgacatctccgcgtatatgcgctaccggttcaccaaggcaggcctcagcaccagatcgctcaacatgcagcgcttggctaaagacgccctagtagcggcaatctgagtcacaacgataggggtacatggtaaccgctccatgaaccccacattcaaagcgctaatctgatgtccgattgccccgtactgcctatagctccccccccccggatgagctaacgtctacttcacgcctacaaccaaggaaaaacatggctcgactaaatggcatcacagaaacgtactgggcttccatgaaagaggatgacaagctcaagtggaaattttttagtaaagggttagtattcttcggaacactatacctaacgaaaacaggttttttgccatttgactatgctgttgcagctgcaactacaattttttcgatgcttatcatcgaaagccaacgcagctacaaacgattcagtccaaagctacgcaaaagaatcgtccgcacgtgtatattcctaggaacttggggcactaccactataggagttctatacttctctcttgtggcggcttctgcggccagcggtgcgctagaatcctacaatttagtactctccacaaacccacgagacttattcaaactagcgatcttaataccaatatttttggtcgtgatattttacactccaataaagatttttagagaactacacattgagcagatcatctaccgcttaccacacactaagcttattgacttgttagtaaaaaagaaatttaaagcagacagcctactctctttcttaaattttgagtatgccataatagtgtcatgcactctgtactccattatccttacggagcttgtgcgggcatatttgtccccattcataaaactatagcctcaagtggatgcttttatgctacccatcaaaattcaagacggccacgagattaacaaatcaaattttctaaacataaccccctctagtaaaatacttaatgaggtttttcaatcaaacaacctaatagatgccagattagatatagcaacgaaaatttgcgaccgttttcggcgagaggttgagcacctaaacaatttaatcaaagccacagctcttgaccgatcaggttgggtgataaactttaatttctgcgcactagatattttttatgctgaggcaggtcaatctctatttgccccccaaaacacctatgagcttagggtatcactaggcgtaccggtaattactctatctgtggttttagagctgatggaaatattagagtcaacgccaccccgaatagacgaaccggaaaacctaattaaacccaattctataacagtaatattcaataacctgaccaaagaagaaagcgtgagcgacctcgctatagagcttgcactggacacctgcctcctactttatttccatgagctgtcccacatattattcggacattgcgactatcaaacctcagacgaaaacgagctaagggcgatcgagcttgacgccgacttcaatgctggatcttttttctgctcattggtgtcggagcttccggaccctcttcgaagaccaagctctacaaattcaataactgagcgtctaatacgagcttccttcattctaggcacaatccttaaagcctgttcaacaaagtcaaaaaagtaccattatcctaccgtccgcgtaaattgtttcgtgggcggtggtgcatattatattcgtcatagcgcacttaatccgaacgtaacaactgacagccaagaggaccaatattgggaggaacaaacaaatcgcatacagccccctctactagaagcgctgagaaagtcatcgcttgcctactacgctggcaccgagatcgaaattgacaaagacagagatgaaatggacaccacaacttacacaacacgtaaccgactaaaggatggtccactaaagcatttaaagatccccatccgataaaaccgcacgtacaagcctgacgaagcaccgtgccaggccaagcctttaaatcaaggtaaatgcaaatcccactcactcaaaaggtttaagccttctcacttcaacacaaactctgcgactatttactcagtatcttcgctactgggtatttgtcgctccagaatgagatcgtgagcacagcatcagatatcagattaacgctttgaatgtggggttcatggagcggttacggtacctggcatgtgcccctggtcgtttacttgaggagccaccagctattaatagcttattttagccttcaatgttcttttaaaacgctcttactttactactggaactgatcaatacatcgccccaaaattccgcactactacatcaataaaaagtaactccccaaaagaaaattaacgtcttataaaagcctctatccaatatctggccacaagtgtattcagcaaattcttatttgtgagctttaactatagtgcccatcttcatacctatagctacctgcaacctccgaaactccatcatcaggctttccacatcaatggcgttcgcgctttctccacgcttctctgcaagccacagtttcaacagaccagcaacccgcccgaggtcgccactgaccttggccaattcacccacagcggtcaggtcaacgaccgaccgaatgggagtgttcatgcctagggcgcgaaggtagcccgagcgggacattccagcttctttggccttgtcagtgatcgccgccttttcctcgttagtaacccaaacttcgattggcttgccgcgtcggcgagccgtcgttttttctttggttccgcttgtcataggtgctccagctgttgctgtgttttgcccttagacgcggcagcggctgtgcgcctcgcagagcaagatccgttgagccgaaggcgaataaggggcagtgatggatgggttcgggcttgcccgtacccgtacaacacacatcttgccgtctgcctgagtgcaattcaaagaaatttagtgctaatagccgtttcggcaaagtgagttgccttaaatttccttgagttgcgttaactctccctaagttgcctagagttgcattaattcaggtaagaaattgcctacaattgccttgagttaactcaatcgactaaatttaaatgaatggatcgaaaagagcggaggaagtatgagtgccggccaacttgccgtggccacgcttagctcgtagcgacgccgatcctgatatggctaacaactccagcggtcgctggaatctccgctgcccacaatagataaaggccgaaatggcaccaaaaaggagcatgaaaaatggctagaaaaaccctttctgagcgtcgagctgacgcctgttctgaactagagatggctaaggcaaggcttgcaaaactagacaatgaggcagcagaaagaattgcaagaattgcaataaagtcaggattagttaatcttgatctcgcggacgatgacatccgggaagaattcaacagaatcgtggaaaggataagcaaggggaattgattatgaagacagctcaccgcatcagcgctttggccactcaactcaatgaactgcaagcctgcctcggccgagccagtgggcaatctagtaagcgcattgcggaggcccagcgcatcgcggccgagctggcttcttcactcgaagagtggcaccttgagacgctgcacatccctgaaactgagcgttgcctctatcgcactcataatccttattacgcagcccactgacgccgcgcaccaacttataaaaagctcacttcagtgggcttttttcttccgcaaaacgcatcaaaccggacagccaattcttcctccttataaaagaaaaaccctagacaagccagagagttgccagcattaaaagggttgattaacggacagtttccggacgcaacttattgcaatctatgcggatagactattatccgcatattcaaaacaacgccatatcggagaataatcaaacctcaagctactacaaaatgaggtattcggtatggaaatagaatcgcaaaaaacgtcagtttatgtcgctcggatattcggccgaggtgcggcgctagctgtggcaatggcaaccacaagccttggtgtagttctctatatgacacctgcgtcggcttacgccatctactgctctaactgctcgacgttctatcaacagatgttcgagtacgccgagcaggtcaacacggcgctgaacaccgccgagcaactgcaaacgcaaattcagcagtaccaaaacatggtcacgcagggcacgggcttacccgattcgaagttcggcagcatcgcggctgacttgaaaagcgtggtcaacatctacaaccgctcgcaggttttgggccgccaaatccagaacatggattcgcaattcaacacagtttttcccggattcgagtactacctgaatcaagcagcgaactcggcagaggtcccggcgcaggatcgctatcaaaagtggtcacagcagggccgcgacaacgtgaaaacggcgatgaaagcagcggatttaaatacaggagccttcgagcctgaagacgctcagctcgcgcgcatggtttcacgttcacagtcagccatgggccgaatgcaggcgattcaggcaggcaacgaaatcgcctcacaaaatgtccagcagttgcagaagctgcgcgatctggtcgctacgcaaatcaacatgcagggcaactatatggctcagcagggtgaccgtacagcagccagcgaagctaccgaacagcagtttgaagcgcgcaaaaacacacgcggcggcgtgaaggggtactgagaatgactatttcgaaatggctcatcgcgttgatctgctccggctctgcactaatcggttctatggtcaccgtggcggttcaaagcgacagcgaatgtatatcggtgactgagcaccaacggcaagagcgtgacgctgatttctcgtttgaagagcgcccgaacactcgcggcggcgttaaggggtactagctatggatactcgcctactattgttcctcgtcttggcgagttcattcgtgagcggagatgctatggccgcgaccgacctttcccatgccgacacatcggtgcagggcctactcgacctcgttttgcagcagtcgcaccagtggtcaggaaagctgtatgactatgcgatcagattattctggctgttggcctccattcaattcatttggacgttcatacctctgatcatgaagcaagccgacttaggcgagattgtcggcgagctgctgcgcttcgtcctggtggtcggcttcttccttgctgttatgaagtactcggtggagtggtcatctgccattgtcgatagtttccgcgatgcggctgcgtctgcgagcggcctcgggcgtgcattagaacccggcgatatgctggcggttgcactggattttggccgcactatggtaaagggcatatcagtgttttctccggccaaaggacttttgatcgcagtatgcgcaatccttgtattggcgtgtttcgccttcatcgctgcattcatgttcgtaacgctcgtagagtcttacgtcatcatcaatgcttcggtgctgttctttggctttggcggctcacaatggacgcgtgattttgcgatcgccccaatgcgcttcaccgtggcaatcggagccaagctgttcgtcttaacgctaatcgtcggcttgatcgtccagtcggccaagcagtggttggccgcctacaccaatgacgaagcgtcgttgatgacgatggtcggtctggccttggtgtgctgctatctgacaaagactattcccgacctaatcggcggcatgattagcggcacgtcgatgggtggcgggtcagccatcggtggtatggcggccgccggtgctgccggtgctgcggcggcaatcgcaaccatcgccacggccggggcggcagctcctgctgctgccggtgctgccggtgcagcgggtgccggaggcatcagcggcggcggtctggcaggggcaatcaactccagttttaccggtgcaagctccgctggtgctgcctcgccagtaggtggagctacgtcccccggcgtagggtctagcactggcggcggcgcagcggccaaggcggcgagctccgcaggtgcgaagattggcggtggtgcagctaccccatcggctacgtccagcgacagcgtccagcagaccgctaagcaggccgggaaggccgcacagagcggcggtgacaatgatcagaaagcaacaccaaaagggggagctgttagttccggcaccgcactgtcccaagcggccaatggtggtgcaaaagcgcttggcgtaattgcctcgctgacagtgccgggcatggagaatgcgcactcagcgtcgcttggcgctgatcttctcctgccagctcccattgactcctgttcgcccacgtccgcagagccaactggggaagccgcaggcatggaatccaacgtcattcgaccggatacgaacaccagctcgaattccggccgcctcgacgtttcgagcataacctcaagcaacgaccacccggagaaataatcatgaatagcattctaatgttcgctggattcgtagtgctcgcctccaccttagccattggcatgtgggcgttcggccgttggctgcgaagcaaaggccacgggccattgctcgatagactggatcgacaatgcaccgcgttgcagcttcgagttagcccgctggccctttcggcttcctttcacatgttttccggagtgcaacatctgaatcgcctccctctattgggtagcaagagcaatgctgctcaatcccagcaaattctgacggcgatccgagcggcgcaggaagcccaaaggctcgactcctccgtcaaccgctgaccctacaacccccagccagagtgcggggggttgtttcccggggccaccaaatccaagtagtacgcacggacttgtctcagctaaccccttcagccccccgcacgtaagcgtaatctccccctgagttctaaatccaggccgcctattaattcggaccagcaccctactggcactccatcagaacgacgaccccagacagccttgatccaacgcgcggaaggctctgccattagtaatacgcacgaactttgaacacttggaccatcggcatggacgggccgccgtcaaagcgcgggggcttcgccattagtaatacggacggactctgaacactctacggccggagctttgagatagcccgagacggctcccacggacaccgccattcgcttagcgatggctcgcacgctcaggccttcgcgtctgagggcctgcgccttcgcctgcttagcgttggcagcctcaatgtaggtttctcggtctacagaaccggcagctcgcctccgaagctcatggcgcctcctatcgcgctctgcagcctcgacccgactgacaatagtcttgagctggcgttgttcgtcggcagtgatcccgaacaagttgataagggtgtcgttcttcggcgtgtacagcggcgcgtagtccttgccaccaaagctaactttctccccggcctcataggctttggccttgctgaacagggtcataagctctttcgagcggctattccactgcggatcaagttcgcgggccagcgcggccgcttcgtggtacatctgcttgctgttggtcgccccggacagcagcaggaaattcaatcgccaaaacaggtgctgcatccggctgccttcaccgacaccaccgcgcagctcggccagcttgcgcaggtcttccagccgatcccacgcgagctgtcggccggaaaacccgcgcagattgtcagctttgctgccgggcatcaaaaggaaacgctttcccgttgcgcgctgttcggcctgtttctgttgctcctgccgttgctgctcgatagtccatcgggctgccggtagcagggcctcggccagatactcgaagttgtagcggatcggctgaccatcaaggccgctctggacgtgaaccacgcggcagactttgccgctcttgctgttgaccgtctcgacagtacgcagcacgcggctggcgtccttggccattgggtcggccccgacgtgcgcgaggcgatccacaaggtagcgttggcaggcgttccagcggggtagggcctgtcgtggaatggtgccttccagcaaccacttggcctgtatgccccggccgctgtagatcagcacggacggcggcggcaagccctcttcggcgcagaaatataggacggacgcggccagttggtcaggcgctcgcccagacagcgcgggcacgcggtaggtgtcgaggtcggcgaacagcaggccaagccgcagaagattaacgactcgccgattgggtcggatgaactctgcctgggacatccacgtgtcacgttttttgtccaacaaactgagcacttttggcatatcagccaaacgatgagaggactggcgcttttcaccttgggagtcgacgagcaacgaaaaaaaaccggctctcgtcctatcgtggtacatctgcgcttcgtcctgagaactgaaaagcgcaatctgtaaacttgcgcttttcagctttacaaggtcgtttgcagtgtctgtgtaaggacgcgatgtcgaccttgtctcaggcctgaaccccaccgctcagtctgccattcctggcctaggagcggggccggactccctgcatgtatcaatccactcctctacctcggctaaatcccacacgaccttgcggctactcaccgcaattcgacgtggaaatttacccttcatttcaaagttatagatcgtgcgctcacacagcgggatcatcgccagaagtgtctttttgtcgattagttttttgatcgatgaatgcatagctaggccctatcagtcacagcgaatgtgtgcctgatcgtgcctttaggtgcctattgcttcgacagaatgattggctagaatggttgacatgaaaaaacaaacgaccatagctatttgggaggggtgttatgcctccgtcgcagaggcccttcaccgattccttgatcgctgggagccctactccacagcatctaaacgctatccgatcgttcgtctggtcgaagagcttatcgaccctgccgtggcgtcatatgccgaaacgcttccatcgcgttatcagggccatatacccggggcaggaacgaatgtagcgttcagcgcgattatccagcttgttggcattgccgctatggtccgcctacagcgtcagctgttacgagcttttgttctgactcacgacaagcagtcgggggatgatcgctgcttcattgcgacgcttgagacgttgatagaactggtgctggcatgtaagcgcaagcagccgtataccaaggatatggacggtttgaacggtcaacgcttgaaggggttttgtagattctgcggcgcgcgagcagagctagcattgttcgcagaaggtgaaggtcagcgtgaccttgatgaacacctacgcctgagcaacctgtactgcaccacccaccgcccaaagacaccagatggacgctggaatccggcatacaggcaagcaatgagatctgtagcgcagttcgacctagagctggccagattgagcagacaatgcgcgatacgagcagagcctaaggcaaagtcaggtgacgagctcgtcgacgcttatatctttcgatacatgcttagccaaaccctacacctagcggacgaagcggagctaagaaatctcgctcgactaatggtggacatgaagctgacagaccgaagaaagcaaatcctcgtactgcaaaaatttggcttcaaccagtcagaaattgctcgcagactggagatcgagcgccaagcagtatccaaagctcttcgctcaattcctgattgctttcgacttcctacagcgtgagtgcgtcaagcagcgtatggtgtatagatggccgcttttgtccgacttctggacatttggcaatgagcagcccgtggccggtggcgccatgttcagagagttggatcttaaggtacactcaaaaaattgggcttctaggctttgtacgaaaagtgcctgcgcgacgatcatgctgcgttgaaaacacagctggtctgccaacccggtcggaatgctcattgactacagtcaagtcgagcgcgactctgaccgttcctcgcctttttcgccttgcctgatcgtcgctctgcgacttttcgtacaaaccctagtttcaactgctggcaacccattcactcgaagcgcttgtagccctcgagcgctttttcatgctcgtctgcctgtcttttcagctttgcctgatagtgggcatattcggtcagcgctgcgaccgaagtgccgtttagttggtcgagcagggcagccttctgcttgaaggagttgcgctgtgggccggggaagcaatggcggtcgagaagctgcaggaacagggtcagtactttggctggagcgggcgcattgtccagcagtgccagtgacagtggtttccagtgcagcaggtcctgttccacctcggcccaggggtaaagcaggctggccaggagcgggtagtgctcatcgggctgcgtgttgcaccaggctacaagctgttcggagtcggcgtttgcaaatggggcgatacctggttggcggatgccgtgcaggcgttcgagcagttgtcggtcattgtcccgggccgcatcggccagcatttgcaaagccaggcaaggatgagcatcgatcagcgagacaactactcgcaagggggcatcccggcttccctgctttgttttgccttgctcaagcaggtaagtgatggtttttcgagccagcgccccactgtccgcgcaacacatcgctacctcgacggtcgcttccagttcaaaggggcgacaaggctgcgcgggcacatcgtcaaggtagcgagtgagcaggtcggcggccatgctggcccagtgtgaacagtcccggtggtcgagcgacgcctggaacaagcgcgactcgagcagatccagcgctgccggaaggccgtcgggaagggcggcgatgtcgtagatcagcgtgtgcaatgcctcctgagggacctccaggtaatcaggcacataggtcagttctgcaatgaccgtgaggggtatgcgcgtcagattggcatggactgcgagcgcgacatcctgagcgttcccatatgtgaagaaatacagatggatgaggtacggactgagcgtgggctgcaggtggaaatctgctgccagctcatccagggcagtggggtttgcgtgcgccataccgtggatgaacccttggatgaagctaaggttcaggcccttttcaggcgtggcatcgacgatctgctgccagacgttttgaggcagcaaagtgcccgtgcaaatgtggaaaccgaggtgcccggcagagttggggcttgatagcacggcaggcaaaaactgtggcaactgctgtggctcgtttaacagcgcctcggccaggcgtcgctgatcctgctccagtcgtgccatgcgagcgtcggaaatagcacggcgcggcttatcggcaatgtcgggtgagttgatcgaaagttcgatcagcgcatcgataccggaaggcgtcagcgcttcgatggcggtttcgagttgctgttgctgaaagtcgccgaggttcaggtctggcgcatcgagcaggccgatgagggcacccctggcctcgttccaccactcggtttgcgccagttgcctgaagtattcctgcagccagtgtgcggactccttgaaacgcagtaggcttctgctgtgaacaatgatcgtcgctcttgccggcgcggcgcctgggcctggcgccaaggccagcgcacaggccaattgtagcgtttggcctatccatatctccgggtcttccctggccgctggcattctggtatcgacaggcggctgcgccgccaacaaggtgtcggcgtgaatggggaaatgctcgagttcgagcagccctttcaacgcgcgttccccaacccaactgtctggaccgttgagcagcgagcttgcgacatccaggcgcagtacgagtggagcttcggtgccccagctggcaaagtggaacaggtactcgacaaagcgcagtacatactcgcgttcatctctattgcggtacgtgcgtttggccaggtgcaccagcaggtctatggcttgggcgaaatgctcggtctttcttgccaatgcgttcacggtcagggtaatgaagcgtcggctgtcgatatcgatagcggattgcggtgtcaccagctttcccaatagtgccagcgactcactgggagccaaggccgcgatgtagctgaacatccgccactcatcccgattcaactttgacgcgctgcccagccatccgctaccgttgaaccagcgttttaccaattgaactgcacgatcgttttcgcccaagtagttgagcctgtgacagaaagagagcttcaggcggcccggtgcatcgttgaacatctgctcgatagatcgcggcgatattgccttgagggcctgaacagccagtcggttggcaatcgcttcagggagtaatgcgcgatagaacccacgctcctgaatcaggccacggttgtgcagccttgagatctggcgatagaactgaccagcgcccatctgggccaagggggcgagatggcatgactcgtcgccttcgggtggttcgccgtcgacagcgaacgagtagacgagtgcggccacctctgccgcggcttccagcgcgggatcctcggccttcccctggcgcagtatgcggtagagcagttcggtatcgttcaaagtcgatacgtccttgccatgctcggcactagcaccaagccacagtgcgatccgggcattgccacctgcgaacctggcaatgctggagacagccagtccattgagttgcggatggctgcgttgaaccagcacttgaatcatcgcgtccgacgaaggatgcagtatgtacagattgtcgtaggactcgtctggctgcctgatctcgtgttcgatcgtcaggacgctaacctgcagcgccagcctgctcacgcgctctttcaatgcacggtgcagttctggtgggcagttgtcgattatcaggatgggataaggctcgctgtcgcacaacaacgaggccatttcgtcaggcgggggggtaagcgacaagccaatgtcaccgtagaccccgcgatgggcgggtagcgattgggcaccaacgccgtcttcgaacaatgcttgcgccaggcgcgtcttgcctgtgcctgggagacccagcaagcgtacgatgctgccgggcagggccagtgctgtgcggatgctgtccactgcttgtgccacgctcagcggcgctggatgccctgggcattcgacccgtggctggtcgtcgcacaggtaggcagacgcctggctttgctggccgacggccagcgctggctgccagttgccaatggggcgcttgaccgtttggcgcacccagatgaccagaccagggtagccgcgcacggccgtggccagtgtgctggcatcataaaagtcgaccttgatcatgcctttcaagccattctgatcaagggctgcctccatcgcctcgacccttggcacgatcaactcactggcgatcgacttgccacagacgatcacataggcgccggccacatgtgccagcgctcggaccgcctggcgcaatagttggtcaggacacatctctgccttgatcctttcggcggtgatattgtttctcttgacctgaaacaccgtgtcgggacatggaatgaagccatcggggcgcgcgtcggcgaacgcgctgacacgaacatccaccccgccatccttggatttttgatcaccgccccagcgcgccttgagcgcagattgcccagcgccacgctgttcgtactctgcaagcaaccccacgagtgtgcgcagctcgtcttcggccagcgcttcgatgtccttgtccgtgatttccagcatgaattccctgcagttctagacgcttggccgatggatgcaaacctggcgcaggatactgacaaacggaaaacatttcgagcaaggcgacacggctggtaagctcgatggcaaacactggggctaggctttgcacgaaaagtgcctgcgcgacgatcatgctgcgttgaaaacaggctcggaatgcgcatttacaacccgtaaactccgcttcctcgcctgttttctccttgcctgatcgtccctcggcgacttttcgtacaaaccctaagctaggccgccgctgacgatagccttggctagatctaaaaattacaatttttgctttcacaatatgtatttacattagctaagtgggtgtcttatggatgagtttgcattagaaaaaatgtcagatcgtattcattatggaaaaacgaaggattacttcaaagaagtcttatcctcataccataacggaaaccacagatcggcagttgtaatgctctggtcagtagccgtatgtgatcttgtgtacaaactacaaagcctgattgatttatatgatgatgcttcggccaaatcaatattggcagagatgagcaaaatccaacaagaggaccaaaagtctgcggcttgggaattgaggctgattgacgatattcatgataaaacgcatctcttggacagctcggagtatgaaaacttaagataccttcaaaagcagagacacctttccgctcaccctgttcttaatagagagcgggagctgcattcgcctaacaaggaaacagttaggtctctgcttcgtaataccttgaccgatgtattaacaaaacctccattttatactcagcatattctcaaggaactcctcatggatgtcgccgagtctagtgaaatgttgagcgatagggcaaaggtaaaaaagtacgttgtcagccgctaccttgaacgagcaactccatcagttgaattaagtatttttcgtcagctgtggaaatttgtctttaggcttgaggatgaaaattgcgtaaaaaaccgtttaatcaacttgcacgttctagaggtagtggcagctcgcaacaaggctgctcttgctaacacaataaagggtgatgttgattattatagcaatatcgccagctcagaaaccccactgcaatatttgacattctttatttctaataacccggaactgtttcccgtcttaagtgaggcggctcgcctgaaggtagagcattgtattgctgaggatgacataggaaaagttatagggtggtttgtcaaagaaagcatcatggcgcacggcgatgacttagagggctggatcaaaaatgattcgccggctatcagtccatcccaattcgactatatttttcagatttctgatactgaagagtggcaagagaaattttgcaatatagtcgccacttactatggcgtaagcggaagctacgaccaggcaaattctcgctttcaagtggccatacctcagtacattaaattttttaacaaaactgcaattaagtacctcgcagaaaaaattgaaaataatagccagtgccacgataggaacaaggcacgccacgattacgttatcatcaaagcgcgcatagatgagttatttggcaatgagtttgactatactcaataccactggtttagtcggaagctaggtctagcagactagtataaaatcttgaattttcaattaattggatatttaggtagctgccctccgtcaagggcagctttgggctgtgggttcaatcggacgatgcagagattagcgacatcgatccgcaggcgattcttagcctagtattttcctaggcttcttaagcgtccactcatcaatcatatccgcccaatcctgcaacatcgctcgccgctgatcccgatactcggccttgttgtaaacggctcgaacgcctttctgctcgtgcgcaagacacttctcgatccagtcagagttgtaaccagcctcatgcagcagcgtgcttgcagtgcgtcgcaaatcgtgagggccgaactttcctaggggaacgccttccctttgagcaagacggtaggtcagcgtcagtacctggttgatcgtggctgcgctcattggcaagtcggagtcgtagcgtgaaggcagaacgtactcagaacctccggctaaggttttcaatgcgatgaagaaatccaaagcttgccgggacagaaacaccaaatggggatttcggcgcttcattgttctggtcaagtttttccggacaccgattacggtggtcaagccgcctgctgctccatggctattggagacaggtagttattgtagctgtggagcctaattcggttataccgcatgaagaagctggtcatatcctgcctggcttcttcaactgtcgtataacccttggtgggcacccactctgacttgagtgtcccgaagaaacgctctgttggcgcgttgtcccagcactgtcctctgcggctcatgctttgcgttatcccatgttccagcagctcggactgaaagcgctgactggtgtattggcagccttgatccgaatgaaacatcaagcccccatgtttgcctcgaacctccaccgccattcttagcgccttgctaaccaggttggcgtcgttgatcagggaaaacgcccagccaatgattcggcgggcgaacagatcaatgaccgctgccaagtgataccagcgtttcccaaccatcaggctagtaacatcgccgcaccagacctgattgattgcggttggctcaaagttacgctcaagcaggttcttggccacaaatgcttcgacgcctctagagcgatattgatggcggcggcgctgcctgctggccagatttgcctccgccatgagttttccggccaaatgccgtcccaccttgacctgctgggccttcaagtgctgagagatcatccgcgcgcctgcacttccccggctttcgtcatgcagttgcacgacttttgctctgagcgcgtcacgcttggtattgggcgctgagcgacgcttaagccagtcgtaaaacgcgctacgggaaacgcccagcgcactgcaaagcaggcaggtcggatatgaactcgactccctcagctcctcgatcaggaaaaacgatcgggatccgacatcaagagagccgtagccttttttaagatttcagcctcggtctccagacgcttgaccttggctcgcagctgctgcagctctcgctgttcttcgctgattgccttggtaccggccactggctgccctttctgacgctctttacgaacctgatcaacccaacggcgcagagccgtagggccaacctccatcgatgcacagacgtcgggaactgagcagttatcatcaagaaccatgcttgcagcacgttgcttgaactcgcgggtataggtttttcgttcttgcatggaacctcctgaatgggcgaatcatatcgcccttaagaggtgtccgggatcattaggccagttcacatccgctctttggggatcgtccatagcgcctcgctgaagttgatttcgctccatgccgcgttggtcagctcgctcttgcgcaccatcgtcagcagaaggagctttgctgctgcgcggactgaagtcgcggttccgatcctatccatgtactggtacatcagcgcaatttcatcaggcgtcaacgcacggtcgcgtggctcgaatttagcgatgctggcagaccttactagatccgctggattttcaaccttctggccacgctcaatggcccaacgaaagacctgcagcacgatctcacgtgaatggacggcagttgcaggcgcaccccgctccactatcgcgtcagtcagcgctcgcagatcctcatgagtgatttcagccagcttctgattgccaaacttcggcttcaattcgcgctcataaactgaccggcgcatatctcgtgtcgagtccgccatctgatagccgcgcagccatttttcagcccaatcgtcaaaggtctctgcgcccttggtgcgagccttcgcacgcgccttttccttagcaggggacttacctgcggcgatcatcttcttcgcctcccctagcctctcacgtgcctctgccagggcgatcccgcccaagccataacgaccgaaggtgatggtctcctgccggccattgatggagtagttgtagcggaaggagattgagccggccggtgtaaccgccacgtacaagccatcgcggtcaatcaccttgtagagcttgtcttgcggcttgaggtttcgaagcttggtatcagtgagcatggcttccatttattccatgaaaaaataccatgctctgaaaagcgcggaagaatggggcttaaccccagtaaaaccgggcctcttggctatcccgataccatgcccatcctgaaacaagggacatggtatcaagcgtcatgcatggcatcgaatgcagttggtaccccgtaccatgccataaaaaaaccatgcttggcgatgcaaaacgctgcctgaacgtgccagacccaaaaagccaaaagcccgcaattacgcgggcttcagggcattttttgctagatcatgccgggcagtgccgaacgcgggatcattcccactcaatagtcgccggcggcttgctcgacacgtcataagtcacgcgggaaataccttcgatctcattgatgatccggccgctgacggtttccagcagttcgtaaggcaggtgcgcccaacgcgcggtcatgaagtcgatagtctctacggcacgcagcgccacaacccacgcgtaacgacggccatcgccaacaacaccaaccgatttcaccggctggaacactacgaaggcctggctgaccttgtggtaccagtcggccttgcgcagttcttcgatgaagatgtgatcggcgcgacgcagcaggtcggcgtattccttcttcacttcacccaggatccgcacgcccaggcccgggcccgggaatgggtggcggtagaccatgtcgtacggcaggccgagttccaggcccaggcggcggacttcgtctttgaacagttcgcgcagcggttctaccagcttgaggttcatttcctcaggcaggccaccgacgttgtggtgggacttgatcacgtgggccttgccacttttggcgccggccgactcgatcacgtcagggtagatggtgccctgggcgaggtacttgatgttgtccagtttgttggactgggcatcgaatacgtcgatgaaagtacgaccgatgatcttgcgcttcttctccgggtcggactcgccggccaggttgttgaggaactgctcctcggcgttggcgcggatcaccttgacgcccatgttctcggcgaacatggccataacctgctcgccttcgtgcaggcgcagcaggccgttgtcgacgaatacgcaggtgagctggtcgccgatggctttgtgcagcagggctgctaccacggaggagtcaacgccgccggacaggccgagcagcacgttgtcagtgccgacctgggcgcgtacctgggcgatggcgtcttcagcgatcttcgacggggtccacagagcttcacactcgcagatgtcgaggatgaagcgcgacaggatgcgcccgccttgcttggtgtgggtcacttccgggtggaactgcacgccgtagtaacgacgctcgtcgctgaacataccggcgatcgggcagctcggggtgctggccaggatgtggaagtcttcgggcatcttggtgaccttgtcaccgtggctcatccatacgtcgaggccgaacaggccgtcggcgtcgatgtggtcttcgatgccgtccagcaggcggctcttgccgaccacgtcgacacgggcataaccaaattcacgcagctcggaaccttcgaccttgccgcccagttgctcggccatggtctgcatgccgtagcagataccgaagaccggcacgcccaagtcaaataccgcctgcgggcagcgcgggctgtcggcttcgtgcacggactcggggccaccggcgaggatgacgcctttaggggcgaattcgcggatcgctgcgtcatccatgtcgaacgggtgcagttcgcagtacacgccgatttcacgcacgcggcgggcgatcagttgggtgtactgggaaccgaagtcgaggatcaggatgcggtgggcgtgaatgtcgagggccatgaagtcagtctcgtctaatgaatcagaaacaactcggggctgaaagaacagccccggttacttaacgttttgctggaagcctcaacctacgcggtagtttggcgcttccttggtgatctgcacgtcgtggacatgggattcagccatgccggcgccggtgatccgtacgaactccggcttggtgcgcatttcttcgatgtcggcgctgccggtgtagcccatcgaggaacgcaggccgcccatcagttgatggatgatcgcgctcagggtgcctttgtacggcacacggccttcgataccttccggtacgagcttctcggcgcctgccgaggagtcctggaagtaacggtcggaagaaccttgcgcctgggacatggcgcccagcgaacccatgccgcggtaagccttgtacgaacggccctggaacagttcgatctcgcccggcgcttcttcggtaccggcgaacatcgagcccatcatcacgcaggaagcaccggcgacgatggccttggacaggtcaccggagaaacggatgccgccgtcggcgatcaacggcacgcctgtgccttcaagggcagcggcgacgttggcgatggcgctgatctgcggcacgcccacaccagcgacgatacgcgtggtgcagatcgagccagggccgataccgaccttgaccgcatcggcgccggcttcggccagggccttggccgcagcgccagtggcgatgttgccgccgatcacttgcacgtcagggaagttctgcttgacccagcgcacgcggtcgatcacgcccttggagtgaccgtgggcagtgtcgaccaccaccacgtcaacaccggcagcaaccagcgccgaaacgcggtcgccggtgtctttaccggtacccacggcggcgccaacacgcagacgaccttggtcatccttgctggccagcgggtaagccttggctttttcgatgtcgttgacggtcatcatgcctttgagggcaaacttgtcgtcgacgatcagcacgcgctcgatgcggtgcttgtgcagcagttcgcgcacatcgttcttgtcggcgccttccttgacggtgacgaggcgctctttaggcgtcatcacttcacggacggtgacttcaaggcggttctcgaaacgcacgtcgcgggaagtgacgatgccgaccaggtcgccatcgtgcagtaccgggacgccggagatattgtgcaggcgcgtgagatcgaacaggtcgcgcacggtggcgtcggcctcgatggtgatcggatctttcaccacaccggcttcgtaacgcttgaccttgcgcacttcggcagcttgctgctcgatggtcatgttcttgtggatgatgccgatgccgccttcctgagccatggcgatggccagacgggcttcggtgacggtgtccatggcagcggaaaccaggggaatattcagctcgatgccacgggttaggcgggtcttgagactgacttcgttaggaagcacctcggaataaccgggcactaggagaatgtcgtcgaatgtcagagcttcttggctgatacgcagcatcgcgggggctcccgagcgggaaaatggaagcgcgccattatatacatgcaccctgccaggctcaatgtaaaactctgacaaacttggtattactgatagatggagaaaaccttctacatgggtatcgcttaaagctcgactttgacccaggcgatcttctggtccaaccaatcggcaaactcgtcgataaagctctgcttgaagcccgcctctgcccagttattgaagatgaaccccaggttggaaaacccgcattcctgcaggaacaggaagccgttgatgtcatcttcatgcccacacagcgggcaggtgaaattgtcggtgtggccgggcatccagtcttccaggctttcgaacagcgcctcgccgacttccttgaggcattccgggcaaccggcctcttcgagaaagcccttggccggcgtatagatgcaacgtttgtagatgatctccaggccattgaccggctcattgaacggcagcgcctcgggatgcagcaccacggcgcgggcgccatcggccagggcgtaggccatgcggttacccgtgcggccgcaggtggttaactcttccttgacgatgttcttgcgcaccagccagcgcacgattgcccgggcgcggggttcgtggaccggcaaggtggagattttcgggacgaggatgctttgggagttcatgggagtcctgcggtgtggcgtctggcgccatcgggggcaagccctcccacctttgaacgtattcacaattcaaaatgtgggaggggccttgccccccgatggcgccctaaaggctggcagcttaatccctgccccacacaggtcaagtgctcaaataccgcccgatcaacgcaataccactggccagcaccaaccaggtcaccaaacgcacaaacgcttcacgagacatgcgcatcgtcagcctgcgtccacaccaaagccccaaggccatcgccggcaacaggcagaccgccaacatcaacaagggcagatccgcgtataccccggcaaacagaaacaggctcaggcgcaccaccgtactgcaactgatcagcgcactttgcgtggcccgcgccgcgtccttggatagtcggctattgagataaatggcatataaaaagccgccactgccaaacaacgcaccaaacaacccgcccactgtgcccatgggcaccgaccaacccgccgccagccgcgtcggccgggccttcaccgccaggctataaagggcgtatgcgctgataaacagccccatcaacagcagtagcaaatccgaatgcagattgagcaaaaacaccacgcccagagtgcagcctatcgccatgcacggcagtaatcgcagcagctccggtgtgttcacctcccgtcgcgtttgcagcaggccgccaaacgccgcgacaaaatccagcagcaccagcagcgggatgatcttcgacagcggcataaacatcagcaagaccggccccgccaccaacgccgtgccgaagccggcgatgccaaacacgatataggccaccacaatgcccaggccgatcaccagccaatccactgcgccgaacgaccactgactcatccactcaaccgcgctcatgggctattccttaaaagacctggccttcactttagccatcggtgagtgttgcgactaatatcttcaaagccgtccacccatctctaaaaggcatgccccgtgatttctacccgtcaactgcgttacttcgtcgaaatcgccgacagcggcagcttcagcgccgcggccgagcgtctgttcgtggcgcagtcggccttgagccggcagatcaaggcgttggaaaaccaattgcagacccccttgttcgagcgcaccgctcgccagccgcgcctgacggcggccggtgaggccttttatccacgggcacgcaacctgctgggtgagctgctcaaggccagcgagatggcgacacaggtgggcaatggccagctcggcaccttgcgcctgagtcattcgagcaccgtgccgatgagcggcgcgctactgcagggcatcagcacctggctggagcgttgccccggggtgtcgatggatatcgccaaactctcctccgaggctcagttggaagaaattgccgacggtcgcctggatgtcggcctgttgcgcttgccggtgttgcgccagcgcgaaggggtgcgcgtggtgccgttgtacaacgagccattggtgctggcggtgccgccaagtcatcctctggcatgtagcgacggcgctgtggaattggcccggctcaaggacgaagcgtttatctcgatcccccacccacaacgtggcgggctgagttatctgtcggcagagctatgcatgcgcgccggttttttccccagggcggcgcgggtgatgtctcgcaagactacgcagttgcaattgatccaggccggcttcggcattgccctgttacccaagtccatgcaggacatcgcccctgccaacctgcacttcctgcccctggccgacccggactgtcacagcaccgtagccctggcctgcgcgcagctgccgagcacgctggtggagcaattctgtcaaaccctgcacgaatgcctataaactgccgcccatgattaaagatccctttgcccgcctgggcctggaccgcgaagtcctgactgtcagccagctcaacggccgtgcgcgggtgttgctggaagacgtgttcaccaatatctgggtcgaaggcgagatctccaacctcgcccgcccagcctccggccatgtgtatttcaccctcaaggacagcggcgcccaggtgcgttgtgcgctgtttcgcaacaacgcggcacgggtgcgccaggcgttgaaggacggcctggcggtcaaggtgcgcggcaaggtctcgctgttcgagggccgcggtgactaccagctgattctcgatacggtggaacctgccggtgatggcgcgctgcgcctggccttcgacgcgctgaaagagaagctcagcgccgaagggttattcagtgccgagcgtaaagtcccactgccggcgcatccacaaaggatcggcattatcagttcgccgaccggtgcggtgatccgcgacatcatcagcgtgttccgccgtcgggcaccgaacattgagctgaccctgatccccaccgccgtgcagggtcgcgaagccatcccgcagattgtgcgtgcattgaaactgtccgacgcacgtgggttcgacgcgttgatcctggcccgaggcggcggctcgctggaagacctctggtgcttcaacgaggaggccgtggtccgagcggtggacgcctgcgtgacgcccatcgtcagtgccgtcggccatgaaaccgatgtgtccatctgcgattttgtcgcagacgtgcgtgcgcctacgccatccgccgccgccgagctgctcgcaccggacgccagccactgggtacgccaggtcgacaacctgcaccgccgcctggtgatgctgatgcgcaaccgattggcccacggccgcctgcgcctggaaggcatggcccggcgcctgcgtcacccaggcgagcgtttgcgccagcaggcccagcgcctggacgaccttgacatgcgcctgcgccgcgccttcgagcgcagcctcaatacccggcgcgagcgcctgatccgcctggaaacccgcctcgccggccagcatccggggcgccaactggcgctgttgcgccagcgcctggacagcctcgccgaacgcctgccccgtgccatgcgcgaaggcctcaaggcgcggcgtctgcaactgcaaagccaggtgcagacgttgcaggtggtcagcccgttggcaaccctgggtcgtggctacagcatcctgctcgacgagcgcggccaggccattcgcaatgccgcacaaacccacaccggccagcgcctgaccgcgcgtctcggtgaaggccaattgcaagtgcgggtggaagacaaccacctgacacccgtcaccctttcgctactggattgattgatgccacgtctattgagcttattgctgctgctgtgcctggccgttaacgcccaggctgacagctatatcacccgcaccctgaacaaaccggtgccgggtggcgtggcggtggtcgagctgggcccgtccgccacggcgccgaaggctacttaccaaggcaagccggtgctggtggtcaaggagcaggacaactggctggcgattgtcggcatccctttgacggtcaagcctggcaacgagcgcatcagcagcggcgggcgcaatctgccgtttatcgtcggctacaagaagtacccggaacagcgcatcaccttgaagaataaaagccaggtcaatccagcccctgcgcagctcaagcgcatcgaaggggaactggccgtgcagctcaaggcttaccgcagcttcagccctaccctgccaagcaacctggtgctggacaaaccggtgaatggtccgctgtcgagcaggttcggcgtgcgccgattttttcaacggtgaagaacgcaacccgcactcaggcctggatttcgccgtgccggccggtacgcccatcaagacgccggcgaacggcaaggtgatcctggtcggcaactactttttcaacggcaataccgtgttcgtcgaccatggccagggctttatcagcatgttctgccatatgtcgaagatcgatgtgaaagtgggtcagcaactggtccgcggtgcggtggtgggcaaggtcggcgcaactggccgagccaccgggccgcatatgcattggaatgtcagccttaacgatgccagggtcgacccggcaatttttatcggcgcatttcagccttgacagccatgcctgggcgccttcccctgcgcgcccttctctttcctcccgcctagcctgaactgcaccgatttcactgcaacacgctcgctcctgcttacatttgcagcaggaaccaccggatggtcaatacgcacccaacctacgcgttacccggagcgtaacgacgatatgaacagcccattcatcctgcgagtgcccgcttatgcctatgcttctagaggctgctccgcgcagcccctttgacgccttttatcgtctctatgtcgacaacgccggcgtccatcgtccagccgatacacaccaatctacgtcctcgccgccagcggccttgagctatgccccagacgatctggcgctgcccacgtcttccgggattgcccccgtcggcgtgcattaccccaagcttgtgaagcagttcaacgtcagtcaccagcgcgcgttccttacccagcacgacagcctcacgcaagagatgcaacgcctgcaaagcgaacaaccgagtttcaaggcctttgtgcaagcgcaacttgaacaggcctttccagacctgcgccccctcgccgccgacaccatcagtttcaatcgctaccgcagcgacggcgacgtcgaaacacggctgtcatcagaacctctgatgaaggccctcggtgaaaaggtgcgcaacatcctggccaacccgaatacgctcctgcacgcagaacgcaaggtacgtaccgaattcacgactcgccccacgcctgccgatgagcccaagacgttgagcacctccagctcattgcaatcaattgcacgcgccattgccacgcagtatccggcgtacccgcaagcgttctggagtacgccacggctgacgccgatggatgcacagatcgagaaaatcctgaacaccccgcaactgccgaaagtcccgcaagaccaactgctgagcctgcacaaacaacaactgtcgaccctggccgcgctgcgtgtcagcgacggcaccctgagcccggccagcaaacgcttgatagatatcgccctgcaatatcccacgctggccgatcgggaacgccagttccccaacggcgcacgcccgggcgtgtatcccatcaccctggatgacggcaccgagcacggtgccatgctggcgggcagtttccttatcaccagcaccgacggctgcgcagccaccccgccaacctggtcaaaagacggcaggcgccttgctctcaatgacctcaatggccccgtcgtgctgtacacacccggtgagggtttcgaggagtttgccaccccggctcaggcacgccaggcgttggcggcacgccttgaccagggcggaatagacgccgaactgctgctgcaaaccgcgccgttgtcggtacaaaaccaacccgaagcgccttcaggcaaagacctgatgcgcagtgttgaacccctgagcggcgacgtgctggcagaagcaatccccttgatgctcaaacgccaggagacgcagatcaatgcgcacctggcccaggcattggcgccaccagtcactggcgccggcagcaacgccttgctggatccagcgtcaatacaaagcctcgatgacgcagcagatgcactctttgtattcgatggcaccaatgccatgctggcacgcgacgccaagctggccgaaaagctgcaaccgcaatggttgaaaaccctcgaaccggttcaagcagcgctcttcgaaaagctggagcattccgaaggggaaagttcgcgccagttggcctcactgctggaaaagatcccgtccctggcggatttttcccgggatcggctgaaccaagcgcttagccgacagtacccgagggcacgcctgaatgctgaccaactgatggttcaggtcgacactcgcacaaccattcacagcggccgaggcagtggtgccaggaccacttttcccgctcagcgctcagtgtccctgaccgacctggcattgcaaaaccccagcggttttccagccgtcgaacgcggccaattcacccataccactctcacgctgccgctggtcgacacccagggcaagcccctcatcgacgccaagggcaagcaggtgatactcgataccgaaacgctcaaaacactggtcaataccgcagatgtgggcggcgagtacaccaagctgcttgaacaggagctggcgcctgatacggcgtcggggcctgctgcgcaactgcgccaggcctggaaagccaacctgaacgacctgatggccaaagaaagctttctcgccgagctcaaccccgatgcctatcaaacagaggctagccaggacaaatcgacaaaacgcgctgcgcaatgggtcgctgcggtgctggattatcccgacccggccaatcgccctcaggttgatggcaagaccatcgtcgccaacagcctcgtgcaatacggcttacccgtccaaggcgtgctcgtgatcggcaatcaagtggattcatcgctggtgctgtacgcacccgatgctccagatggcgtagtgtttcgtgaggtcgctgaccaggccgcgctgaacaccctgctggaaaaagatgagtggacggcctacaccgcccgaagaaaatcaccggtaaataaagatgacttcgtctcgttcattgagaccgccaagaagcgcctggctaacccattggcgataaaagatccttatgaaataaccagcctggccgtccaggcgttaaagctcaaaggcggcgatctgactctcgagccgataacaggcaatgtagaggatcacctgtataagcaacacgtgcagttggtgatagacaaggctgactaccagtccgtcagcagtgcagaagtggcggcccagtcgaaaatcaacaaagtcgagttcggcattgaagtgggcacgctgttgctcgacctggtaccggtactcggcaagggcctttccgccggtgctcgcctgggcaaagcggcggtgactgcgctgcgcgccaatagccagctgttgccacacctgatcaagaaccccggcctgggccgtgggatctacgccgactttaccctggccgcagcgcgcatccccaaccttcgcgcttcgtcaatgcggccggtattcaatgcgtcaacgactgccgtcgccaacccgatacgccccgccgcaagggcgctgcctgcgccggctagccccgcacccgctatcgcctccactagcagaggtgtggaacaaggtgtcgtgcagacaccggccctgggggtcgctccaagccgcgacctgagcgcctacgccaaacccgacgatataatccttggtcgtcagttaggcaccaacggtacctataatgtcgacgacaattggtatatccgcttcaccgatagcactggcgtgaacaaggtttatcagatcgactctgcatttcacgccagcagtgggcaggccaatatcatcgaccccaatgctccgctgacgaggagcaaaagcagcaggatcgtggcgtcggtggaacacgcaggcaacggtgaatggcgcctgaatcgactgcccggaggagcaccgacgccggtagcaaatgcatcgggatcgggatcggcttcagggtcaggggggtcagggtcaagctcagcttcagcttcaggatcacaagcagtagaagcgccagcatcgacagcgcaagcgcccgccaagcagaagttaaccgaccacgaatatttcagcatcaccgacggcaggttggtcgaaaatcactttacccccgcaagactgcccgtattcagaacctggttcaggcgcgacttgattcacttctatcggaacatgcttacgcccggccagatgccgccgcgcccgcctcggctggagcttgcacccggcacgtcgcccgccgatctcttgcgcaaggcttatgacgtcactgacattgtgatattgggcgagtctcatcgcgaaatcgcgagtttccagatgatcaaagaatgcatgccagccctcaaggaggcaggcgtcaccaccctgtatcttgagaacatcgaactcaatgccgcaggccagcttatggatgtcggcatgggtggtcatcggccaccaggcgcgtctcccacactctccgaactggttaagcttgccaatgacaatggtataaccgtcaggcccattgagcatcactacttgacccgccgttcggatatgcccgatttctacaagtacgtcggggacaatgacaatggcatcacacgcctgcaggaactcaactacttcgcgacccgtgtcatacaaaagcgcaagcccggcgaaaaagtactggccctggtaggcagggcccatatgaacacggctcgcaacgtaccaggcctggccgaactgaatggcggcataggtataggggtgtacccgaacacttcattctccaagagcacggccatcagcggcccatccatccagcgcgatcccggggccggggtagcggacagccttacggtaggggattatcaggttttccagcaagtgacctgaatgtgttagtcgcgcatggcctgcgcaatggcgaaccgatcgccattgcgttgtgcacgcctgaactatgcgacaaaacccgaactcaataaattgcgcgctgcttaaaagcagcgcaacaacaacaaatataaaaaataataaccgcaataattaaccttaaaaccgcataaaatcagaaaatctatcaatttttcctgatcacttgccatctcccctgcccacggttagggttgggcttatgaaaacctctcacaccctcattcagcttcgccagcaccgcagcctgtgccttgtcagcgcacgactgccaggctgaatcgatctgcctcgtcccaagctccatccccaataacagttgcatggcaggccgcctcttctcggcccctacacaaaggatttcccgatgagcatgctcaaagacccgtcttccaagtaccgcgcgttcccgactatcgatatcccggaccgcacctggccctcgaaaaccatcaccaccgcgccgatctggtgcagctccgacctgcgtgatggcaaccagtcgttgatcgagccgatggacgctgcgaagaaattacgcttctggaaaaccctggtcgcggttggcgtaaaggaaatcgaagcgtcgttcccggccgcctcgcaaaccgatttcgacttcgtgcgcaccctgatcgaagacaaccacatccccgaggacaccaccatccaggtgctgacccagggccgtgaagacttgatcgcacgcaccttcgaatccctgcgcggtgccaagaaggccatcgtgcacttgtacaacgctacgtcgccgtcgttccgccgtatcgtgttcaaccaggacaaggatggcatcaaggccatcgcagtcaacgcggccaaactgttcgtcaaatacgctgcgcagcagccggaaacccagtggaccttcgaatactccccggagaccttcagcgcaaccgagcttgagttcgccaaggaagtctgcgacgccgtgatcgaggtgtggaacccgacgcccgagcacaagatgatcctcaacctgccggccacggttgagtgcgccacgccgaacatctatgccgaccagatcgagtggttcggtcgccatatcaaccgtcgtgacagcgtgatcatcagcctgcacacccacaacgaccgtggcaccggcgtggccgccaccgaactgggcctgatggccggcgccgaccgtgtcgagggctgcctgttcggcaacggcgagcgtaccggcaacgtcgacctggtgaccgtggcgctgaacctctacacccagggggttaaccccgaactggacttctccgatatcgacggcgtgcgcaaggtcgtcgaagagtgcaaccagatccaggtgcacccgcgtcacccgtatgtgggcgacctggtccacaccgcgttctccggctcccaccaggacgcgatccgcaagggcttcgcccagcagaaagacgatgcgttgtgggaagtaccgtacctgccgatcgacccggccgacattggccgcagctacgaagccgtgatccgcgtgaacagccagtcgggcaaaggcggcatcgcctacctgctggagcaggaatacgacatcagcttgccgcgccgcatgcagatcgaattcagccaggtggtccaggccgagaccgaccgcgttggcctggaaatgaccgcaccgcagatctacgccttgctgcagcgcgaatacctgcaagccaacacgccgtatgcgctggtcagccatcgtctgcaggaagaaaacggcaacagctttgtcgaggtggaagtctccggcaagggccagggcgagaccaacctgcactggaaaggcaaaggcaacggtgcgctggaagccttggtggctggcctgccgattggcgtggagatcatggactacaacgagcatgcgatcggtgcaggcaccaacgccaaggcggcggcctacattgaactgcgtgtgaatggcgagcgtccggtgcatggtgtgggcattgatgaaaacatcaccaccgccagcttcaaggcgctgttcagtgcgctgaaccgctcgctgagccagttggaagccaaagcggcgtaatcggctgctgaaatgtgaaaggcccctggatgtgaatccaggggccttctcgtttcaataccttgtaggagcgagcttgctcgcgaaaaacccaaaggcaccgctggcaacctgataacgctgcgttatcgttggcgcttttcgcgagcaagctcgctcctacaggaactggaagctatcggcatccaggttcgctggaaacctggtgcgataagcagccaactccgccgcatccagaatcacctggaacaccccgtccgcctcccctgcactcagcaaggtttcaccttggaaatccagcacctggctgtcgccggtgtaggcgaaacccttgccgtccgtgccgacccggttcaccgccgccacgtaacacagattctcgatggcccgcgccggcaacaatcggttccaatgctgacgccgcgcaccgggccaattggcggtgtacaacagcaagtcggtgtcctgggcatcgcggctccataccgggaagcgcaggtcgtagcaaatcagcgggcgtatgcgccagcccttcaactcaaactgcacctggcgttcaccgggggtgtagtgatcgtgctcaccggccatgcggaacaggtgacgcttgtcgtaatgcaacacctcgccatccggccttgcccacaacaggcggttgcggtggctgccatcggcggcctggataatcacgctgccagtgatcaccgcgttgtatttggatgcctgcgcctggagccagtgatgggtcgggccgttttccggctcggcgagcgcttcggactccatggagaaaccggtggtgaacatctccggcagtatgatcaggtcggcgccattggcctgctccagcagcagctcaaaatgctcaaggttagcctgacggtcatgccacaccaggctggtctggatcagggcgatgttcagattgggcagtgcactcagatcacgcatagcttttcggctgcttgttgcagcgtctcctcgcgtttggcaaagcacaggcgcaccaggcgctggccttggggtgggttctggtagaacaccgagaccggtatggtcgccacgccgtgttcgcgggtcatccacaaggacatggcaatgtcatccaggtctgggcgaatctgtgagtaatccaccagttggaaataagtgccgctcacccgggtaaaactgaagcgggatggccccagcaggtcgcaaaacatgtcgcgcttggcctggtaaaaggccggcagttcttcgacatgctccgggtgatcagccatgaagtcagccaaagcgtactgcaaaggggtcacgccgcaaaagttgacatattgatgcaccttgcgcagttcggcgctgagggccgggggagcgaccacatagccggttttccagccggtcacgtgataagtcttgccgaaggaactgaccacgaaagcgcgctgatacaactcttcgtgggcgagaacgctgacgtgtggcacaccgtcgaacaccagatgttcgtagacctcatcgctgaccaggtagatatcgcggtcgcggatcagttcggccaactggtccagctcggcacggctgatcagcgcgccagtcgggttatggggcgagttgatgatgatcatgcgggtgcgcggtgacagtgccgccttgatcttctcgaagtcgagggcaaagccgtccaggctcagttgcacgtgcacgcaaagaccaccggccagctccactgagggctcatagctgtcgtagctggggtcgaacacgatgacttcatcgccattgcgaatcaccgcctggatcgcacagaagatcgcctcggtggcgccaggagtgatggtcacctcgctgtcggcattgactgtggcgccataactgcgagcaattttggcagccacctgctgccgcaacacgggcaagccggtcatgggcgcgtattggttgtgacccagagcgatatgcttgcccactgcgtcgagcaaaccttgcggtccattgaaatccgggaaaccctgggacaggttgagcgcgccggtttcagcagcgagttgcgacatggtggtgaaaatggtcgtgccgacgttcggcagcttgctggtgatcatcagaggcccctgcaggtgagcctcaagttttaagctgccaattgcatcgggtcaaggcacaaacggccgcgcataaaaaagggctccaaaggagccctctcttgcagcttgtcgctcacaacttatagcgcctgctatttcttgtcgcgacgcttcttgtcggccttcttgtggtgagtcatcaaacgacgcttcttgttcacctgacggtcggtcagtgtgttcttgttgccttcgtatgggttctcgccacccttgaactcgatgcggatcggcgtaccgaccagtttcaagactcggcggtaagtgttttccaggtaacgcacgtaggacttgggcaccttctcgatctgattaccatggatcacgataatcggcgggttggcaccacccaagtgggcgtaacgcagtttgatccggcggttgttgaccatcggcggggcgtgctcgcccacggcgtcttcgaggatctgggtcaggcggttggtcggccagcgggtgaccgcagacttgaacgagttctgtacggaggcgtagaggttgcccacgccggtaccgtgcagtgccgagataaagtggatgtcggcaaactcaacgaagaacaaccgacgctgcagctcgatcttgacgaaatcgcgctcgctcggcgtcatgccgtcccacttgttgatcgcgatcaccagggcccgaccggcttccagggcaaagcccagcaagttgaggtcgtggtccaccacgccttcgcgggcgtccatcacgaagatcaccacgttggcgtctttgatcgcttgcagggttttgaccacggagaacttttcaacttcttcgtggatcttgccgcgcttgcgcacaccagcggtgtcgatcagcgtgtacttctcgtcgttacgctcgaacgggatgtagatactgtcgcgggtggtgccgggctggtcgtagacgataacgcggtcttcaccgagcatgcggttgaccagcgtcgacttgccgacgttcgggcgaccgatgatggcgatcttgataccgtctttttcgctcgggccaggaatgcgcttggcttcctcgccttcggcaacgatctcttcatcaccctcttcttcctcgacgtcatccttggggaaatcgcgcagggcgatttccagcatctgggtgataccgcgaccgtgggcaccggcgaccgggatcgcgtctcccaggcccatcgggctgaattcggcacgggctgcctcaggatcgatgttgtcgatcttgttggcgaccagataggaacgcttgttacgcttgcgcaggtgctcgccaatcatctggtcggcagcggtgtagccggcgcgggcgtccaccaggaacaacacgacatcggcttcttcaatggccagcagcgactgctcggccatcttttcgtccatgccatgctcgtcaccggagataccaccggtgtcgacgataatgtaggagcgcccttgccactttgcctcaccgtattggcgatcacgggtcagaccggacaagtcgccgacgatggcgtcgcgagtcctggtcaggcggttgaacaaggtggacttgccgacgttaggtcggcccaccagggcgattacgggaaccatgcggctctccacttcgttatttcagaaaatacaaaagccgctgcagggcagcggctggtgctcggggcggcatttgaaatgccacatgccctgctctggcaccaccactgtaggagcgagcttgctcgcgaaaaacccaaggacgacgcgtctatccagaaaacccgcgttatcgttgaagtccttcgcaagcaagcttgctcctacagcaacaggcattgaaacagggccgcctggggggttaccccaagcatagtcaaacctttacttgatggtcagggcttccagcgtgccgccgttgccatacacataaagcatgttacctaccaccagcgggcgtgcacgcaggccgtcgctgtcgatacgctggcgacccacaaagcgaccgtccacctggctcaacaggtgcaggtaaccttcgaagtcacctaccgctacgtagctggagaaaacttccggagccgacagttgacggcgagccagtgagtcgttgctccacagtgcggtggtggaacgctcatcgacgctttcaaccgtgccggaggccaggctcacatagacgctgccaaacccttgggcgacacctgcatagctggaagcatcacgctgccagttgatgcggccgctctgcaggtccagcgcagcaacacggccctggtaggtggcgacgtagagggtttcgcccgacagcagcaagccaccgtcgatgtccacgacgcgatccagctcggaacgaccttgtgggatagccacacgggtttcccaggccggcacgccgttctgggtattcaaggcgaccactttaccggtcgacaggccagcaacggcgaggttgttggtcacaatcggaccactggtaccgcgcagggtcaacaccgccggggtgctgtcgtataaccagcgctggtcaccggtggaggcctccaggccgatcacgcggtcatcctgggtttgtaccacgacgatatcgccgttggtcgcaggtgccgagagcacttcactggtcacgcgagcgcgccatttttcttcgccggtgctggagtcgagtgcgaccacgtcacctttgagcgtgccgatcagcaccatgccgtagccgacgcccacaccgccggaaaccggcagctcgaggtcttttttccacttcacatcgccattcatgcgatccatggcaatgaccacgccggtggagtcggtggcgacgatgttgtcgccgtctatggccggctgcaacagattgtagaggtcgccctgaccatcaccgacggagcggctccattgcttttgcaggaccacttcttccttgaagctggtcagctcggcaggtggcagttcttttttgctgttgctgctgcaacccgcggccaaaacggccagagccagcaatgctgcatgtttccaacggatcacgtcacgcatcccctttggccaagtcgtcgagcttgatttgtaagccaccgaccgccgcttcatcagacagcgccgccttggctttttggtacgcagcatgggcttcgtcggtacgacccaattggaccaacaggtcgcccttgagctcttcgcgagtggccacgaatgccttgtcagcatcgccgtcgagcagtttgagtgcttcgtcagccttgttctgtgccgccaatacctgtgccaggcgctgacgtgcgatttcacccagggtcgggttggtcggcttgtcggcgatggccttcagctcagtggcggcatcatccagcttgccggtatcaaccgcgactttcgcgacgaacaggctgccgtactgggcgtaggtgctaccgccgaattcgttcttcagcttgccagccaggtctgcaacctgcgcggggtcaggcttgccgtccggcgtcagggtggtttccagcaattgctgataaacgatcgaggcgccttgggactggttggcctgatacttggtccaggcttgccagccgaacaccaccactaacgccagcaggccgccagtgaccaggggcttgccgttacgctgccaccagtccttgaattcggccagttgctcatcatcagtactcgacaccccaatactccttaatcgctaaattcggctgttcgacagcttcaaccctgcacgacgcaggtggccaagtgcgcagcgagcgcatcaaaggcaatgttctgttgttcgccctggccacgcaggggtttgaaacctatcacttgctggcccagctcatcatcgccgaggatcagcgcatacagcgcaccgctcttgtcggccttcttgaactggcttttgaagctaccggcgccggcattgatctgcagccgcaggttcggcagttggtcacgcactttttcgctcaaggccagggcagccagttcggcggcctcgccaaaggcgcacaggtacacatccacctgacgggaaatctcttcgggcacctgctcaagggtttcgagcagcaggatcagccgctcaatgcccatggcaaagcctacgcctggggtcggcttgccacccatttgctccaccaggccgtcgtagcgaccaccggcacacacggtaccctgggcgccgagtttgtcggtgacccactcgaacacggtcttgctgtagtagtcgaggccacgcaccagcttggggttgatcacgtagggaataccggctgcatccagacgagccttgaggccatcgaagtgcacgcgggattcgtcgtccaggtagtcggccatcttgggcgcatcgaccagcacggcctgggtgtcggcgttcttggtatccagcacgcgcaacgggttggtcttcagacggcgctggctgtcttcgtccaatttgtccaggtgcgcggacaggtactcgaccagggcttcgcgatagcggccccgggaatcgctggtgcccaggctgttgagttcgagcttgaccgcatcgcggatgcccagctgaccccacaggcgccaggtcagcacgatcagctcggcgtcgatgtccgggccgtccaggttgaaaacttcgcaaccgatctggtggaactggcggtaacggcctttctgcgggcgctcgtggcgatacatcgggccgatgtaccacattttctgggtctggccaccaccggtgatgccatgttccagaacggcgcgcacgcatgcggctgtgccttccggacgcagggtcagggagtccccgttgcggtcttcaaaggtgtacatctctttttcgacgatgtcggtcacttcaccgatggagcgcttgaacagctcggtgaactcgacgatcggcgtgcgtatctgcttgtaaccgtagttatcacacagacgcgcgacagtgctttcgaagtagcgccacagtggcgtctgctccggcaggatgtcgttcatgccacgaatggcttgcagagacttgctcacatcagatccttaaattcgttcaatcagccgcgagcgatcagcgctgcgtcagcggcgaccttctcggccgctttctcgcggatcagcttttccagctcatccaccagattgtcattcgtcagtttctgcgacggcttgccgtcgatgtaaatcaggttcggcgtaccgccagtcaggcccacatgggcttccttggcttcgcccggcccgttgaccacacaaccgatcactgcgacatccagcggcaccagcaggtcttcgaggcgcaactccagatcgttcatggttttcaccacgtcgaagttctgccgcgagcagctcgggcaggcaatgaagttgataccacgggaacgcaagcgcagggacttgagaatgtcgtagccgaccttcacttcctctacggggtctgccgccagggagatgcggatagtatcgccaatcccttcggcgagcagcataccgagacccacggcagatttcactgtgcctgagcgcaaaccgccagcttcggtgatacccaggtgcaacggctgcacgatttccttggccagcaggcggtaggcttctaccgccatgaacacgtcggaggcctttacgctgaccttgaagtcctggaaattcaggcgctcaaggtgctcaacatggcgcaaggccgactcaaccagcgccgccggggtgggctcgccgtattttttctgcaggtctttttccagggagccggcgttgacgccgatgcggatcgggataccacgatcacgggcagcatccaccacggctcgcacacggtcttcgcgaccgatgttacccgggttgatacgcaggcaatccacgcccaactcggcgacgcgcaacgcgatcttgtagtcgaagtgaatgtcggcaaccaacggcaccttgaccaactgcttgatgcggccgaaagcctcggcggcatccatgtccggtacggaaacccgcacgatgtccacaccggccgcttccagacggttgatctgggccacggtagccgccacatcgttggtgtcgctgttggtcatgctttgcactgcaatgggggcatcgccgcccaccggcacagagccgacccagatcttgcgcgatacgcgacgtttgattggagattcgccgtgcatgactattgtcccaacttgaggcgagcagtctcgccactggtgaacggcgccacgtctacaggctggccgttgtaggccacttgcgcgccacgggcaaagcccagacgcagcgtcaaaggaggcttgccgccctggtccagcgtatctcccttacgcttcaaaccgctgaacagcactttgccgttgccatcggtgacctgcgtccagcagtcagcgacgaaggtaatctgtactcgcccatcaccggcgatcaacgccggggtggtgggaggcgacatcgccggcgctgtcggtgcggctggcgcgggggcaggtgtcggtgcggccggtgcctgggccacaggtgctgtcggggccgctggagccggtaccgcaggcgtcgcagccggtgccgtggcggtttccggcacaggctgctcgacagcggccggcgcttgcggcgtggtttgcccttctacaacggcctggtcttccggctcatccagcggatgaatctgggtggtgccgtcggcgctttcgacttcgacgtgctccatggcattgctggtcaggtctttgctgcgctgggaggcctggtcttgccaccagacgaaaccgccgccgatcacggcaatcagcagtaacaggctgacaatccgcaaaatcgtatgggaaacccgtgttggttcttcgatgcgccccaggccgtggacgttactgccctgggagtcggtaccggtgaactggtcaaattcctgcaccagcacagtctggtcgatccccagcagtttggcataggcgcggatatagccgcgggcaaacgtatgcccgggcagcttgtcgaacgcgccggcttccagattggccagggacgtgctggtcaaattgagcttgagggccacttccgccagcgaccaaccattgctttcgcgggcctgacgcaaggtgtcgcctgggtttacgcgattagctgctacatcttccgggtgcgcggctttcatcattgctccgacaggtattgctgatattccggcgtaccgggatagagtcgttcgagttgctggccaaaacgtgcggccgtgtcgtgttcttcatgaaccgtcgccaggcgcacaccgagcaatagactacgtgcattttgcccgctgagcaggctaaaacgctcgtaatagtctcgtgcaggcacataatgcctgtcttcgtacgacaactcagccatttcgagcaatgcccgaggctggcggctgttcagatgcaaggctttttcaaggtgctgacgcgcgttgtcgcgctggccgaggcgcatcgaggccacaccgaggttctcgaacactcgcgaacgctccgggtagagggtatcggtggcagcctgttggaaataacgcgacgccaggtcataacgcttctgctcgaacaggaaactgccgtagttattcagcagccgtgggtcggcagggcgtgaagccagggccttgtggaaatagcggtcggccagttcaggctcggcctgggcctggaatacctgggccagtgcggcattggcgtcggcatcctcgttgtccagctcaagggcctttttcaatggcaccttggcctgctcgctcatgccttggcgcaggtagcccaagcccagctgcacataggcaactcgcgcctcatcacggcctttatccgtttgcaaagggctgacatggcccgatgaaacgcaaccggccacaaggccggtaaccagtaaaagcagcgcaaggcgcaagggcatagagttcctctctcagattcgattcacagcaatttgcggcaaatcttcagcggcgttaagttcgcgcacggcgatataacgttcgctgcggcgggtgcgatccatcacctgccctaccaattgaccacaggcggcgtcgatgtcttcaccacgggtggtgcgcacggtgacgttgtagccggcctggtgcagttgatcctggaaacgacggatggcgttgttgctcggccgctcgtagccagaatgtggaaacgggttgaacggaatcaggttgatcttgcacggggtattcttgagcaactcgatcatctcgaccgcgtgctcgaccttgtcgttgatgtccttgagcatggtgtactcgatggtcaacacgcgcttctcgcccagggtcgccatatagcgctggcaagactcgagcaacatcttaagcggatacttcttgttgatcggcaccaattggttacgcaatgcgtcattgggtgcatgcagcgacaacgccagggagacgtcgatgtgcttggccagctcatcgatcatcggtaccacgccggaggtcgacagggtcacacggcgcttggagatgccgtagcccaggtcgtccatcatcaggtgcatggccgcaatcacgttgtcgaagttcagcagcggctcacccatgcccatcatcaccacgttggtgatggcacggtcgacggtcgccgggacgctgccaaaggatttgttggcaatccacacctggccgatgacttcggcggcggtgaggttgctattgaagccttgcttgccggtggagcagaaactgcaatccagggcacagcctgcctgggacgaaacgcacaaggtgccgcgtttgccctgggggatgtacacggtctcgacgcagctgccggacgccacgcgcaccacccatttacgggtgccgtcgctggaaatgtcctcgctgacaacctcgggaccacgcacctcggcaatggccttgagcttgtcgcgcagggccttgctgacgttcgtcatggcgtcgaaatcgtcgacgccaaagtggtgaatccacttcattacctgaccggcacggaaacgcttctccccgattgagtcgaagaatttctccatttccggctgagtcagacccagcaggttggttttaacagtcgatgtagtcatggattcaccctcactctttaagccgatgcttagcgagcggttacttcagtagcagcgaaaaagtacgagatttcgcgagcagcagcggcttcggagtccgaaccgtgaacagcgttggcgtcgatggattcagcgaagtcagcacggatggtgccggcagcggcttctttagggttggtagcgcccatcagctcacggttcagagcgatagcgttttcgccttccagtacctggacaacaacaggaccggagatcatgaaggcaaccaggtcgccgaagaagccacgagcgctgtgctcagcgtagaagccttcagcttcagccttggacagttgcttgagtttcgaagctacaaccttcaggccggctttttcgaaacgagtggtgatctcgccgatgacgttttttgcaacagcgtcaggcttgatgatggagaaagtacgttgaacagccatggtgtaactccagaaacggtaatttacgaaaaattaaacccgcgaattatacgcgggttattaggtattgcctaactgcgtaaaaaggcggctcagtctgcttcttcgatccacaggccttgaatcgcctccaggaccttttcgccaccccggtcagggatgtcgtcaaaatccggcagcgccattacgaggttgcgcagcttgacgaagttcacggtaagaggattgacctcagggtgagcttcggcaagttgtatagcgatttcttgtacatcaacccatttcaggctcatgacagttccttgaatcaatgcggcgcttcggcggcatggttaagcgaatatttcggaatttcgacggtgatgtcttcagtgccaacctttgcctgacagcttaagcgagaggtggcttccagaccccaggcacggtcaagaaagtcctcttccacctcatcggcttcctccaggctttcgaaacctttacgaatgatgcagtgacaagtggtgcaggcattcacgccgccacaggcactttcgatctcgatgtgattgtcatgcgcgacgtcgagcagggacttgccggtctcagcttccacgaccttgccctcagggcaatgctcggcgtgcggtagaaaagtgacctgcggcatcagttattcctcgatttcattcaggttgcgccccgccagtgcggctttcaccgtctgatccatgcggcgggcggcaaaggcgtcagtaacctgcgacaagcgcttggtctgctgctcgatggcataaccatcattacctttcatcagttcggccagttcctgcatctgcaggtcgataaccatgcgctcctcggcatccagcaggcgctcaccgtcagcatccagggccccctgcaccgcttcgagcaggcgctgggcatcgacttgctgctcacgcagcacacgggcgaccttatcgtcgccggcgtactggaacgagtccttgagcatcttggcgatttcgccgtcggtcaggccgtaggacggcttgacctggatgctggcttcaacaccagaggccagctcacgggccgccacgctgagcaggccgtcggcgtcgacctggaaggtgacacgaatcttcgctgcgcccgcgaccatggccgggataccgcgcaattcaaagcgcgccagggagcggcaatcgctgatcagctcgcgctcgccctgcagcacatgaatcatcatggccgtctggccgtctttataggtggtgaaatcctgggcgcgggcgacggggatggtggtattgcgtggaatcaccttctccatcaggccgcccatggtttcgaggcccaaggacaatggaatcacgtcgagcaacagcaactcgccgccatcgcgcttgttgccggccagggtatcagcctgaatcgcggcaccgatggcaacgacttggtccggatcgatttctgtcagcggctggcgaccgaaggcttcggccacggcctcgcgaacgcgcggtacgcgggtggaaccgccgaccatgaccacggcagccacgtcttccaactcgacaccggagtcacgaacagcacggcgacatgccctgaggctgcgagcgaccatcggctcgatcagcgcatcgaaggcttcgcgggtcagctgtgctgaccagctaccgtaggagacttcaacagaagcggcatcagtcagtgcttccttggcggcacaggcggtctgcagcagattacgctgcgcgcctggatccaagtcggcagacaaaccggcgctggtgataatccaacctgcaatggcgtggtcaaagtcatcgccgcccagggcactgtcgccaccggtggccagcacttcgaacacaccgccggtcaggcgcaggattgatatatcaaaggtgccgccgcccaagtcgtagatagcaaccaggccttcagcgtgctgatccaagccataggctacagcggccgcagtcggctcgttcagcaggcgcagcacgttcaggcccgcgagcttcgccgcatccttggtagcttggcgctgcgcgtcatcgaaatacgcgggaacggtgatcaccgcaccgaccagttcgccgcccaaggtggtttccgcacgctggcgcagcaccttgaggatatcggccgatacttccaccgggctcttcggcccttggacggtatcgatgaacggcatatgggattcaccgccgacaaagcgatagggcaactggtcgcccaattgcttgacgtcggacagaccacgacccatcaagcgcttgaccgacagcacagtgttcagggggtccgaggacgcggccagcttggccgattcaccgacttcggtacgatcagcgtggtaacgcacagcggacggcaggatcacctgcccatcggcatcgggcagcggctcggacaggccgctgcgcaaggcggcgaccagggaattggtagtgcccaagtcaatcccaaccgccaggcgacgctggtgcggttgagggctttggccgggttcggcgatttgcagtagagccatggtaatcaggtcttatctgtctatcaggcgtgcatcacgggcagcactgggttaatcgtcgaggcgctcttctagctggcgcacttcgtaggtgagcttgtcgaggaactgcatgcgccgcatcaggcgttcagcctgctcgcgttgcgcagcatcatcccaacaggctgcgaagctttcgttgagctcatcctgggcggttttcagacgacgcttgaaaaccgcgacacccgccacatcggcttcgtcctgcaagtcttcgagttcttcgcgccactgcatctgctgcatcaggaagtccgggtcatgcacggtcacttccaatggcagctcgccaccgttcatcgcaagcagatagcgcgcgcgtttcgcagggcttttgagcgtctgataggcttcgttgaggctggccgattgctccagggcctggcgttgttcacgctcggaagcgtcagcaaaacggtccggatgcacgccacgcgccagttctcgatagcgcgtggcaagctgatcgaggtccaggcgaaagctcggctgcagctcgaataaagcgaaatgacaaggagtacccacgagtagcctcagatgttgaagctttcgccgcagccacattcaccgcgcacgttggggttgttgaacttgaagccttcgttcaacccttccttgacgaaatcgagttcggtgccgtccaggtaggccaggctcttagggtcgatgatcactttctcgccgtgactttcgaacacctgatcctcttcaaccacctcgtcgacaaactccagcacgtaggcaaggccggaacagcctgtggtgcgaacacccagacgaatcccctcacctttaccgcgcccattcagggagcggcgaatgtgctgcgcagccgcttctgtcatgctgatagccatcgttgactccttactcgtcgccaaatgcttagatcaagcctttcttctgcttgtagtcgcgaacggccgccttgatggcgtcttccgcaagcaccgagcagtggattttcactggcggcagggccagttcttcggccagctgggtgttgctaatggtgacagcctcatccagggacttgcctttcatccactcggtcgcaagggaactggaggcgatggccgaaccgcagccataggtcttgaacttggcatcttcgataatgccctgttcgttgaccttgatctgcaggcgcatcacatcgccgcacgccggagcgccgaccatgccggtgccgacatcagggtcttgcgcgtccatcttgccgacgttgcgcgggttttcgtagtggtcgatgaccttttcgctgtaagccatggtactgaatcctcactcatcagggccgctctggaaccctgtagaaacgcctgcgtttaccgccacgttcctacagagcttgggtggcggcttctatagttagtgtgccgcccactcgatcttggaaatgtcgacaccgtctttgtacatatcccacagcggcgacagaacgcgcagcttgttgacggcttcgcagactttctgcgcggcgtagtcgacttgctcttcggtggtgaagcgaccgaacgtaaagcggatcgagctgtgagccagttcgtcgttgcggcccagggcgcgcaatacatacgaaggctcaagggatgccgaggtacaggccgaaccggacgagaccgccaggtccttgagcgccatgatcagcgactcgccttcgacgtagttgaagctcaaattcaggttgtgcggtacacgggcggtcatgctgccattgatgtacagctcttcaaggttctcgacctgcttgtagaaacgatcgctcagggccttgatacgcacgttttcggcagccatgtcttccttggctacgcggaaggcttcgcccatgccgacgatctggtgggtcgccagggtgcccgaacgcatgccgcgctcgtgaccgccgccgtgcatggtggcttcaatgcgcacgcgtggcttgcggctcacgtacagcgcgccgatgcctttagggccataggtcttgtgagccgagaacgacatcaggtcgactttcagcttggacaggtcgatgtcgaccttgccggtggactgggcagcgtcgacgtgcagcaacacacccttggagcgggtcagctcgccgatggctgcgatgtcgttgatggtgccgatttcgttgttcacgtggatcacggaaaccaggatggtgtcttcacgcatcgcggcttcgatcatggccggggtgacgataccgtcggtggtgggctcgaggtaggtgacctcgaaaccttcacgctccagttggcgcatggtgtcgaggacagccttgtgctcaatcttggtggtgatcaggtgcttgcccttggtcgcgtagaaatgcgcagcgcccttgatagccaggttgtcggactcggtagcaccggaggtccagacgatttcacgcgggtcggcattgaccaggtcagcgacctggcgacgagcattctccaccgcttcctcggccttccagccgaatacgtgggaacgggaggccgggttgccgaagtttccgtcgaccagcaggcattcgctcattttttgcgcgacacgcggatcaaccggggtggtcgctgagtaatcaaggtaaatcggcaatttcatggactttctcctaaatcaggctggctggcgtgccgttagctctgcggctgtcactcgacggcggacgcttcgatcttgtccaggcgcggcgccttggtgttgcaacggcgctggtcctgacgctgggctacttcttgcacctcacggcgagtcacaagatcagccaagctgataccactcaaaaactcatggatctgcaggctcaagtcacaccacaagtggtgcgtcaggcaggtgtcgccggcgtggcaatcacccaggccctggcacttggtggcgtcgacggattcattgaccgcgtcgatcacctgggctacctggatgccctgcatgtcgcgggacaattgatagccgccacctggaccacgaacgctggaaaccaggttgctgcggcgcaatttggcgaacagctgttcgaggtaagacagggaaatgccttggcgctcggagatatcggccagggacaccggcccagtttgcgcgtgcaaagccaggtcaagcatggcggtcaccgcgtatcggccttttgtagtcagtctcatggacaaggtaccaaggtgtttcagaatgggagcaagtatgcgattcccgagtatttaagtcaactataagacctagtgctttagtcgggattacccgtaaaaagggcgcgcgaatcatagcagcatggggtgggatggaccagcgggaacagggcctggcagagatctcgagaccaatggagatcaaaatgtgggagggggcttgctcccgatgactgaatgtcagtcacttatcagttggctgacccaccgttatcgggagcaagccccctcccacagggatctctagcggccttgggacttcagcttgccttggtggcggcctcgtccttgatctcggcgaagtcctcttcgcgcaactcaggcagatccttagcacagtatgggctgcccagatccttcagcgcaccacacataccgtccaacttgccatccaccgcctgcaggtggtcgagcaattgaccaatggcgcgcgccaccgggtcgggcatgtcttcgctgacgccataggcatcgaagccgatcttctcggccatggccttgcgcttggcctcctgctcgtcgccgacttccggcttgacgatgatgcgacccggaatgcccaccacggtggcgccagcaggtacagccttggtcaccacggcattggagcctaccttggcgccggcgcccacggtaaacggccccaataccttggcgcccgcccctaccactacgccattttccagggtcgggtggcgcttgcctttattccaagtggtgccgcccagggtcacaccctggtacagcgtcacgtcatcaccaatctcggcggtctcgccaatcacgatgcccatgccgtgatcgatgaagaagcggcgaccgaccttggcgccagggtgaatctcgatgccggtcagccagcgaccgaagttcgacaccaatcgcgccagccatttccagcccatgccccacaacacagcagacaggcgatggatccagatcgcgtgcatgcccgggtagcaggtcagcacttcaaaggcattgcgcgccgccgggtctcggtggaaaacgctctggatgtcttctcgcaaacgctcgaacattgttaatccttccgcttaagaagctcgccacgggccgctttctgggtttccgtgaggatgccacgcaatatattcatctcagcccggctcaccgagctgcgaccgtacaagcgacgcaggcgcgccattaaatgccttggcttttcaggatcgaggaattcgatggctaccagggtttgctccaggtgctcatagaagcgttcaagctcgtccatggtggccaactcgccacttttggtcgatgcgacttcatccttctcaaccttgctcggctggccttgagcagccagccaggccatgcgcacttcgtaactcaatacctgcaccgccgccccgagattcagcgagctgaattcagggtctgatggaatgtgcacgtggtaatgacatcgctgcagctcttcattggtcagcccggagtcttcacggccgaacaccagggcgatctcagcgccaccggcagcctcttctaccactttggtgccgcattcacgtggatccagcagcggccaggggatgcgtcggtcacgggcgctggtgccgagcaccaggttgcagccgaccagagcctcttccagggtggcgacgatttgggcgtttgccagcaggtcattggcgccggatgcacgggcgtcggcctcgtggtgcgggaatacccgcggctcgaccagcaccaggcgcgtcagccccatgtttttcatggctcgcgccaccccgccgatgttgccgggatgactggtattgaccaagacgacacgaatgttttgcagcaagggaggcgctctcggacatgggaaaggggagcaaatcttacagaacagcctaaggttatgccatgaaagctaacgtcatccttcacctgaggaaagtttctgctagaatgcccggctttctttaacaaccttaggtgacacatccatgcagcccatgctgaatatcgcgctgcgcgccgcccgcagcgccagtgaattgatcttccgctccatcgagcgcctggataccatcaaggtcgatgaaaaagacgccaaggattatgtatccgaggtcgatcgcgccgccgaacagaagatcatcgacgccctgcgcaaggcctaccctacccacggcatcctcggtgaagaaaccggcctgcacaaaggtagcggcgaaggcgaagactacctgtggatcatcgacccactggatggcaccaccaacttcctgcgcggcatcccgcactttgccgtgagcatcgcctgcaaataccgtggccgtctggaacacgccgttgtgctggacccggttcgccaggaagaattcaccgccagccgtggccgtggcgcccaactgaacggccgtcgcctgcgtgtcagcggtcgcaccagcctggaaggcgccctgctgggcaccggcttcccgttccgtgacgaccagatggacaacctggaaaactacctgggcatgttccgcgccctggttggtcagaccgccggcatccgccgcgccggtgcagccagcctggacctggcgtatgttgccgcgggtcgtttcgatgcattctgggaatcgggcctgtccgagtgggacatggctgcaggcgccctgctgatccaggaagctggcggcctggtgagcgatttcaccggcggtcacgacttccttgagaaaggccacgtggttgccggcaacaccaaatgcttcaaggccgtactgacggcgatccagccgcacctgccggcttcgctgaagcgttaagcgagcgagcacaaaaaagcaccctcaggggtgctttttttatgcctgggatttgtgccagccccgtgaatcagcagcaatacatatcaaatgtgggagggggcttgccccctcccacattttgaactgcaccagagctttgaatcagtgccaggcccgggattactgctggttctgaccgaggatcagacgcccttccttatccaccggaatctggctgcctggatcacgctccatacgcacagtcccttccttgccatccaggttgtaacgcacgtcataaccgacaaccttgtcgctgatgtcgttaacagtgttacagcgggtttgcgtggtggtgtaggtatcacggttctgcatgccttcctgaaccttgttaccggcgtaaccgccaccaaccgcaccggccacggtggccagtttcttaccgttaccgccaccgatctggttacccagcagaccacctgcaagggcacccactacggtaccggcgatttgatgctgatcctgcaccggacgctgccgggtcacggtgacgtccttgcagacctcacgaggggttttaatctgggttttcaccggctgcaccgccagcacttgcgcatactcagggccgctttttaccaggctgtaggtggcaacagcgcccccggcagtcacaccgacagcacccaataccgcaccaaccagcaacgacttgttcacatgaacctcctgaccatcacaagcggaccgaaacgtccgcgctatacccagccttggagccaaaaaaaaggcacgagttcaatctcgtgccttctttgtaacagcgtatcaacgaacatccatcaaggacggtcgtcaacctccttgccggtagcagcaggagggatcaggtcttcgctgttgaggttcagccagatcagcaccacgttggcgatatagatcgacgagtaggtacccgccagcacgccgatgaacagcgccagagagaagccccacaggttgtcgccaccgaagatcatcagtgcggcaatcgccagcaaagtggagatcgacgtcgccatggttcgcagcagggtctgggtggtggagatattgatgttctcgatcaacgtcgccttgcgcagtacccggaagttctcacgaacccggtcgaataccacgatggtgtcgttgagcgagtatccaatgatcgccagcacggccgccaatacggtcaggtcgaaggtgatctggaaataggccaggatacccacggtcacgatcacgtcgtggatcagcgacacaatggcgccgacaccgaacttccactgaaaacggaaggccaggtagatcatgatgccgaccaacgccatcagcatgccgaggccgccctggtcgcgcagctcttcaccgacctgcgggcccacgaactcgacgcgcttgaccgatgccgggttgtcgccgccgaccttctgcaaggcctcggctacctggtgacccagttgcgggtcttcgccaggcatacgcaccagcaggtcggtggtcgcaccgaagctctgcacgacggcttcgtgatagccggccttgaccagctcgtcgcgcaccagggtgacatcggcaggcttctcgtaggtcagctcgatgagcgtaccaccggtgaagtccaggccgtagttcaggcccttatggaaccagctgaacaacgccagaacagtaaggagcacggtgacgccgaacgcaacgttgcgaacgcccatgaagttgattgtacgtaacatggcagccccttaaatccacaacttcttgaagtcacgcccgccaaagatcaggttgaccattgcgcgggtcaccatgatggccgtgaacatcgaggtaaagatacccagggacatggtcaccgcaaaacctttgacggggccggtgcccatggcaaagagaatcccgccgaccagcaaagtggtcaggttggagtcgagaatcgcggtaaatgcccggccgaagccttcgttgattgcacgctgtacggtcatgcccgccgcgatctcttcacggatacgcgagaagataagcacgttggcgtcgaccgccatacccatggtgagcacgataccggcgatacccggcagtgtcagggtagcccccagcagcgacatcagggccagcagcatcaccatgttgcccgccagggcgacggtggcgatgacgccgaagaagcgatagatggcgatgatgaacagcgacacgaacaacatgccccacagcgccgcatcgacacccttggtgatgttgtcggcacccaggctcggcccgatggtacgttcttcagcaaagtacatcggcgccgccaggccaccagcacgcagcaacagcgccagttcggacgactcgccctggccgttcaggccagtgatgcggaattgagcacccagcggcgactggatggtcgccaggctgatgatcttcttctcttccttgaaggtctgtaccggcacgtctttttcgacgccgttgaccatctgcttggtgtaggtagtgatcgggcgctgctcgatgaagatcaccgccatgctgcgaccgacgttgctgcgcgtggcgcgactcatcagttcgccaccgtggccatccaggcggatgttcacttcaggggtgccgtgctcgccgaaaccggccttggcatcggtcacctggtcgccagtgatgatcaggccacgctcgatcaatgctggaggacggttgccttcgcggaactcgaactcttcggaggtcgcgcgggtggcacctggctcagccgcgagacggaattccaggttggcggtcttacccaggatacgcttggcttcagcggtgtcctgcacgcccggcagctcaaccacgatgcggttggcgccttgacgctgcacaatcggctcggccacacccagctcgttgacgcggttacgtaccgtggtcaagttctgcttgatggagtactcgcggatctcggcgatcttggccgggctcatcgccaggcgcaacacagcctgaccattcaagtcggccggcacgatgtcgaaatcattgaaatttttgcggatcagcgcacgggcctgttcgcgagaggcttcgtcagcaaagcccaactggatggcaccgttgagctgcggcaggctgcgataacgcaacttctctttgcgcagcaggctcttcacatcaccttcgtagactttcaggcgcgcatcgagggccttgtccatgtccacttccagcaggaagtgcacaccaccggacaagtccagacccagcttcatcgggtgcgcgccaatgctacgcagccattgtggcgtggtctgtgccaggttcaaagcaacgacgtagtcgtcacccatgaccttgcgcacgacatctttggccggcaactggtcttcttgcttggtcaggcgcaacaagccgcctttggaaccagccgccaaggttgccgctttaacctggatacccgcgtcgttgagcgctttgctcgcacgttccaggtcagcctgattgacctgcagcgaagtgctggcgccagagatctggatcgcagggtcatcaggatagagattgggagcggaataaataaaaccgatcgccagcaccgccaggatcagtacgtatttccacagagggtatttgttcagcatcacgccgcccgcttataacgcggggcgccttgcgcgccccgtcgattggtaaaggttgttactcagatcgctttgagcgtgcccttaggcagcgtggcggcgatggcgcccttctggaacttcatttctacggtgtcggagacttccagtaccacgaaagcatcggaaaccttggtgatcttgccggcgatgccgccagtggtcacgacttcgtcgcctttctgcaggctgcccagcaggtttttctgctctttggcgcgcttggcctgtggacgccagatcatcaggtagaagatgaccaggaagccgaccaggaaaatccactcgaaaccaccgcccatagggccggcagcagcaggcgcagcggcgtcagccatggcgttagagataaaaaagctcatttagcactccagttgcaaatagtgaatcttagggtcgggaaactcagtccaagggcggcacagggagcccgcgcttggcatagaaggcatcgacgaaggcggccaatgtaccctgttgaatagcctcgcgcaaaccagccatcaggacttggtagtgacgcaaattgtggatggtattcaacatgctacccagcatttccccgcatttgtccaagtgatgcagataagcacgggagaagttctggcaggtgtagcagtcacaggtggaatcgagcggcgaatcatcatggcgatggaacgcgttacggatcttcagcacgcctgtatcgatgaacagatgcccattgcgggcattacgggttggcatcacgcaatcgaacatgtccacaccgcggcgcacaccctctacgagatcttcgggtttgccaacgcccataaggtaacgaggtttgtcagcgggcatcaggcccggtaggtagtcgagcaccttgatcatttcgtgcttgggctcgcccaccgacaaaccgccgatggccaggccgtcgaaaccgatcttgtcgaggccttccagcgagcgcttgcgcaggctttcatgcatgccgccctggacgataccgaacaacgcagccgtattgtcgccatgggcattcttcgagcgctgggcccaacgcagggacagctccatggagatgcgcgctacgtcttcgtcagccgggtacggcgtgcattcgtcgaaaatcatcacgatgtcggagcccaggtcacgttgcacctgcatcgactcttccggccccatgaacaccttggcaccgtccaccggcgaggcgaaggtcacaccctcctccttgatcttgcgcatggcgcccaggctgaacacctggaaaccaccggagtcggtgaggatcgggccttgccacttcatgaagtcatgcaagtcgccatgcttcttgatcacttccgtgcccgggcgcagccacaggtggaaggtattgccgaggatgatctcggcgccggtggcgacgatgtcacggggcagcatgcccttgacggtgccgtaggtaccgaccggcatgaaggccggggtctctacggtgccgcgcgggaaggtcaggcgaccgcgacgggccttgccgtcggtagccagcagttcaaacgacatacgactcataagttgtcctcagggccgcgcggcgccgggttacgggtgataaacatcgcatcaccgtagctgaaaaaacggtactcgttggcgatggcggcttgataagcggccatggtttccgggtaaccggcaaatgccgacaccagcatcaacagcgtggattccggcaaatggaaattggtgaccaggcaatcgaccacatggaatggccgacccgggaaaataaagatgtcagtgtcgccactgaacggcttgagtacgccatcacgcgccgcactttcaagtgaccgtacgctggtggtgcccaccgccaccactcgcccaccgcgcgccttgcacgcgttaaccgcgtccactacgtcctggctgacttccagccattcgctgtgcatatggtggtcttcgatgttctccacacgcaccggctgaaacgtaccggcccccacgtgcagggtcacataagcggtctcgacgcccttggcggcaatcgcatccagcagcggctggtcgaaatgcaggccggccgtcggtgctgcaaccgcaccgagacgctgggagtacaccgtctgatagcgctcgcgatccgagtcttcgtcggggcgatctatataaggaggcaacggcatatgaccgacacgttccagcagcggcaacacttcctcgcagaacttgagctcgaacaaggcatcgtggcgcgccaccatctcggcttcgccaccgccatcgatcaacaggctcgaacccggtttcggcgacttgctggagcgcacatgggccagcacgcgatggctgtccagcacccgctccaccaggatttccagcttgccgccggaggctttctggccaaacagccgcgccggaatcacccgggtattgttgaaaaccatcaaatcgcctgggcgcaaatgctcaagcaaatcagtgaattgacggtgtgcgagggcaccgctcggcccgtccagggtcagcagtcgactggcgcgacgctcggccaaagggtggcgagcgatcagcgaatcagggagctcaaaagtaaagtcagcaacgcgcatgatggggttcgtctagcagggccgggaagtctagcggaaatagtcaaaattgaccatgaaacgtgattgaccaacggtaatctcatctctatacttcgccgccattgagccctgatggcggaattggtagacgcggcggattcaaaatccgttttcgaaagaagtgggagttcgattctccctcggggcaccatcttaagaaaagaccttgaaattcaaggtcgttttttttcgcctgtgaaaaagtgaccggcatggcagtagaggtagcgggaccatggaattgacgcttgaagccgttgcactgtttgccctgaaactggtgcatgagaccgaggacggcagcccgctgctgcgcgatgacccggcgatggatgggtatgaacgcgaggtgtttgggctgctggtgcgccagggtgatttggcgcggattcagttaaagcttgatcagtgcctgacgttagcgctcgactctctgggcggcgcccataccgtgatggggcgcgagctgcagcggcttgcgctggacgtgcatcaagcagcgaccttggaagcactcaatgctccgctccaggcactcaaggattacctcaaagccatcctgtaacgcgcagctagcgtcgcccctccaccgccatccgcaccgccaaccccatcaacaccgaccccatcacccagcgctgcaccacctgccagcctggccgggtgacgaagaacaccgcgatggaacccgccatgcaggcaatcaccgcattgacgctcacgctgataaaaatctgcagggagcccaacaccagggattgcatcagcacactggcatgaccgttcggatcgatgaactgcggcaacagcgacaaatacatcaccgctactttgggattgagcaggttggtgattaggcccatggtgaacagcttgcgcggactgcccttgggcaaatcccgcacctggaatggcgaacgcccacccggcttgaccgcctgccaggccaggtacaccaggtacagcgccccgccgagccgcagcgcgtcgtaggcgaagggcactgccatcaccaacgcagtgatacccagtgccgcgcaaaccatatacaccacaaaacccaacgccaccccgcccagggaaatcaacccggcggtgcggccctggcagatcgagcgggagatcaggtagatcatgttcggcccgggcgtcagcaccatgccgagtgaaatcaggccataggcaagcaagctggacatatcgggcattgtttcgctcctggatttttattctgccagcgtgaatccttcgccacactgtgatgtttcgctccatgctagggcgttagaggcgtgggcgttagatacagatccgcgaacaaaacctcatacacaggcgcccccactgacccaggacaggtacatgatcgacttcaacaacaaaggcttcttcaagctcaaacaaaacaatgagtacgccgaacgcgtatcggccctgctgctcgacggtgaggaagtggtcgacgcctacaaagccatgcgtgacggcgtggttttcaccaccaagcgcatcattgcggtgaacgtgcaggggattaccggcagcaagaaggacttcacgtcgttgccgtataaaaatatcgtggcgtattcggtggaaacgtccgggacgtttgatctggattcggaattggagatttacttttcctcactggggaaggtgaggtttgagttcaccggcaagacctcgattgtggaaatatcgcggttgatttccaagcatctgctgggctgatcaacacaaggaggcttgcccgcgacagcggtgaatcagtgactagatcggatactgatactctgccatcgggggcaagcccctcccacattttgatcgcgctgtatcagctgaatacgcatgcgaggccgctcacttgggctggaatgtctccaggtaggccaggatgttttcaatcttctcctgatcgctgatcccccagaaaatcatccgcgtcccactcaccaccttcttcggcgcttcgatataggccgcaagcttgtcccgcgtccacaccaccccggaattcttcatcgcatccgaatactgatagtcggtggtagttccggcaggccggccaatgatgccgttaagctgcggcccgaaaccaccgcgggcgccttcgccgacgctatggcagccaccgcaggtcttggcgaagagtttaccgcccgcctccgcgtcgccggcggcgaaggcagggctggtggcaagggtcaggacgagggtgaacagggcgtacttcattgagggttccacttcggctattaccggcgattatgcctgtttaagcgggcatgcccccaaccgttcaatcaggcacgtcagataacctcgctccggtagcaaccacgtcaaatgaccacccatcgtttaaaaaacatccaatcgaacctataagcgcgcgccccactccaccctactgaacccctgatggtggagtaaggatcatggctcagccatcgattttggtattggaagacgacgagatcattcgttcgttgatggtggatgtgctggaggagttcggggcgcatgtgacgtcgttcccttcggcggatgacgggatgattttcctggagcgcgatgatgagcaggtggacctgattgtcagcgatatccagatgcccgggctattgaacggctatgacttgagcagggtggtggcgcatcgttggccatctatccaggtgctgttgacgtccggtaatacgtcgctggcgtctgagttgggtggcagagtcaggtttttacccaagccgtggagcaccgagcgtctgctggaatgtgtggagtcggcgttgacccagcagggtgcgtccatgcattgatagcgctgcgacatcgctcaaaccgaacttccggtcaggcgaaggggtcattaaccatgcatggagcgacttctcggatccgacggtcagccttttcgctttgtgcgctcagctgacggccatgagtgtgtagaatcgttgccgacttttacccgtcatggatggctgacaagcccacagttcgagctcattgaatgcattcacaggcccctgacattggtgcgcccccgttgctggaagccttgcgcacaggcacgggcttgctgcacgtagcactggaaaagcgcctgccgtttttctgtgcgagcctggatgtcgactggtaccgacgtttacttcaagcgtattacgggttttacagaccaatagaatcagcgctgaaccacagtgacttgatccctgaaggcttcgactgcgtgttgcgtgcgaaaaccccgacactggtcagtgacctccacgccctgggcctggatgaccatggtatcaacgccctgccccgctgcacccatctcccagacttggacaccccggcggcctgcctgggcgcactctacgtgctggaaggcgcgaccctcggcggccaggtgctgcgccgggaaatggccctgcgcctggacgtgggtgccgacaacggcggcgcgtttctcaatgtatatggcgccgagaccggtcgacgctggaaagaatttctcgattatctgggccgtttgccattggatgcactcgccaaacagcacgcggttaacgcggcccgctcgacattcagcggctttgagcaatggctcgacagccagaaggtactgctatgaaacccgaagactttgatgagctgcttgccaactgtgctgacgagcccatccgctttccgggggcgatccagccccacggtgtgctgctgaccttgtcggagcccggcctggaaatcattcaggtgagtgccaacgtaggcaccttgtttggccaggcgcctgagaccctgttgagccagccgttgcacaggctgattggcgacgagcatgccctggctgtgcaaaccatggctgccaacaacacgtttttcgatgctccgcccctgcacgtcaccttcgacggcgcgccattcgagggcctgctgcatcgccatcaggatgtgttggtactggaattcgaaccacggcttgagaacttcaagccacaggcgcgcaatggccgcaccagtgacctgggcaagatgctgcaacgcctgcaatcggccaagaccctgcaggcgctgtatgccatcagtgtgaatgaaatccaggccatgaccggctacgaccgggtgctgatctatcgcttcgaagaagaaggccatggccaggtgattgcagaagcgtcggcaccgtccatggagttgttcaacgggctgttcttccccgcgtccgacattccagaacaagcccgcgagttgtatcgcaccaactggctacgcatcatcccgaacgcgtcctacgaaccggtgccgctactgcccaagttgcgcccggacactggccagcctctggacctgagctttgccaccctgcgcagtgtctcgccgatccactgccagtacatgcagaacatgggtgtgctgtcgtccatgagcatctcgctgatgaagggcgacaaactctggggactgatcagctgcggcaaccgcgaaccgctgctggtgcccaacgacctgcgtatgacctgccagaccataggccaaatactgtcgttgcagatcagtgccatggaagccttggagctgaatcgccagcgcgaagagaaaatcgaagccctggcgctgctcgatcaggccatgaaagccaacgaaggtaacgtgttcgacagcctggcccaccacggcaaaaaactgatggacctggccctctccggcggcgtagcgatcatcgaagacaaacaattgcaccgctacggcaactgtccggaaccggcgcagatccgcgcattgcacaagtggttgcaggagagcggcgagccggtgttttccagccataacttggcctcggtatacccgcccgccgccgagtaccaggccgtcgccagcggcgtactcgccatgagcctgcccaagcctgtggataacggtgtgctgtggttccgccccgaggtgaaagagaacatcaactggagtggcgatccgaaaaagccgttggacctggaaacttccgacgccggcctgcgccttcgccctcgcacctcgtttgaaatctggaaggtggaaatggccggcatctccaccaagtggagccatggcgatctgtttgccgccaacgacctgcgtcgctcggccctagaaaatgacctggcccgccaagtggtgcgcgaacggcaagcggtgcgcgcccgtgatgaactggtcgcggtggtgtcccacgacctgcgtaacccgatgacagtcatctcgatgctctgcggcatgatgcaaaaagccttcagttccgagggcccacacacctcacggcggatttcatcggccatcgacaccatgcagcaggccgccggacgtatgaatgtgctgctggaggacttgctcgacacctcgaaaatcgaggccgggcgctatgtggtcaagccggttgcgttggacgtcagtcagatctttgaagaggcgtactcactactggcgccgctggccacggaaaaaggcatcgacctgtcgttcaatgccgaacctggcctgcagatcaatgccgacccggaacgcttgttccaggtgctgtcgaacctgatcggcaacgcgatcaagttcacgccgcgccagggcaacatcggtatcagcgccatgagcaacggcaaagatatcgtgttctcggtgcgtgactccggtgaaggcattgcccctgagcaactgccccatgtgtttgaacgctactggacccagacagagaacaaccctaccggcagcgggttggggctgtatatcacccaaggcattgtccaggcccacggcgggcggattgaagcccagagtgagttgggccgtggcagtgagttcaggtttacggtgcctaagcccgtctgaaacacgcccaaacatttgattacctgaggccgggaacgacgaacccggcttatgccactgattaagtgcgcactcaaagggagcattgatgcgggaacaatcctccaattgagcaaagggtttatcatgattatcggtcagccgttccacacctataacatcaaccaatccacggaggtccagcaggaccatcaagcgtccctaaatcctgcggataacccgtcgacaactgaaagcaatcaatcagagcacgtgacaacggggaaacctcctcactcatccctggactccctcggacagggcaggctgctttgaccctacccacagcgccaggcctgtagcacgcctggtcgcccccaaggagtgcagcgccggtgctgcactctgttgacaaaacactgacatcccccgcgctaccctttcacgtcctagacttcgtgtgagccaccacctcaatgcttcaacccgacactctgcccgcagtcattgcaggaccgctgttaaggcggctggaaccgcagcgcctggttatttggttggtgggcagtcgtgtcctgccgttgtacttggaactgcgtttaccccacggcgagacgttggatatccctttagataccacgtgctgccaagtcgtgcccgtcgggcgccatgccttcatccacctgatcgatgttgtgctggatcatgccctgccccaggatgtggtcatcggctacgacctgttgatcgacggcgtaggcatcgccgactgggcatcacatttgctgtacgccgataagacgatgccgaacttcgtgctgcacagccgcatccaccagttggtacacggctcctgccgtaagccccaccaccgtgccgacgaaggcttgttatgcgttgaccgcctgctgacggatgcccgcacaccgaccgaacgcccggccctgctgatgatgagcggcgaccaggtctacgccgacgatgtcgcaggccccatgctacgggcaattcatgcgctgatcgcgcgcctggggctgttcgacgaatacctggaaggtgccgtggtgaccgacagcgccaccctctacgaccatcgcgccagttactaccaccgagcggatttgctccctgcgctggacagtaacgagaccttgcgcgaacgctttttcggcggcgtgaaaaaacctatcttcaccagcagcaccgcggacaaccacttggtgacctttgccgaagtgatcgccatgtatctgctggcctggtcacccacgccgtggacgctgatcacgccacaaccaccacaactgagccccgaagaacaacagcgttatgcccgcgagcaggcgcagattgacctgttccgcagcggtctgcctggagtcgctcgagtgttcgcccacctgtcgacgctgatgatcttcgacgatcacgacatcaccgacgactggaacctcagcgcccaatgggaagaaactgcctacggccaccccttctccaaacgcattatcggcaatgcgttgctggcgtacctgttatgccaaggctggggcaaccagcccgaagtgtttggtgaactgctgagccaaacccaggccatggccggccaggcacgcgacaatcatctcgacgccgtcgcgcaagatgacctgctgaaagcgctgttgaaattccagcactggcactacgtattgccaaccacgcccgccctggtggttttggacacccgcacgcggcgctggcgcagcgagttcaccctcaagcaaccctccggcctgctggactgggaagccttgagcgaactgcaacaggaactgctcgaccacccgtcggccattatcgtatcgcccgcgccgatttttggcgtaaagctgatcgagaccgtacagaaaatcttcagctggtgcggcttccccttgctggtagacgctgaaaactggatggcccatcgcggcgccgcccaggtgatattgaatatcttccgccactcgcgtacgccgggtaactacgtgatcctctccggcgacgtgcattactcgttcgtctaccaggtgctgatccgccatcgcaacggtggcccgaagatctggcaaatcaccagcagcggtatcaagaacgagttcccgccacgcttgctggaatggttcgaccgcctcaatcgctggctctactccccacgttcaccgctcaactggtttacccgtcgtcgcaccatgcaggtggtaccgcatattccggagcatgccgaggcgggggagcgtttgtggaattcggcgggcattggccaggtgtttttcaatgagcacggccagccagaggctatttaccagcacaacgccaatgggaagccccggacaaaaatggcacctcccgaacaatagcctattgccactagccaaaagcagcacacccgccctattcaaagcgcgcaggcggcgatgtacagtagcgccagccacggagtatcggcgacaacaatgactggccttaagccagccctcgcaggaagcgcgctgatggacgatacatccggcaacgaaccactacgcaatgacataaccgacctcaacgtcgacctgttgcacgccatcatggaactggtcagtgacggagtctgggactggaacgccaataccggtttcgtctaccgcaaccccggctggtacgagatgcttggctactcccgccactccctggaaaacagcgtgttcacctgggagaacgtgatccaccccgaggattacccccgcgtgatggcgatgtttgacgactacatcagccagcgctcgccccattaccgggctgaataccgctgtcgaaaagaagatggcacctatctctggatcgaggactgcggttatatcattgcacgtaaccccgaccactccgtggcccgcatggtgggcgcgcaccgcaatatccatacgcgcaaatgctccatcgaacagttgcaaaggcgcaataaatcccttgaggcactggtggccgaacgtaccctggagctgtcgcgggtcaatcaacaactgcaattgcaactggacgaaaaccgctccctggccgaacgggacgcgctgacacgcatagccaaccgttatcgcctggaaaaagtcctgctggaagaatgcgaccgcgccgagcgcttccgcttgcccctggcgctggtggcgatggatatcgatgatttcaagccgatcaacgaccgccacggccacggcgtcggcgaccagacgctgatacaggtggtcgaaagcctggaaacctgcatacgcaccagtgacttgctggcccgatgggggggcgatgagtttatggtcgtgctgcccaaaagcaccctggagatggccaaggaactggccgaaaggattcgccatacagtcaagctagcgcccaccgtaggcggcttcaacgtcaccctgagcctgggtgtggtggagcggctcatgggtgagtcgccggccgcccttatggcgcgggccgaccaagcgctgtatcggtcaaaggcggcgggcaaggacggggtttcggaataatgcaggcaaccgctccttccgatttggaatgacccggcgactttatttcgtttgcggcaagaccaggcgcgcggcttagataaacacgcctgcccttgccgagtcccgtattcatgagccacgccactatcagccaatcaatttccatcgttcaccccatcagcctctgccacggtaaaaacgccgaagtctgggatacggcgggcaagcgctatatcgattttgtcggcggcatcggcgtactcaacctgggccattgccacccggctgtggttacggcgattagtgagcaagcgaccaagctcacgcactacgcgttcaacgccgcaccacatacaccctacatcgagctgatggaacgcctgactgcgtttattccggtgggctacccggtcagcggcatgctcaccaacagcggcgcggaggccgcggaaaacgccttgaagatcgtgcgtggcgccaccgggcgcacggcggtgatcgcctttgacggtgctttccacggccgcacactggcgaccctcaacctcaatggcaaggtagcgccctacaagcagaaagtcggcgtactgcccggcccggtgtatcacctgccctaccccagtgccgataatggggtgaccagtgccgaagcgctgaaggccatggaccgcctgttcagcgtggaaatcgacgtcaacgatgtggcctgtttcattatcgagccggtgcagggtgaaggcggcttcctcgccctggatatcgagttcgcccaggccttacgccggttctgcgacgagcatggcatcctgctgatcatcgatgaaatccagtcaggctttggccgcaccggccagcgttttgccttctcgcgcctgggcatcgaaccggacctgttactgctcggcaaaagcattgccggcggcgtgccgctgggcgcggtggtcgggcgcaaagcgctgatggacaacctgcccaaaggtggcctgggtggcacgtactccggcaaccccatcgcctgtgcggcagcgctggccactcttgaggtgatgaccgatgagcatctgcaggcatggggatcacaacaggaagcggcgattgtcagccgctataacacctggcgttcgcgacaactgtcgccctacctgggccgcctcaccggcgttggggccatgcgcggcattgagctggcccatgccgacggcacgcccgcgccccagcaactgacccaattgctgcgcctggcgcgggaggccggcttgctgctgatgcccagcggcaagtcgcggcacatcgtgcgcctgctggcaccattgaccaccgagccggcagtgctggaggaaggtctggatattctccaggcctgtctcgcacaactggatgaatagcacgcatgccaaggcagggcctggatggtggtacagtcattgatgcgccgctatcggcactgaaagtattcacccgcccgaacctgccttgacctgatccctctccccgccgaaaatgcccgacgttttttgtctccccgcttactacgcagtgaaattttaatgtccgattcctacaccgcagaatccgccgaagaatccgtagccgccttgcgatccaaagccgaatacgaaaacgccatcaatctttcacagcatgtgccagcggccaagatcatcagcgagatggtgctggacgcgtttcacacctccaaggaaagcgaccagatccgcgagttgcgcgttgccatccgccaggcccacgacgccttcgacgatgacaaggcttatgacctgatgggtcagctcaagcaattgaaagacgccgaagccgccgataacgccgccctggaaaacctgagcagccagttctccatcagccgtatcctgtcctgcttcaaggacgacccagagttccaggaactggtgtacggcctggccctcaaggtgctgaaccagtcgcaccaggccatcagcaacccgaacgccggcaagggcaaggccgcgcgcgccaagaaagacaccgaagtgtttgtgatcagcaaggatggcatcagcgtcaccctgccgctgcgcacgccgcgctccaagctcaatgtggaccgcgaagcactggagttcctcggctttgcctttgtgggcgaaggcagcgaggcggaattggcgagtgaaacctttatcgacaacagcggcgcggagcagccagtcacgcgcaagagcatcgtcaccgcactgcaacagcaaagcgcctttgacggctataccatcgccgcccagtaacacgatgtgcagcacacatcgagcaagcgccgaaggtcgtcgggcagcatcggtcgggttttatcggggaagacatttcgtcgcacagctgtcgtccttgatcattcaacccgcacgaaaacgaagcatgcccggcaggcctgtccaggcttggtgtaacaaccctggtgcctaggcccgggccagctgcgccgcgaagacctggcgaaagcgttccatttcctgctgggtacccaccgtcacccgcacccattgcggccagttctgccacacccgcccgaccagtacattctgggctgccagccgctcgaccacctgttctgccggttgcttcacttcaatcatgaagcaattgctctgggaggcagtgcaggcaaaaccccggtccttgagccaagcgatcgtctcatcgcgcaacctggcattgagcgctttgcgttggcccaccagttgggcctcttccaggctggcagtcgcacccaacaagctggcgccagctgggacgttgtcgccgccgaacacggccagccgctccaacagtgccggatggccgattgccaggcccaggcgtgcaccggccataccatagattttcgagaatgtgcgcagcaccagcaggtcatcgtagtcgttggtccaactcacgcagctgggggcgtcgcagaaatcgatgtaggcttcgtctaccaccagcacactgcccttgggtttgttcaccagggcttggcggatagcttcagtcggggtcagggtgccggtcgggttgttggggttgcacaggtacagcatgccggcttgtgggtcggccttgagcatggcctgcacatcatgggcatgctgcgtgtcgaggtccacttcatgcacaggggctttgtttgactcggccgcctgtcgcgggacttcgtaggacggtgtggccatcaccaggccgcggttttgactggtgaacgccagcaccgcataacgcagggccgccatcgagccggcaaatactgcgacgttttcttcagcgattccctgttgccgggcaaacagctcggccagtgcgtacatgtgcgggtaaggatagcgtccagactctgcaatcgcccgctgcatcgccgcacgggctgcgtctgaagggccgtaagggctttcgttgtagttgagcagcaccttgtcagatgacgtcggcggcgggctggcgagcgcccaatccagatgccccagcacgggcaaagcggccccgagggcgagaagcgatcgacggttgatactgaccatggctactactccttgtagaggcgcgagaaattcgcaccgggtcatattcaagagtatgacgaaataaccgttgcctgatttagcgtcacaccctatcggtacactcagcactttattgttatgccgggcccatgcaacacttccattgccgcgaacctgaaaggacaggttctgccggacatggactgacgactaaatggaagtggtgagcacttgatacacagacgggaaaaaaccgagcacttgaagagcaacatcaagtacttgatcaagagccgtggcgaaacccagcgttcgttaagcaatgccgccgggctgaccaggaccaccatctacaacatcctgggaggcaaagtcctcaacgtacagcagtcgaccattcgcaagatctctgacttcttcggcgtctcgtatgaggaaatcgagaccatcagttttgaagccaaggaaatcatcgagaacaatgtctcgccgctgggcaatatgaacccggcagcggtgcctgtgctcaaggaaagcctgctcatgcagaacctgggcaagcgcgtgggcgaattggccacgctttatccgctgacctattacttcggtacgtcatgcaacttgatcggcgtgcgcctggaacatgcgatccccggcatcaatgaggcgggtgacttgttgatcgtacagaaaggttcatcgagcgacggtaaagagaaactggtatacgaccgcgcgaccaaaaagctgtttatcaccctggagccctgtgctcattcagaccgtttatgtgtcatcggcgatattcttgaggagcgcttcaatgaccacgtatgaaggggccgttgaaaacagcaggtataaattgctgggctttgaaaatgacaagcgcctggcggtgatcatggtgcttgccacgggcaaggtcatcaagatcaaactgagtgaagtgctcaacagtgagatcatggatgacttcaatagaatggaagtcaagaacgtctacaagaagttctatgcccatggaggcacactcaccgcctacgatataaacgatcgcaatgaaaactcctggatgatctacatcatcctgaacttgctgctgttcacgttttatatcttcaccagcattgccgcgaccaagccgatatacctggagtccatgggcatcatcgtgacgccgggcacattcctgtacccgctaacctttctgatcgtggacctgctgaacgagaatttcggcttgcgcctggcgcgacgggccattctgtttgcgtttgccagcaacgcgatgatcatcatcctgctatatggctcgaccttcctgccggggctgccgggctggaaactggacgggccgtataccgacgtgatcctgcaagtgtcgtcggtgctggtggcctcttcggtgtcgttcctggtgtcggagaatataaactcctacctgctgtgcaagatcaaggagctgaccaactccaaatacctgtacctgcggattttcctcagtacattctttgcggtcattatcgacagcttcctgttttgcttcattgccttctacggcgccatggagacccgcgacatcctgggcatgatctatgtacagatcgcgatcaaagtcggctttgcgttcttcaatatcctgcctgcgtatggggcacgctccttgttcaagcgctacctggcgacttgaacccattgccgtgtaggagcgagcttgctcgcgaaaaacgtcaacgataacgcagcgctcctggttgaacgcggcgctctcgggattttcgcgagcaagctagctcctacaagagttatttcaactgcaacttatgcttcaagctgtgcatgacatccgccttgttctgcagatactcattcaagccccgcgcacgcaggttgcacgcatcgcaattgccgcagcctgtgccgatgatgccgttgtagcaagtcagcgtctgctcgcgcaccagctccagctggtcgtggtaatcggccagtgcccaggtttcggccttgttcagccacatcaatggggtgtccaggcgcagcttgtattccatgcccaattcaagggccttgttcaacgctttgacaaactcatcccggcaatcggggtagcccgagaagtcggtttcgcacacgccggtaatgacggcctcggccttcacctgataggcgtaaatcgacgccaaggtcaggaacaggatattacgcccgggcacaaaggtgctcggcaggctctcgcctgagctgttcacggtcggcacgggaatgttgtcacgggtcaggctgctgatggccagctcattgagcaaggacacatccatcactttgtggaccgtggcccccagttgcttggcaagcgtgcgggccacttcgatttccgccacatggcgctgaccataatcaaaggtaatgcagtgcacttcgtcatacagcggcagtgcctggatcaggcaggtcgtcgaatcctgcccgccgctgaataccataacggcttttttactcattgctttgcttcctgcatccgtagaattggagaatagtttaaagggcatgtcataaaaaaccccgcgcttcttgcgaaggcggggtttttaattgctcacaccactcagtgggcgtaggtcagcaacagctctttcggcacttggaaatccagggacatcatcacgctgagcgcggtgatggtgaagatcgagaacacgaacagcttgcgcgcccagacggtgtcatccaccgctttgtagccggtccaggccatgtacaaccagtacatgcccatggcggcggccacggccaggtagctcatgccagcgtagccactgaaggtcaacatcaaggtcgccacgaggaaggccaggatgtagagcaggatgtgtttcttggccacctggatgccacgcttgaccggcaataccggaatcgacgcagccaggtagtcattgaagcggaaaatcgcgatggcgtaggaatgcggcatctgccacaggctgaacatcaccagcagcaccagcgcggccatgtcgaagctattggttacagccacataaccaatcaccggcggcatcgcacccgacaggctgcccaccagcgtaccgtgtaccgacttacgcttgaggtacagactgtagaggccgacgtagatgacaaaaccgatcacggcaaacagcgccgccaacgggttggccaccttgtacaacagcaccacaccggcaacacccaggacggtcgcaaagatcagtgccagtttcagggagataagcccctgcaccagcacgcgattcttggtgcgctccatcttgatatcgatgtcacggtcgatgcagttgttgaacacgcaaccggaagcaaccaccagggacgtaccgatcattgcagccaggaagatggccagatcgacatgtcccttggaggccaggaagaaaccgcccgccacagaaagcacgttaccgaaaatgatccccggtttggtgatttggataaagtgcttaagcgacatcgggtcttacctcacttcgccatcatgaacgtatggatgctgaacatgatccatatcgacaggccaaccagcagcacgattacgatccctgcaaacacgaacgcaaccacgttgtcgcgctgctctttggaacgatccaggtgcaggaagtacaccaggtgaaccagcacctgaatcaccgcgaacgccaacacgatcatcaaggtgatcgacttcggcagggtcgggtacatcaccagaccaaacgggatgatcgtcaggattaccgacaggatgaagccgatagcgtaggacttaacgctgccgtggctcgcatcatggctgtcatggtcatgggagtgtgcattagccattacagagtccccatcaggtaaacaacggtgaagacgcagatccagaccacgtccaggaagtgccagaacaggctcaggcaagtcaggcgagtcttgttggtgttggtcaggccgtgcttattgacctgatacatcatcaccgccatccacagcaggccggccgttacgtgcagaccgtgggtgccgaccagcgtgaagaacgccgacaggaagccggaacggtgcgggccgtagccttcggagatcagcaggtggaactcgttgatctccatgccgatgaagcccaggccgaacaggaaggtcagtgccaaccagctcagtacgcccttcttgttgcccttgtagaaggccaacatggcgaagccgtaggtgatcgaactgaacaacagcaaggcagtttcgccgagcacgtaaggcagttcgaagatgtcgtggcccgacgggccacccgctacgttgtttaccagtaccgcgtacaccgcgaagatcgacgcaaacaagatgcagtcggtcatcaggtagagccagaaaccgaagacggtcattggccccgagtcgtggtgatggtcatcgtgcccatggtcatcgacatgggcgtgtccagcattggtcactaagttcgacatggtttaagcctgttccaacgaggtttctacacggttggccggaatcttcttctcggctaccaggcgagcgtgctgctcggcttcgatgcgttcgatcgtttcgaccggcaccatgtagccttgatcatcacgggcagcgtgaatgatgaagtaaccgatagtgcccaccaggctcgcgattgccagccaccagatgtgccagatcatcgcgaaaccgaacacggtcaacagcgcgcccatcaccacaccagtggcggtgttgcttggcatgtggatcggttcgtagtgcttgggcttctggtacgcagtaccgtcttccttggcttcggtgaacgcatcaatggtgttcgcagtcgggatcacggcgaagttgtagaacggtggtggcgacgaggtcgaccattccagggtgtggccattccatgggtcgccggattcgcaagcgttctgcttacggtcacggacgctcacgtacagctggatcaactggcaggcgatacccacggcgatcatcaccgcaccgaacatggcaacgtacaggtacggtacccactcagggttggtggtggcgttcagacgacgggtcatgcccatgaagcccagtgcatagagcggcatgaacgcgacgaagaagcccgagatccagaaccagaatgcagccttgccccagccttcgtgcagcttgaagccgaacgctttcgggaagtagaagctgaagccagcgatgtagccgaatacagcaccaccgatgatcacgttgtggaagtgcgcgatcacgaacaggctgttgtgcaggacgaagtcagcacccgggatggccagcagtacgccggtcatgccgccgatggcgaatgtcaccatgaagcccagggtccacaggacctggctggtcatgcgcagacgaccgtggtagatggtgaacagccagttgaatagcttcacccccgtcgggatggaaatcagcatcgtcgccaggccgaagaaggcgttgacgctggcccccgagcccatggtgaagaagtggtgcagccagaccatgaagcccagtacggagattgcacccgatgcgtagaccatcgagtggtgaccgaacaggcgcttgccggtaaaggtcgagatcacttcggagaagataccgaacgctggcaggatcaggatgtacacctcagggtgaccccatgcccagaacaggttcacgtacatcattggattgccaccaagttcattggtgaaaatgtggaaatccaggtaacggtcaagcgacagcagcgccatggtagcggccaggatcgggaacgaggccacgatcagtacgtttgcccaggtgcaggtccaggtgaagatcggcatgtccatcagtttcatgccaggggcgcgcattttcaggacggtggccaggaagttgacccccgtcaatgtcgtccctagtcctgataactgtagcgcccagatgtagtagtccacacccacgcccggactgtattgcaagcccgacaatggcggatacgcaacccaaccggtcttggcgaattcgccgacgcccagggacacgttgatcagcaccacgccggacaccagcagccagaagctcagggagttcaggaacgggtaggcaacgtcacgcgcaccgatctgcagcggcaaggccaggttcatcaagccggtgaagaaaggcatcgccatgaagatgatcatgatcacaccgtgggcggtgaagatctggtcatagtgttcaggtggcaggtagccaggcgaaccctcggtggccatggccaactgggtacgcatcatgatggcgtcggcaaaaccacgcagcagcatgaccatggcaacgatgacgtacatgacgccgattttcttgtggtcgaccgaggtcagccattcggtccacaggtaggaccatttcttgaaataggtgatacccgcaaccagtgccagaccacccagcgcgatcatggcgatagtcaccattacgatcggctcgtggaatgggaccgcgtcccaacttaatttaccaaacatcgtttactcctctgccccagcagttgaatgcgcgcctgtatcagaaccttcaaccgcggccacttctttcttctcatgcttgaccggcttgcctggcttcataccttcgtacttgtcgacgattttctgaaacaggttcggctcatacgtggagtacagggcgactgggttgttctggcttggtttggtcagggcgtcgtattcagcttgatcaagctgtttaggtgcggccttgacttcggctacccaggcgttgaaatcgtcctggctcgtcgagatcgctttgaatttcatgccggtgaagccagcgccgctgtagttcgcggagatgccttccatttcagctttttcgttggcgatcaggtgcaggcgggtctgcatgcctgccatcgcgtagatctggccgcccagggctgggatgaagaacgagttcatcacggcgtcggaggtgatccggaagttaagcggggtgttctccgggaaacggatctcgttgaccgtggcgatacccaggtccgggtagatgaacagccacttccagtccagcgcgaccacttcgatgttgatcggcttgacgtcggattcaagcggacggtacgggtccagctcgtgggtcgacttataggtgatgtaacccagggcgatgatgatgaggatcggtaccagccacaccgcaatttcgatcttggtggagtgcgaccacttgggcgcgtaggtcgccttggtgttcgacgcgcggtatttccaggcgaaggcgaacgtcatgatgatcacaggcaccacgaccaacagcatcagcagggtggcagtgatgatcaggtttcgttgatccagaccgatctgtccttttgggtccatcaaggtccacttgcagcctcccagcattaacatcatgccaagcagcggcaaaaagcctagtaatcgggggtacctgtttttactcatctcacgacctctaaagcagcttgcgcaatgcagttgggttttgatcgccaacacttcaccctgccaagggttggcatttctcttcgattgaataagagcctgcccgacacgtcatgactgtacgttgcacggaccagcagtgagttcttattcgatttcgtggctaaaggccttgttacagaccaattccatttggtgcggatagttgaaaggctgccggaacctggggtcgcacagagccttccatctgcccctcgaccgctccaatgctcaaagattgaacagcaccggacattcagtgcgggcgattgtagttagctagcgatgtataaaccatgtcttataaagaaataatttttatcgattccagcaacaatccttcaccaaacttgcaaagattcgcgatcttatcgcgttcaattctcaacaaaaaccacaaaaattgccctgttattgggcagattgccacttcccttacagcctgtaagggcatgccgaagctatccaagtccccataaaacaaggcattcatagctccgtcgagcgctcggaccacaggtgcggcgcggcgccgctcgcaccacgaactgacagcacaatttgtgcgctgggtgcaaatttaagcgccgatttcacgggtcagaaacgtcctgcgacagtgtccgtgtgacaacatgtcgcacactgtgcgcaccttaagttgctcctcgtcacggcgctttcacaaatccctacaaacaaaaacgctccggccttcacaagaaggacggagcgtcttaatggagcgaaggctcaggctttgggatgacgattgcgatagatgcacagcggcaccaggatcaccgtcagcacgaacgccaccagcgcccattgggccagggacaggccgagtatcggcgggtaaggcgtgctgcagaagccgtcgacctggaaacccaggggaaacactttggccaggggcaggtcatcgacgatcggttgcaacacatcaacgccgcaactgacctgtggaaagaactgtgtgtacacatggtggccggcagcagccacgccacccaaggcgctgagtacgaccagcccttcgaagactgtgaccgcccctttggtgcgcatggccgccccgatgaacgcgaagagggcgatcagcagcaaggcgtagcgttgcaggatgcacagcgggcacggtgcttcgcccagcaccacttgcatgtacagcgccccgccaatcagcgccaggcagatgatgcccagcaacaccagaaagcgccgctccctgcccaaacgcatatcgtcaatcatccccgttttccctttgcctgattatggttgtgcctgatggcaacaagtttacacacaggcagtggtttaaacagagaggggttaacagcagattaatcaggaaaaatagagcacttaatgtgggagggggcttgctcccgatataggtgtatcagtcagcatagaggtagctggcccaccgccatcgggagcaagcccctcccacattgggatagtgccgctacaaaaagattattccagcgccgcagccgggccgaagaactcatagcgcgcctgcttctccggtacgcccagcgccttcaggtgccgcttgatcgccgccataaaccccttgggccccaggaagtacgcatcgacatcccgctgctcaggcaaccaggcctccaactgctcctggttcagcattccaaccttgtccgccgccgggctgataccgtcatcctcggcataacagtagaaacgcttgagctgcggatgctgggccgccaggctgtctacccagtcacgaaatgcatgcaccccgccattacgggcgcagtggataaaatgcaccgggcgctgggtcgccagggccgcttcgagcatcggcagggttggagtgatacccaccccgccgctgatcagcaccagcggtttatcactggcggccagggtgaactcgcccgacggtggaaacaggtcaatggtggcaccgatgtgcatctggtcatgcaggtagttggacacccgcccaccggcttcgcgcttgacgctgatgcggtacatgccgttatcggtgagggccgacagggaataattacggcgtacttcttcgccatcgagcaccagtttcagaccgatgtactggccaggtgtggcagccaggatcgggccgttatccaccggggcgaaatagaacgaggtgatctcgtcgctctcctccacgcgcttgaccaaaaggaacggccgcgcaccgcgccagccgccgggcgcctgggctttttcatcgtagatggccgcctcggcgccgatcaggatgtccgccaactggccataggccgcaccccaggcactcattacctctggggtggcaatctcgctgcccagcacttcggatatagctcgcagcaggcaggcaccgacgatggggtaatgctcgggcaggatctgcaaagccacgtgcttgttgatgatcttggtcaccaggtcgcccaattggtccaactggtcaatatggcgcgcgtacatcagcaccccattggccagggcgcggggctggtcgccgctggcctggtgagcctggttgaacagcgggcgcacttcggggtactcggagagcatcatgcggtagaaatgggtaatcagcgcttcgccgccactttccagcaggggcacggtggatttgacgattgcacggtcttgggcactaagcatgggagactcctaggtctttttactcattaccctttggtagtcagtattcgtgccaactaataaatcctttattttcaatagattaaatataatctagtcaaaacgacttcctacgctttatagtcataaggactacaaggagtcattatgactgcacaaccgttgctcaccaccctgctgccgctggttgccgatctgtctcgggaattgcccgaaggcgagcgttaccgacgcctgctacaagccatgcgcgccctgctgccctgtgacgccgccgcgttgctgcgcctggacggtgagtggctggtgccgctggccgtggatggcttgagccccgacaccctgggccgacgcttcaagatcagcgaacacccacgcttcgagatactgctgagcagccccggccctacccgtttcgacagcgacagccaattgcctgacccctatgacggcctggtcgccggtttgcacgggcacctggaagtccacgactgcatgggctgcccgctgtttatcggcgatcagccctggggcctgctgaccctggatgccctcgacaccgaacgctttgaacgggtcgaactggacgctttgcaagccttcgccagcctcgccgcggccacggtcaatgtggcgcagcgcatcgaacgcctggcgttgcgggctgaagacgagcaccaacgcgccgagatctatcgccaggccagcggccagcagcacaaggaaatgatcggccagagcaagacacataaacgactggttgaggaaatcaagctggtgggtggcagcgacctgaccgtgctgatcaccggcgaaaccggggtcggcaaggagttggtggctcaggcgattcacgcggcgtcgtcccgtgcggataaaccgctgatcagcctcaactgcgccgccctgcccgaaaccctggtggaaagcgagctgttcggccatgtgcgcggcgcctttaccggggcgctgaatgagcggcggggcaaattcgaactggccaatggtggcaccttgttcctcgatgaggtgggtgagttgtcgttgaccgtacaggccaagctgctgcgtgtgctgcaaagcggccagttgcagcgcctgggctcggacaaggagcaccaggtggatgtgcgcctgatcgccgcgaccaaccgcgacctcgccgaagaggtgcgcaatggccgctaccgtgccgacttctatcaccgtttaagcgtgtacccgctgcaagtgcccgcactgcgcgagcgcgggcgtgacgtgctgctattggcaggtttcttcctcgaacaaaaccgttcgcgcatgggcctgggcagcttgcgcctgaccgccgacgcccaagcggcgctgctggcctatgactggccgggcaatgtgcgcgaactggaacatctgatcggccgcagcgcgttgaaagccctgggtaactgccgcgagcggccgaagattctcagcctgagtgcccaggacctggacttgcccgccgtcactgcagcggtgactgaagcaccggtcgaagcggcgcccatcgccactggcgacctgcgccaggccaccgagcactaccagcgccaggtcatcagcgcctgcctggaacgtcaccagcacaactgggccggcgccgcccgggaactgggcctggaccgcgccaaccttgggcgcatggccaagcgcctgggcctcaaatagaccaggcgactcagtaaagtgtgggagggggcttgcccctcccacattagatttgtttcgcatgaaaagtcggagctaccggcttgggtttacgaaacaccaacacattccccaacatcaccaacaccagccctgccaaagccggcgctgtccactggtagccctcggcaaacgccgacacattcaacgccaccactgggaacaacacggtgcaatacgcggctttctccgggcccatgcggccaaccagggtgaggtaagcagtaaagccgatgaccgaacctgggatcaccaggtaccacagggcgccgatataccgtgcactccagtccatttcgaaaggaataccgcgtaccgcgcaataggtggccaacatcgccgcgccataggccatgccccaggcgttggtggtcaacggcttgagcccggccttctgttgcaggctcgagagcatattgcccgccgagaaacacagtgtccccagcagcgccaagcccagacccagcaaggtctgcgggctggcggtatgcccggccaattccggccagaacagaaagcccaggcccagcaacccaagcgcgccgcccatcaacacgttacgtgcaacccgctggccgaaaaacacccgggcattcagagcgttccacaaggtcgccgtggaaaacaccaccgccaccaagccgctgggtatccactgactggcagtcagaaagcacatgaagttgacgcagaacaggcacagcccttgggccaggcagatcaggtgcccgcgcctgttcatcacctgcaacttgccgctgagcagcaacagcccgaacagcaccagcgcagccaagccgaagcgataaacgatcgacacaggaatggcgaccacgcccagctgccatttgagcgcgatccaggtggtgccccagatcagcacggtcagtaaatacaggaagaggttcatagcgggctccatcgattgagccacagtgtcgcccccgctccttgaaaggctcttgcacattcttgcgcttttatcgagcggtgggctcacagcgccagccgtggagcgtaggatgcaaggtgtcggagaacacaccatgccagagctggaatccctgcaagtctttcaatccctcaaccgttcgccccatgcgcgcctcgaggcctgcgccgaactgggcgatggcttggctgcagccgtgtggagcaaccaccatgacgcccaggattaccaggcgcccagccatcacaccttgtcgtgctacatcggcggcggcaccggcacgtttcgccgtgagcggccgggcaccatgggcggccccgacaagctgtgcatcctgccggccgagcatcagtcggcctgggtgatcaatggcgagattcgcctggcccatgtgtatttcagcccggaacaattcgccctcggctgcatcaccctgctcgaccgcgagccgcgtgcactgcaattgcgtgagggcaccttccttgaagatgcccgccaggcccggcgttttcaccaattggtcggcctcaactggcacgagcccggcgagcgcctgctgaccagcagcctggcccatgaaatgctcagccataccctgctcagccaggtcggcgcccgcgacggcttgcgcctcaaaggcgggctggcggcgcaccagcggcggctattggtggagtacatcgaccaccacatcgaagcccccatcagcctcggccaactggccgcgatgtgcgccttgtcggaataccatttcgcccggatgttccggcaaagcttcggcctgccgccccatcaatacctgctgtcacggcgcctggtgcgggcgcagaccttgctgcgcagcagcgcgttgccgatgggcgaggttgccctgctgtgcggtttttccagcgccagccatttcaaccaacgttttcgccaagccatgcgcgccaccccgagtgaataccgccaggctttctgcgcctagaccatcaagcccagcgtcttggccttggccaccgcctgggtgcgtcgctccaccccgagtttgctgtggatacgccgtgcgtgggtcttgacggtgtgcagggagatatacaggcgctcggcgatttccaggttggaattaccgagggcgatcaactccagcacttgcagctcgcgctggctcagtgggttctccacggcaccgacaggcgctgcctgtggctccaggcccagttcactcaatagcccaggggtgcgcaaacgcaactcgcgaatggcctgctgcacctggcaacgccccgccagcgccaacccggcctgcaacgcccgacgagccaaggcggggtcaccgagctgccaggtcacttctcccagcaccaggtgcagttcggtttccaggcagagcatgccgcgctgccgggaggtgtcgagcaaggcattgagccgcgtaatgggttgttcggcacagcccagcttgacctcggccagcaccagcaaatattccaggcgcgggatcagctccaaggtagccggtggcgcctgcttggcgcagggcccacgaaaatgacgcaacacccggcgcaccgcttgcaccgtcaattcagcacgtccctgctgcaaccagaagtgcccgctgaccaacagcagcaccgctcgatacaccgtgtccggcacatggcgctgctgcatcaggcgctcggcgtcacgcagttggataaaggcttgggcgtagtcgccacgattggcggccaacagcgccaggccgagaaagccataaagcacgcgtttgtcctggctctgcaggcacatcgtcaagcccgcttcaaaacactcggccgccaagctgtcttggccctgccgcaaggccaagtgcccgcgacgcagcacaatacgccccaccaacggcccagccttgagacgttggcgagccaacatcgcctgcaccgtctccaacaggctttgtgcccggtagggtgcgccgcgctgctccagcaattgagcatgatccaactccagcagggcctccagcaccagcgaatcatgggcacgggccaggcacagggcttcgcggttcaaggcttgggcgacatccagctcaccgcgcaacaaggcttgctgggtcaggcccgacaggcacatcaggcgcgacgtccaggcactctcaggcaaggcttgcaacgcttcgaggaaatgctcgcgggagcgtccggcatcgccgctcaaatgcagcagccagccccattgggcctgccagcgcgccagcagatagcgttgcccagcggccgtcggctggggagcaaaccgagccagttggtcgatacacaacgccgcttgctcgaagcgcccggcaaacagcaaggccgccgtgaccaaccccactaattgcgcagacccaagcatcaactcatcgccgtgctgctcatgcaggcgcaacaggagcaccgcgttttgctggcgaaacaaatcttcgaaactgaaatgctgcaataggcttaccgccagttcgtattcctctgccagcagcgcctgctcgaaggccgcctgccagtcggtttcggcgcaaaaccactggcacgcacgccggtgccatgaacgcttggtcggccagggggcttcgcgcgtcaatcgcgccagcggggcaaagacttgcagccattcactggtgtcttcccaaggttggataaacgcgccgagcgcctgcaacgcgtgcaaatactgagcgccgtcgtcaatgccgaatagatgctcacacaagctttgattgaagcgtggcagatgggccagcacgcgccaggcatccaccaatggcgtcggcaaggtgttgaagagttcatgctgcaggtaatcgagcaaggttttgtcgggatggccgtcgcccagcaaggcaatacgtaccccggcacaccaaccggcgctgaactgcataatgctgtcgacgctctgccctggtgcgagcagcgtctggatctccgcagcgctgaatgacaactcactgcactccagcaattcatcgtcgagcaacaggcgtggccagttgcacaacggacgtcgccgcgcacccagccaccaggtcaggtgtgggctgctggcggtgagcaaacggtcaagcaaggcgtccaggtcgggcgccggcagacgacagaaatcatcgagaaacagccacgtggggtttggccaacggctgaggtcgagcagcaatgtggcttcgtcaataaaccgcagacccaggtattgcgccagccgtgcgcagaaatccagaggggtgagcgccgcaccattgagtggcatccagtagacctggcactccttgggcgcctgcaatgcacactcggcgagcagcgcactcttgccactgcccccaggcgcgcacagcaacttcacccgcgccggtgccgcgagcagcggcccagccaggcgcgggcgcaacaggtggtgagcggacagccttggcatgagtccaggacggtccaggcagcgggtcatggcggtcattgctgcatcctgcttttttattgttatgcaaccgtagacccgtggttggtggttgttgaagaagtattcagcggggtgattagtgaccatgcacaaacccgacattccagtgggctgtcaggccaccatcgggggcaagcccccctcccacacgttgatcgcatttcacaaaggtactatcgaacgcctgccgacctcagtgcggccggggtgtagtccgccgccttggccgcgaagccgaatacgaagctgctcttctcctcgttcttcatgcccagcgcgatatagcgccccgcgatgaggtcgtacagggtttccacggtgtaggccggcacctggtggtcgtagtagaactgcgcgtgaccttcggcgacgcgccacagttggccgcgaccgtcgtagtgatccaccagggcgacctgccagctgtcttcatcgatgtacatatggcgcttggcgtagatgtgccgctcgctgggcttgacggtgccgaccacttcccacacgcggtgcagctcatagcgggtcaggtcctgattgatatgcccggccttgatgatgtcgtcgtacttgagcttcggcgaatcgagtttgtagctgttgtaggggatgtacatttccttcttgcccaccagcttccagtcataacggtcgggggcgccggaaaacatgtcgaagttatcggtggtgcgcaggccgtcggaggccgtgcccggaccgtcataggacacctgcggcgcccgccgcacacgacgctggccggcgttgtagatccaggccaggcgcggctccttcacctggtcgagggtttcgtgcaccagcagcacattgcctgccagccgcgccggggcggtgaccgactgcttgaaataactcagcacgttggccgccttggcctggtcgatatccgcgatggcctggggcaccgccacttcttcttcgaagcggatcggcgtatagctgccgttggtctgcggcgtggcctgggtgatgatgcggcgcaggttgccaccgtgataacgggtgatgtggttccacagcacctccacaccgttcttagggatcgggaacgcgtaataacgattgccggtgaagttttccaggccgttgccgtcattgatcgcatgcacattcagggcgctgcgcttgatcgactcgtagatgtctgccggcagattgaccgtgcgatggctggggtagaccggaattttgtaggtttctgggtagcgtttgaacatcgccacctggccctcggagagtttgtctttgtacttgtccacggtggagggcgtgatcacgaacagcggtttttcattggcaaaggggtcggcgagaaagcccttgctgtctaccgcgccggcgtttttcgggatgccgccggtccaggccgggatcgagccatcggcgttgccggccttctcggcgccgaccggggtcagggtggtgccgagcttggcggcttcttcgggcgacaccgccgccattacgttagcggccaatacactcagggccatcactgcaatcatcttacgcatagggtcttgtccttcttttaagccagatcagaagttcacgccgaagctgagggcgaggaaatcgcggtcggtcagggtgttgtagtcaccaccaaagaagtcggtgtagctcaggctggcggtgtaggtgctgcgatagtccgcatccacgccgacgctgatggccttggcgcctttgttgaacaggccgttggggccgtagccagccacgtcatgggaccaggacaggttgggcttgaggttcaccccggcaatcgcgttgttgtagtccaggatcgcccgcgcgcggtagccccaggaggtggaggtgacgaaaccgtcagtgtcgccctcgaaaccgtaggcgccgtacaccgagtcgcggccataacgcagcttgcttttatcttccaggcccgcgacgtgcaccaccgccgcttcgccaaccagcgtcaggcgttcggcgcccagcacctggtcgaagaactgggtcatggtgctttggatctgggtgatttccttgcggcggtagcctttgttgtccgcaccaaacgcgctgcggatcggcgacgcggtattgccggcaatcgggttgaccagcgccagggtcaggtcggtggtgttgagttgtaccggtgcattcggccgatagctgatctcgccggtccacgccgtgccagtaggcagggtggtggaaaaactggcgccgaacaggcggatatcttccggataatccaggtagtactggccacggccaagcatggtgctctgggccagggccgacccgaagcccggcggagcagcggcaccaatggcgccgatggtcgcaaggttggtattggcggtaatcgtgcccacggtcggggtacggctgtggtaattcatgaagtacaggccgtattcagtgtcatcacccagccagcgcaaggccgcgccaaactagccggagtctcgtgcatcacggtcgccagcgcgctgcaccaccaccccttcgcgggtcaccacaaagccttggccacgtgccgctgctatgggttgcagaggggcaatcgccgggttgcccaccgtgtagttaccggtgcagccgtccgccgccacgtcccctccgaagaaggtgccgcagttgtccagcacggtctggtcccattccagttggtagaaaccctccacggtcagttggttggtcaggctttgtgacgcaaacagcatgttcaccgggatcaacccttccttgatctcggcccctgggcggcgaaacgccgagacgtcaatggggttgatgctgttgatggagttaccgatgaaggtgctttcgccccaactgaccacctgcttgccggcgcgcacggtgccgggcaggtcgcccagggagtagttgtggtagacgaaggcatcgaggatttgcgcgccgctggatttggcgccttctttgcggttgtgatcgctgatctgcttgaactcgcgatcttcgtccttgagttcgaagtcgtaccagtatttgccgcgcacgaacacgccggtgttgccgtatttcagctcgaggtcgtgcaggcccttgaagatcttggaaaaggtctcgcccttcttgaagttgaggcgcccgtcatccccggtcgacgcctggccggtgccgccgttgacggtgctgaccaggcttttatcggcatcgcgcatgccccagctggcgcccaccgagagcgaagagtcgaattgcccttcgatctcaccaatattgaacgaaacagcctgtgcctgggcacagcaacccaacgcaaccgcagtggccagcgcctgtggcgtgaagatggcgcgcattattgtttttgtcatgcgtcttccccggtgagtgacagaaggccccaccctactgccgcccttgaggagcgataagcgcaccaaggaggtattcgtgttgtcactcgaaaggatgaatggcccagcaggacggggcttgcacagggcccatgcattagacggataaggggctatcaggagaatccatggcgagatcaattattgtcatttatgtaacagtcattgtcctgaactgctattactcattttgttacaaccgattattcttgcctggctttcagggcaaacagcccgcttccaaggttgggagaaaaagcctatttacaacagattgatcctttattcagtctgttcccggtgttcactgacgttgatttgtcgctccttgatccaacgtcttacttcggccgctgctatgcagcggccttttttatgcccgcaataaaacggggcgtcatcgacgccccgttggattcagtgtttttccagcaacgatcagaggctgaacttctgcaagttagccatcatctcctttaaggcttcaatattatccttggggtgcgcggccccttcaaaattacagatctgctgccagtgcgcggccacatcctgcggcgagaagcccgcctccggatcaaagcccacccccaggctgcgctcccagcgggtcttgccgatccaaccgccacccacttcaaacaaccccgcggtttcctcgcaggcttcactgcccaggtacaccaccaacgggctgaccagctcaggcttgagccgctcgaacacctgcggcgggatcagcccttcggtcatgcgcgtaccacccgtgggggcaatggcattgaccaggatattgttcttgcgcccttccagcgccaaggtacgggtcagaccatacaggcccaacttggccatgccgtagttggactggccgaaattgccgtagatgcccgaggtggaggcggtgaagatcacccggccataaccctgctcgcgcagatggggccaggcggcgcgggtgactttgtaggcgccttcgacatgcacccggtagaccaggtcccagtcgctgtcgtccattttatggaaggtcttgtcgcgcaggatcccggcattgttgactaccacgtcgatacggccgaatgcatccagggcattttgtacgatcttgtcgccgtcggtgacggaatcatggttggcttcagcaatgccccccgctgcgcgaatctctgccaccacccggtcggccgccgaggcgttggcgccctcgccctgggttgagcctcccaggtcattaatcagcactttggccccgtgtttggcaaacagcagcgcatgggcccggcccaggccaccgccggcaccggtgacgatcacgaccttatcctggaactgcactgactcactcataccgaactccgctggcgacaatgggaatagccagagtgtcacgcacagcgcctttggtcacaataaagacggccgaggctgaatggtgctcgataaggcagcaggatgatgccttttcaggaatagaccgcacgcggcgtcggctggccgagacgatcacggaacgcctggtagtgtttgagcacctgcaccggcgcctcgatctgcgggtagtggccgatattggccagcattaccgtgtcggcgtgggccaccagttggtgatagcgttcgaccatatgggcaccggaaatgggatcaacctcaccattgatcacccgcaacgctacatcgccctgctgcatggcggctacccagcgctcgcgcaggcgatggcgctggggaatgtaggtaatcagcttgtgcaggatgcgtgggccatcattgcagttgatcaggctccagaaatcatccagggcgctttcactggggcgtgtgcacgggccgaagatctggttgaaactgctggccagcgcactgcgcccagaggcccggccgatcatccagcccagggggctgagcaataatttttgcaccaacgtcggccgatgggtctccgggaacagcccgccgttgaggaacacacagctggccatctggaaacgcccctcgtaatgccgggcgagtaattcctgggcgatgctgtcgccatagtcatgggccaagacatgcaccggttgctccacacgcaggtgatcaagcagcgcctgttgcaagtcggcttgttccagcaggcaatagtcgtgattcaggggcttggccgagtcgccaaagccgagcatgtcgcaggcaatcactagatggcgctgagccaacggctgccacagatagtgccaatcccaactggcagtggggaagccatgaatcagcagcaacggctcgccctgcccggccacccaataacgcagggtatggccacgaaagatgaagtcctggccgcgtttgcgccaggctctgagtggtatctcggcgagtggcatcagcttttatatccggggtcctggtggtccagtttgcgcagcaacgccggccaggccagcgcaccacccataccttgggcgctttttgtgacagctgccaccatcgccttggcaccagcgagaatctgcggcccgatggcaatcagctcaggtgcgccgttttgcgccagcacctggatctcgcaggcgcgctggaaggtgaacatcatcaagaaggtatcggcgatggtgccggcgcaggtcagcaggccgtggttgtgcagcatcaggaaattgtggtcgcccaggtccgcctgcaggcgagccttttcttcgtgattgagcgccacgccttcataggcgtgatagccaaggctcgacagcacgaacagcgattgctggctgataggcaacaccccctgcttttgcgctgagaccgccacgcccgcagcggtgtgggtatgcagcacgcacgtcacgtcatggcgcacttcgtggatggcgctgtggatggtgtagcccgcggggttgatctcgtaggggctttccatctgcttgttgccggcctgatcgaccttgaccaggcttgaggcggtgatctcgtggaacatcagcccataggggttgatcaggaagtcctcggtacctggcaccttggcagaaatgtgtgtgaagatcaggtcgtcccagccatgcatcgccaccaggcgataacaggccgccagatcgacgcgggtctgccattcggcagcactgacctgggctttgacattctgtggcgataaagcgggggctaggctcacggcaatgacctccttggcgcacttcttattgtgtcgaaagtgagagccagtctagtcagacgccgaggccgaaggagttgccttcgcagccagcttgatgactgagcgagtcagccaacagaatagtacaaatttgtgtcaggcaaacgccgtcaatgaaggcaggtcttcactgacgacgtttactgcgatcaactgcgcagtgcagtgaccagctcggccagccacggctcggcatcggtttccggggtgacgctttcgctggcgtccaggcgcagcatcggcagcacctcacgtacccccaactcaccgaacaattcgcgcatctgctccccgccaccacagaaagtatcgccataactggcatcgcccaagccaatgaccgcaccgggcaggccgcgccaggccgcgggcagttgatcgcgaatggtcgaatacaggggttgcagattgtcgggcaactcgcccatgccggtggtcgaggtcaccgccaggaaggcctcagggccaaacgcctgcacgtcggccaaggtagcgcgagggttatgccaggcttcaaaaccggcgtctttgaggatttctttggcatggcgagcgacttcttcagccgtgccatagaccgagccggaaaggatggcgactttcatcaatctgatcctgtagttgagtgaaagcctgggatattagcagcccgtgccaatatttcagtgcgcaccgtgcaacattcaagacttgccataaacttgcagggtcaaaacaagccatggaccgctcaatgattaacgccaagctgctgcaaatggtcgtcaatgcttccaacgacggcatcgtcgttgccgaacgcgaaggcagggacaaaccgctgatctacgtcaacccggccttcgagcggatgaccggctacaccctggacgagatcctgtatcaggactgccgcttcctccagtcaggcgaccgtgaccagccggcgctgatggccatccgtgaagccctcgacagcggtggcatgtgccgggagatcctgcgcaactaccgcaaagacggcagccacttctggaatgagttatcgctttcgacggtgtacaacgaggccgataagcagacgtacttcgtcggcgtgcaaaaagacgtcacccttcaagtcaaggcgcagcaacgcgttgcccagctggaagcccaattggccgaactcaaagccgagctcgcggctctcaaggcgacgagcggaattaacaaactgtaaaagatgcagcctttagagcgataatggctctttaatgccttagccttgagccagatcaatgcagcgccacacgctattgacgcaggacgagctggattttatccaggacatgcagcacaacccgcagctcaacctgcgggatgcgtggtcgagcctgacggtcaatggcggagcgcagattcgcgatttgctcacccggcttgccgctcacgaccaggtcaccatccaggcgcagttcgacaaccagcaactgaccttccccctgcatttggtggaagatgaatttcatgccgtgcatttgcgcctgggtgtgccgagcattttcgaagacggcccgatgatccgcccctggcggctggccctggaagcgtccgtggcgctggagaacgtcaagggctacgccagcgcattgtgggtacacgaagtgtcattcaagggtgtgctggtagaagtgcgtggccggaccaacccacccaagaccttttccctgtggttcagcccttccggctacgagcgtatcgcgctgcgcggtacgttggagcgggaaaccgctcgaggcctgtttgcctatcgcctgaatcagagtgatgccggtgaaatcgagcgcctgcgccagttcatcctgcaccagcaccgcctggtccatccccaggtgcatgcctgagatcaggtatccaggcgaccgctgagaaactgctgcaagcgacgtggcatcacacggccgtcattgcccaggcaaccaatcgacgagcccgcgaggctctgttcggccaggtcagagacatccccagccagcagcagcgggcaatcgagcgtcaatgcaaggcgattgagccgcgatggtagttctgcgccgggtgcgtgattggaaaacatcaccaaggcttgcggccgggttctctcacaaatcagcgtcaattcatcgagtggctggcccactcccagaaccttgactgcgagcttgtcgcttgacatcaacaggcctgcaaccagcatttccagctcacggcactctcccgcgatggccgccaacagcaccctgggtaccggcgaggcacaggccatctgcaggcaacgcgaggcgtgcgagcgcaggaagttgtcgaagaacagccactcgctggcctggccaaagcgcccctgatgacgcaacagttgctgccatagcggcatcagaatgtcttgaaacaccactgtcgttgagtagacgctgaagatctggccatacaggtggcccagctcatgatcatcaaaggcgctgattgccaacctcagctgtgcctgccactggcgccactccagttcggtatcgctgcgtgacgccgtggcgggctcgccaggcagtgggtcgcgcgccaggatcttgcccaccttgctcaccgctacgccacgctcgatccagtcgagaatgcgatgaaccgtatcgatatcggtgcttgaatacagccggtgcccactttcggtgcgcacgggctggatcaagccatagcgacgctcccaggcacgcagtgtcaccgggttaacaccggtaacccttgccacttcacgaatcggaaacagcacctcggcgtcagcgtgtcggtcgggtgtcgtttctcgaacaggagcaatgatttcggacatcagcagtcaaaaaatccgtttgggcttggatcttatttaacgcccattaaagccaatgattcaagatctacggcaaaccatccgaagtttctggcgtatttcggcaaaaccggaataatccttgcctgttttttacgtcgctgcatcaccccgcagcttcgttcgtgcgccgcttatccggcccagcgcacccgatcacttggagatacacaatgtctacttcacccgtcaccttgatggttgcgcgacgcgtggccaaaggtcgctacgaagaactgatggcctggctgcgcgaaggcgagcaattggccactgacttcccgggttacctgggctctggcgtgctagcccctccaccccacgacgatgaattccagattatctttcgcttcgccgacgaaaaaaccctgcacgcctgggagttttccgcctcgcgcaacgcgtggctgagccgcggcagcgaactgtttgccgacccatccgagcaccgtgtaagcggtattgatggctggttcggcgccgtgggtgctcgccctccacgctggaaacaggcagtggcgatctggctggcgtttttcccggtgtcattgctgttcaacttcggcctggggccgctgctcaacgagttggacttgttcagccgggtactggtcagcacggctgcgctgacaccgttgatggtttacctctttatcccgctgtcgacccatctgctggcgaactggctacagccctcgccttcacgcaaagtcaccgaagccgccgcttgagtacagggggccggggcgctggtatagtttcagcctgcccgcgacttgagcctcccatgactgcaaccaacgccccgatcctgatcaccggtgccggccaacgggtcggcctgcattgcgccgagcgcctgctggacgagggccaatcggtgattttcagctaccgcaacgaacgccccggcgtgcaggccctgcgtgatcgaggtgccatcggtgtgttcgccgacttctccagcgaagccgggacgctcgcctttattgccgaactgcacacccatacccaaagcctgcgcgcgatcatccacaacgcgtcggcctgggtcgcggaaaccccaggcgacgaaagccgcgcctttatcgacatgttcagcgtgcacatgcttgcgccatacctgatcaacctgcattgttcacccttgctgcaacgctcgacacctgccgacatcgtgcatatcagcgatgatgtggtgcgcaagggcagtcgccagcacattgcctactgcgccaccaaggccgggctcgacagcctcacgttgtcgttcgccgcgcagttcgcgccgttgatcaaggtcaatggcatcgctgcggcgatggtgatgttcaatgagggcgatgacgcggcctatcgcgccaaggtcctgaacaagtcggccttgggcatcgagcccgggcccgaggtgatctaccagagcgtgcgctacctgctggacaacccctatgtcaccggtaccaccctgaccgtcaacggcgggcggcatatcaagtaagccgtttgtgaggatgttgcatgactttatccctgccccaccactatcgcgaaatcctcaagggcttgggcgaggacccgcagcgcgagggcctgctcgacacgcccaagcgtgccgccaaggccatgcagtacctgtgtcatggctacgagcagaacctggacgaaatcgtcaacggcgcgctgttcgcctccgataatgacgaaatggtgatcctcaaggacatcgagctgtactcgctgtgcgagcatcacctgctgccctttatcggcaaggcccatgtggcctatattccgaccggcaaggtactgggcctgtcgaaactggcgcgcatcgtggacatgttcgcccggcgcctgcagatccaggaaaacctcacgcgccagatcgccgacgccatccaggacgtgacccaggccgccggcgtggctgtggtgatcgaagccaaacacatgtgcatgatgatgcgcggcgtggaaaaacagaattcaaccatgaacacctcggtgatgctcggcgccttccgcgattcgaacaccacgcgcatggagttcctgcaactgattggacggagcaagtagcaatgccacaacttcaaccaggcatggcgcgtatccgggtcaaggacctgcggctgcgcacctttatcggcatcaacgaggacgaaatcctcaataagcaggatgtgctgatcaacctgaccatcctgtatgccgcccaggaagccgtgcgcgacaacgatatcgaccacgccctgaactatcgcaccatcaccaaggcgatcatcgcccatgtcgaaggcaaccgtttcgccctgctggagcgcctgacccaggaattgctggacctggtgatgagcaacgagtcggtgctgtacgccgaggtcgaagtggacaagccccatgcgctgcgttttgccgaatcggtttcgattaccctggcggccagccgctaaccccctgaatctgcagtgagccctatgaacgaccaacaacgcctcgaactcgaagccgccgccttccgccggctggtggcccacctggacagccgcaaggatgtgcagaacatagacctgatgaacctcgccggcttctgtcgcaactgcctgtccaagtggtacaaggcagaggccgacgagcgccagatcgaggtcagcctcgatgaagcccgtgaagtggtgtacggcatgccgtatgccgagtggaaagcccaataccagcaagaagccaacgccgaccagcaagcagcgtttgccaaaggaaaaccccatgactgatttgaataccctgcgtgccagcctcgacagcggcgaacacgtctttgccgataccctggcctttgtcgcgcaaggctacgactaccagccacaggcgttcaccaatggcgatgtggaaaacgctgctgggcagaacgaaggctcgtgcaagaccttgggcctggcactgctggaaggcttgagcgaccaggaagccttgctggcgtttggcgagcactaccgctcggtgatggccacgccggacggcagtgaccatggcaatatccgggctttgattgcccatggtttggctggggtaaaatttgccgcgcagccactggcccgcaaatcctgagtcaaatacatatccagatgtgggagggggcttgctcccgatagcggtgtatcagctaactaatacttggctgaaaacccgctatcgggagcaagccccctcccacatttttttgcagcgttgtttagaacgaagcgtccttcaaaccgtcgaggtaacgctcggcatccagggccgccatgcaaccggcgccagccgaggtaatggcctggcgatagacgtggtcagccacgtcgccggcagcgaagatcccttcgatgttggtcgcggtagcattgccttcacgaccgccctgcaccaccagatagccgtctttggcttccagcacgccttcgaacagcgaggtgttcggggtgtggccgatagcgatgaacacgccgtcgactttcagctcgtcgaagctgccatcgttgtttttcaggcgagcaccggtcacgcccatgttgtcgcccaggacttcatccagggtggcgttgagcttgaggatgatcttgccttcagcgacacgggcgtgcagcttgtcgatcaggattttttcggcgcggaaggtctcgcggcggtggaccagggtcacggtgctggcgatgttagccaagtacagtgcctcttccacggcggtattaccaccgccaaccacggcaaccggcttgttgcggtagaagaaaccgtcgcaggtggcgcaggcagaaacgcccttgcccatgaaggcttcttccgagggcaggcccaggtaacgtgcgctggcaccggtggcgatgatcagtgcgtcacaggtgtacacgccgctgtcgccggtcaggctgtaaggctttttcgagaaatcgactttgttgatatggtcgaagacgatctcggtctcaaagcgctcggcgtgctctttcatacgttccatgagcaccggccccgtcaggccgtggacgtcgcccggccagttgtcgacttccgtggtggtggtcaactggccgcccgcctgcatgccggtgatcagcagcggcttgagattggcccgggcagcgtagacggcagcgctgtaaccggcagggccggatccgagaataatcactcgggaatgacgggtatcagacatgactcactcctatcgaccgctcgaaccacagagcggctggaataaaaaaggaccgcgaagcacttggggaaggctttgactcgccaggtcctgaaaaataatgggtgcagggtatcgaggggggcaagattaaggaaatacgcattaacaatccagctcatagcgactctctatgtgcttgattgagttaatcgacacctttgttaccgtggatgtcgcctccgtgcctgcgctttcacatcctgtgcaaagccggtaaggtcggcgcgttcgtcatcctgctcggagttgtccatgcctgcccctgttctttctggcccgcaatacctgcgtgaaggcctcaaactggtgttgagccccggcctgcgcctgtttgtattattgccgctggggatcaacctggtgctgttcgtcgggttgatctattttgccggccatcagttcagcctatgggtcgatagcttgataccgacgctgcccggttggctaggttttttaaattacctgttgtggccgttgtttgtggtgctggtggtgctgatggtgttttttaccttcaccatgcttgccaatatcatcgcggcgccattcaacggcttcctcgccgagaaagtcgaggtggtggtacgaggcaccgatgacttcccgcctttcagctggggtgagctgatcgccatggtcccacgtaccctggcccgggaaatgcgcaagctgggatacttcctgccacgggctatcggcctctttatcctgtcgttcattccggtggtcaacctgatcgcggcgccgctatggttgctgtttggcgtgtggatgatggcgatccaatacatcgactacccggccgacaaccacaagctgggctggaacgaaatgctcgcctggctgcgccagaagcgctggcagagcatgagcttcggcggcatcgtctacctggtgctgctggtgccggtggtcaatctgctgatgatgccggctgcggtcgccggggcgacgttgttctgggtgcgcgagcaaggcgccgaggcgatgacgcagcaaacagtggccaagtcataaatccatcatcgcgctgacacaatgacgacatggcccacggcgacactgtgggtcatgacgacagcctcgcttcacataaccctgatcaccgaaaccttcccgccggaaatcaacggggtggctaatacccttggccgtctgtgcgagggtttgcgcttgcgtggccatcaggtcgaactggtacgccctcgccagggtgccgaccagagccggtcgagtgacgaccaattgctgctgtgtcgcggctggccattgccgggctacccaggactgcaatggggccaatcgtcgatgcacaaattgctcaggcgctggagccgccaacgtccggacgtgctgtatatcgccacggaagggccgctgggcttatcggccctacgagcagcgcgtcggctgggtatcagcgtcgtcagcggttttcacaccaacttccagcagtactcgaaccagtatggcttgagcctgctcagtcgcatggtcacccattacctgcgctggtttcataaccgttcgagcctgacgctggtaccgagcgccagccaacggctggaactggaacgtcgacatttcgagcgcctggagatgttgtcacggggcgtcgacagccaattgttccatccggccaaacgcgacaatgcgttgcgcgaaacctgggcgttgaacaatgagcaaatcgcggtgctgcatgtaggaaggcttgcgcaggaaaagaacctgggcctgctgaaacgctgcttcgagacgctgcaggaccgttacccaatgcgccagatgaaactgatcatcgtcggtgatgggccgcaacgggcgatgctggaaaaggaactgcccgaagcgattttctgcggcgccttgcgcggcgaagaactggcgcggcattacgcgtccggcgatgtgttcctgttccccagcctgaccgaaaccttcggcaacgtggtactggaagccatggcctcgggactgggcgtggtggcctacgaccaggcagccgctacccagcacattcgtcacggctacaacggcgtgctggcgatgccaggggatgaagatgcgttctgcgatgccgccaactggctgctggaggatacggagagtttacgacgcatgcgcctgaatgctcgccaacatgccagccgccaaggctgggcagcgattatcgagcaattcgagcatcacttgcgtggtgtgtgcggggagcgtttcgcccttccaacacaaccttacgtacgctgagcaacctgccatttacgtgcaaaccgcgatgagcctgctgcaggccactcaagttttgcctggtatttaaaaggggaacccttgcgccgcgaaacgccaaccattgatacctgccggtcaagcaggcccttttaaataatggagatatttaacaatgccaatttatggaatgggtgtacgcaatggcgtcaatatgccaaccgcggaatggacacgccagcaacaatggctggatcaatctcgtgcagagccgccaacctatggtcagcccgggcataaagatgcgctcaaggctgatcaccacaaagagctgaataagcgtccagagtattaatcactagagccgcaaaactccctgtggtcgacacagggagtccagcccttataccaacgtcgtcaacgcctcacgactgaagggcaagatgtcgccctcgcgcccttcgcgcaccttcacggcccaatccgggtcgaccagcagcgcacggcccaccgccaccaagtcaaactcatcattgttcaggcgctgcagcaggttttccaggctggccggctgcgcgaccttgtcggtgttgaccataaactgcaggaactcgccatccaggccaacgctgcctacggtgatcgtcggcttaccggtgagctggcgcgtccaaccggccaggttgagttcggagccttcgaattcgggctcccagaaacggcgggtggagcagtggaaaatatccacgccggcgtcagacaacggcttgagaaactcacccaatgcttgcggggtctgtaccaggcgcgccgtgtagtcttgctgcttccattgggagaaacgcaggatgatcggaaaatccgggcccactgcggcgcgggtcgcctggatcagctcgatggcaaagcgcgaacggttgatcaggctgccaccgtattcgtcggtgcgctggttgctgccctcccagaagaactggtccaccaggtaaccgtgggcgccgtggatttccacaccgtccatgccgatggcctgggcgtccttggcggcttgggcgaaggcattgaccacgtccttgatgtcctgggccgtcatgccatgcacgaccaccttgccgtccttgagtttttccatcgggccgtaggccggcacactggcgtcaggttcggtgccgatgcgacgcacgctgcctacatgccacagctgtgggacgatcttgccgccttcggcatgcacggcatccaccactttcttccagccagccagcgccgcctcaccatagaagtgcgggacgttgggatagccgttggatgccgggtggccgaccaccgtgccttcggtgatgatcagccccacaccggcagcggcgcgacggcggtagtactcgatgactttggaattgggtacgccccccggggagaacgaacgggtcatcggggccatgaccacgcgggtagacagctgcaatgcaccgagctggaacggtttgaacaaggcttggacaggcatggcagcactccaccgcaaaaaaatttatgatgcggataatatgggcagtgcagcgtgccgaatagcactattgatctgggtgattaaggggataaaagtagccgaatacttgtaggagcgagctagctcgcgaagaacccaagcacacgcgttaagtcaggataaacgcgttgccgttggcgatcttcgcgagcaagctcgctcctacagtaggtgtgtttcagctcagggctttttcgatggcctgcacgattgtcgggtcgtccgcagcggtacgcggcgagaagcgcgccaatacccggccgtctttacccaacaggaacttctcgaagttccaagtgatatcccccggaaactctgcaccctcgcccgccaatagacggtacaactggtgacggtcaggaccgttcacctcgagcttgctgcccagaggaaaggtcacgccgtagttcaggctgcagaactcgcggatctcttcctcggagcccggctcctggcctgcaaactggttgcacggcaaaccaagcaccgaaaacccctggtctttgtattgctggtagaggttttccaacgccgcgtattgcggggtcaaaccacatttagacgccacattgaccaccagcacaacctggcccttaaagggcgccagcggtagctcttgtccgtccaaggctttgagtttcagatcgtggaaagcactcatgacgaactccagatatcccatgttctttgcattgcagcccttggagcttacaacccgcaagactgcaatcatagacgtcggtgacgaaacacgcttgccggttactgagcggtcggccacggcaagattggaatcgccgtcaccgcattctgcgggctgccttcgatcagacggtcgctgtagaccagatacaccagggtattgcgcttcttgtcgagaaaacgcaccacctgcatggtcttgaataccagggaggtgcgctccttgaacacttcgtcaccgtccttgagctcgcccttgaagcggatcgggccgacctggcggcaagcaatcgaggcttcggcgcggtcttcggccaggcccaggccgcccttgacgccgccggtcttggcgcgggagaggtagcaggtcacgccgtcgaccttggggtcgtcaaacgcttcgaccacgatccggtcgttggggccgacaaacttgaacactgtcgagacctgggcaatctcttcggccgaggccagcagtggcatggcgagcaacaggccaagcaatcccttcattacgcgcatcaggtattccttcgtttaaaccaggatgaggttatcgcggtgcaccagttccggttccgccatatagcccaagagtccgacaatggcgtcagacgattgtccaataatcttctgcgcttcaagggcgctgtagttggccaggccacgggcgatctcgcgcccgtccggcgccacgcacaccaccatctcgccacggcggaagctgccctgcaccagtttgacgcccaccggcagcaggctcttgttgccctgagacaacgccgacaccgcacccgcgtccagcaccagggtgccacgggtttgcaggtgcccggccagccactgcttgcgcgccgcgagcatgccgcgctccggcgacagcagcgtaccgatgcgctcaccggccttgagacggtccagcacgcgctccaggcgcccgccaacgatgatggtgtgggcaccggaacgcgcggccaggcgcgcggcgcgcagcttggtctgcatgccgccgcggcccagggcaccaccgacactgccggcgactgcatccagtgccgggtcatcggcgcgggcttcgtagatcaattgggcatcggggttgttgcgcgggtcggcgtcgaacatgccatcgcgatcggtgaggatcaccagcaggtcggcttccaccaggttggccaccagggcggccagggtgtcattgtcgccgaagcggatttcgtcggtgaccaccgtatcgttctcgttgatcaccgggatgaccttgagctccaccagagcgcgcaaggtgctgcgggcgttgaggtagcgcttgcggtcggacaggtcgtcgtgggtcagcaggatttgcgcggtatggcggccgtgctcggcaaagctggattcccaggcttgcaccaggcccatctggccgatagcggcggcagcttgcagttcgtgcatcgcgctgggtcgcgcggtccagccgaggcggctcattccggcagcaacggccccggacgaaaccagcaccaactcgacgcctgcttcatgcaaggccaccatctgctcgacccagacgcccatggctgcgcgatccagacctttgccatccgccgtcagcagcgcacttccgatcttcacgacccagcgctgcgcacctgtcactttgctccgcatcatcttcaaccttagagtgagggccgcgcgacccagcgccgcccataacgttatacccggataccaaaacgccgctcctgggagcggcgttcaagtttatcgcaacggatcagtcgcgcacgtaaatgatttccgggccatcttcatcatccacgtcttcttcgtcccagtcatcgtcgccgatgtcgtggaccgacttcacgccgctgcggcgcagggcacgctggtcgtccagggcctgcaactgggcacgggcttcgtcttcgatctgctggtcgagctcggcaagctcggccttgaataccgggtcggccgcgaggcggtctgcgcggtcttccaggtaacgcatgatgtcgcgggtcaggcgctcggtgccttctttggcaatcgccgagatcacatagaccggaccttcccactccaggcgatcaacgatttccttgacgcgttcttcgtgctcttcctcgaggatctggtcgcacttgttcagtaccagccagcgatcacgctcggccagagccgggctgaacttggtcagctcgctgacgatcacttcggcggcgtccgcagcactggtgtcatccaacggcgccatgtcgaccagatgcagcagcaaacgggtgcgggacaagtgcttgaggaagcgaatccccaggcctgcgccatcggaagcgccttcgatcaggccgggaatatcggcaactacgaagctcttccaacgatcgacgctgaccacgcccaggtttggcaccagggtagtgaacgggtagtcggcgaccttcggcttggcggccgataccgagcggataaaggtacttttgccggcgttcggcaggcccagcaggcccacgtcggcgagtactttcatttccagcttcaggtcacgctgctcgcccggcttgcccggcgtggtctggcgcggcgcacggttggtactggacttgaatcgggtgttgcccaggccgtgccagccgccctgcacaaccatcagcttctggccggccttggtcaggtcgccaatcacttcctgggtcgcggagtcgatgatcgtggtgcccaccggtacgcgcagtaccaggtcttcaccttttttaccggtgcagtcggtgctgccgccgttggagccacgctcggcatcgaagtgccgggtgtaacgatagtcgaccagggtattgaggttttcgtcggccatcatatagatggaaccgccgtcaccaccgtcgccgccgttagggccaccgttttcgatgaatttttcgcgacggaaactcatgcaaccgttaccgccgtcgcctgcttttactcggatggaaacttcatcaacgaacttcataacaaaacgcctctcgccgcatgggcgagcttaagaaaccaagacataagactcttgcaaaaatgagcgcagcgacctcaagcaacgaccgcaaatcctgctgccctcgcccattacaaacagctttgcaagagactcactccacaaacgaaaaagccccgtcgcaagacagggcttttccagcgatctcgcaattaagctgcgacaacgctcacgtaacggcggttgaacgcgccctttacttcgaacttgatcacgccttcgattttcgcgaagagggtgtgatctttacccatgcctacaccgtaaccggcgtggaattgggtgccgcgctgacgcacgatgatgttgcccggaatgattttctggccgccatacatcttcacgccaaggcgtttggcttctgagtcgcgaccgttacgggtactaccaccagcttttttgtgtgccatgagtcaattctcctagtgaggaattaggctgaaattaagcctgaataccggtgattttgatctcggtgtaccactggcggtggcccatacgcttcatgtggtgcttacgacgacggaacttgatgatgcggactttatcgtgacgaccttgggagatcacttcagccacaacggtagcgccagcaacgactggagcgccgatgttcacgtcatcgccattggcgaccaacagaacgcgatcaaaagtaacggattcgccggtagcgatttccagtttttcgatcttcaggtattcacctggggcgaccttgtattgcttgccaccagtaacaattactgcgtacgacatggtatttctccgataatcctgctcacccagcgctttataagaagaggtattggctggcatggctgcatgggatggacgtcccgaatgcaattgcgtaaggcaggtgctgcccaggaagttcagggtgcgcgattgtacgcaaggtaaatgggtgttgcaaggggccgtctatcgcgccttgacacccgggggtcagggtcctagcatgccgcgcaacccttctggagcgactgtcgctgatgcaaccccaagctttctaccgcgcggtcgcggacgattttagcgccgtcgacggcatcatcaagcagcagctgacgtctaacgtgccgctggtctccaaaattggcgactacattacgtcggcgggcggcaaacgcctgcgtcctttattagtgctgctgtgtggcaaggccctgggccgcgaaggcgatgacctgcgcctgttggccgccaccattgagttcctgcacaccgccaccctgctgcatgatgacgtggtcgacatgtccggcatgcgccgtggtcgcgagaccgccaatgccatgtggggcaacgcgccgagcgtgctggtgggcgacttcctgtattcgcgctcgttcgaaatgatggtcgagctgggctcgatgccggtgatgaagatcctttcacaggccacgcgcatcatcgccgaaggcgaagtgttgcaactgtccaaagtccgcgacgccagcaccaccgaagaaacctatatggaagtgattcgcggcaaaaccgcgatgctcttcgaagcgtccacccacagtgccgccgcgctgtgtggcgccaccgcagaacaggcagaagccctgcgcacttttggtgatcacctgggcgtggcgttccaactggtagacgacctgctcgactacaagggcgacgccgagaccctgggcaagaacgtcggtgacgacctggccgagggcaagccaaccttgccgctgatctacaccatgcgcgaaggcacgccggaacaggctgccctggtgcgcaaggcgatccagaaaggcggcatcgaagacctcgaggccatccgcgctgccgtggaagcgtccggttccctggagtacaccgcgcaactggcgcgtgactatgtggcccgtgcgatccagtgcctggaagccttgccggccagtgaataccgggatgcattggttgagctgagtgagtttgcggtcgcccgtactcactaaaatcaccagcagacgcaggacaatgtgggaggggcggtgcgacgattcgacttgctcccgatggcaatatgtcggccaatatataaggtggctgatacaccgtcatcgggagcaagccccctcccacgtttggaatccattgccaattcaagatcccgcccgagctacaaaaccctatataatgtgcgacttttagtcatccctgaacttcaaggagctttagtgagcacgttgccaccctgcccgaaatgcaattccgaatacacctacgaagatggcacccaactggtctgcccggaatgcgcccatgagtggtccgccactggcgaggccgaagtggccggcgatgaaaccgtgaagaaagactctgtgggcaacgtcctgcaggacggcgacaccatcaccgtgatcaaggacctcaaggtcaagggtacctctctggtggtcaaggtcggtaccaaggtcaagaacatccgcctgtgcgacggtgaccacgatatcgactgcaagatcgacggtatcggcccgatgaaactcaagtccgaattcgtgcgcaaggtctgatcctgctgcatccatcccgcgcccgccgcgggatggcgtttcgccctctcgattgatcgacaacaatatccacacaaaaaaaccggaaaccgccaatagatacttgctattctacgaataagaattattctcattgaaacccatcaaggagaacgaccatgacttatttgatagacgcctggctggatcgcccacacccttacctgcggatcctgcatcgggaaaccggcgaagtctgtgcggtgcttgaggaagaagcgctgaacgaactgcaggatcagggcgacctggacgtcaatggcctgagttccagtgagcctggagtactgaaggaagtggtaaggaatctgtttctgttctgctatgcccgagcgttgcgcccggcggcggatctgaatggcaagttccatccatgaacaaactggcaaatccctgttggggcgaacgcgttcgccccaacaggtaatcagcaacaggtcttacagaacgtcgagcagttcgacgtcgaataccagaacgctgtgcggcgggatgctgccaacgccttgagcgccgtaagccagttcgctcggcacgtacagacgccatttgctgccggcattcatcagttgcagggcctcggtccagccggcaatcacgccgccaaccgggaattctgcaggctggccacgctcgtaggagctgtcgaacacagtgccgtcgatcagggtgccgtggtagtgggtacgcacttgatcttcacgggtcggcttggcgccggtgccggctgtcagcacttcaaattgcagaccggaagccagggtggtgatgccatcgcgcttggcgttttcagccaggaatgccaggccggcgccagcggctgcttcagccttggcagccgcttcggcttgcatgatttcgcggatcactttgaaactggcagccatttgctcctgatcaacacggcttggcttgcccgcgaacgcgtcggtcaggccggccaggatcgcgtccaggctcacgcccggtggcgggttgtcgcgcagttggtcgcccaactgacggccgataccgtagctgacgcgggtttcgtcggtggacagattaacttcggacatgaagaggctccgctataggacaacacggtttcccgcgccgcccagaactaaaagggcccgcagactagcacacaagggcggcccatgatcagccccctcccccggccatcagagcgccaggtggtaggtcaggtacagccgaatgacacctcttcgtcgcccggcaagaaaagtatttcagaattgtccattgccgccgatacagccctacacatcttggctggctcaaacaacaacacaccgtccagcagacagacatcactcttcaaggagctttcgatgaacagctggttcggtaacatcagcgtcaatctcaaactcggcctgggctttggcctggtgctggtcctcacctcgatcctggcactcaccggctggaccagcctgggcggcctgatcgaccgtagtaactggatgagcgacatcacccagctcaacgcctcgttgaccaagctgcggatcgtgcgcttgcaatacatgctggccaacggcgacgaagccgtggcgcagaacgtgcagaccagcctcgaggccttcgccgcccagcaacagaagctgctggacagcttcaagagcccggaaaacctcaagctgctcaatgagcagaaagccgtcattaccgcttaccgccagtccctgaacaaaatgcgcgaggcctaccgtaatggcaacgctgcgcgcgacgtcatgggcgccaaggctgacatcgccaatgcgcaaatcaatgcgctggaaaccagcgtgcagcaagcgcccgatagcccggagcgcttcactcagttttcggccgtgacccaagccaagaatgagttccagcaagctcgctatgaagtgcgtggctataccaatagccccagcgcagaaaccgaagcccgcgccgctgcacaaatcgaaaaagccgtcgctggtttgaaaaccctcagcgccgcattcggtactggccagcaaaccgcattgaccgcactggaaaccgcgctcggcgactatcgcagtgccgtgcagagctacaaggccgccaacgccaatatcgtcaccgcccgcgccgaaatgaccacccaaggcgccgatatcgtgacgatcagcgataagctgtacgacatccagctggaacgtcgcgacgttgaaagcacccaggcccgtagcctgcaattgatcagcaccttgctggccctgctggtcggcgtcatcgctgcgtgggtcatcacccgccagatcacgcgcccgatccaggacaccctggccgtggtggagcgcatcgcttccggcgacctgagccacaacatccaggtgacccgtcgtgatgaactgggcgtgttgcaacaaggcatccagcgcatgggcacgaccctgcgtgaactgatcagcggcattcgcgatggcgtgactcagatcgccagcgccgccgaagaactgtcggccgtgaccgaacagaccagcgccggtgtgaacagccagaagatcgagaccgatcaggtcgccaccgccatgcatgaaatgaccgccaccgtgcaggaggtcgcgcgcaacgccgagcaggcttcccaggcggcttccgacgccgacggccaggcccgtgaaggcgacaaggtggtggccgaagccatcgcccagatcgaacgcctggccgccgaagtggcacgctccaccgacgccatgacgcacctgcagcaagagagcaacaagatcggcagcgtgatggacgtgatcaaggcagtggccgaacaaaccaacctgctggccctcaacgccgccattgaagcggcgcgtgccggtgaagccggccgtggctttgccgttgtcgccgacgaagtgcgtggcctggcccagcgcacgcagaaatccaccgaagaaatcgaaggcctggtggccggcttgcagaacggcacccagcaagtagccaacgtgatgaacaacagccgcagcctcaccgacagcagtgtcgaactgacgcgcaaggccggcgtgtcactggaaaacatcacccgtacggtgtcgaatatccagtcgatgaaccagcagattgccgcggccgccgagcagcagagcgccgtagcggaagagatcagccgcagtatcgtgaatgtgcgggatgtgtctgagcagacggcgacggccagtgacgagacggcgaagtcgagtgtggaactggcacggctgggtagccagttgcagcagatggtcagtcatttccgggtgtagacaccaaaaagccgcctcaatctagaccgaggcggctccacctctcagaccttaacggtcatcgaagctgtcccgcaggaacttccatacgtgatacgcacgcaggcagttcactacgaggttccatgtacgtcgtgcaaacttagacatactcggccctccgtgagttgggccttacctccagcgcaattaccggaacatgtgggcctttggacgcgggtcaacgcttcctgtgaggcggccgggctctggttcctcccgcatgaaatccggcacggattactagcccgtggcgttcggtccataattccgcgcgcatacccagccaccacaaaacgacatacttggaacgggggtgatactaaccaatattccgatcaaaggtgtgacggacgaagataaacgagctgtcgaaactagatcatttattgcaattttttaccgccaaaattggctctaaataagatagacgaataaaaccaccgaccctcgtcaagccttgcgcgatccagtaactcacattagtatcaacgcagtgggtcaacgcttcctgagaagccgcaaccccagccactaactgggtttgcaaaaaaaaccgccctatcaaggcggttttttattgcctgtaatttgccacttagccctcgctgtcctcgacaaacaccaagcgattcccgaacggatcccggatgctcatttcccgcgatccccaaggcgtttcctcgaccccaggcttggcatagcggtaatccttgccgagcaattgctgctggtacgcatccaccctttgcgcctggatccgcaccgccgcgcccggcgaagcatcgccatggtgctcggacaaatgcaacacgcactcacccagcgacacttgcaggtacaacgggaaattcgcctcgaaccgatgctgccaatcgaccttgaaccccaggaagtcgacgtagaattccaacgctttggtctcgtcgaaaatccgcaggatgggggtgacttttcctaagtgcatggcgaccgctccgtgtatgagaacgcccactataaagacgaaaagccgccacgcaaatccccactgcgcgccaggaatcgccctggccgctggccgttggcctgcccattgctgtagctcagtacgccgttaacccacacaccgtcgatcccttccgctgcacgttgcggtgtgttgaaatctgccacatcacgcacccgcaacgggtcgaacaacaccaggtcggcccagtacccttcgcggatttcgccacgctcggataagccaaagcgcgctgccgacagaccagtcatcttgtgcaccgccgtgtgcaacgggaacaagccgacatcgcggctgaagtgccccagcacccgcgggaacgccccccacaagcgcgggtggggaaacggatcttcgggcaagccatcggagcccaccatcgacaacggatgggcgaggatgcgccgcacatcgtcttcgtccatcccgtagtacaccgctcccgccggttgcaggcgacgggcagcgtccattagcgaaacgccccactcggcagcgatagcctgcagatcccgcccacccatttcggggtgcggcgtcgaccaggtgatggtgatgcgaaacgcatcggtcacctgcttgaggtccagggtcgaggagctggcggcatagggatagcaatcacagcccaccggatggtcttttgccgcagcttccagggacgccaacaactgcgggctacgcccccagttaccggcaccggcgcatttaagatgggaaataatcaccggcaccttggcatggcggccgatcagaaacgcctcctccatcgcctccagtaccggctcgaattcgctgcgcaagtgggtggtgtacaccgcgccgtaggccgtcaactcttcggtgagctgcaacacttcagcggtctcggcattgaacgcgctggcgtaggccaggcctgtggataagcccagggcgccagcttccaggctctcttgcagttgtatacgcatcgccgtgatttcaccgggcgtggcagtgcggtgcaggtcatccatatgattgctgcgcaacgccgtgtggccgatcaacgcggcgacgtttaccgccggatgggcaccctccacggcgttgcgatagtcgctgaaccgcggatagcagaacgcctcacggccgcccagcaagttcatcgggtctggcggggcaccgcgtaaactcaccggcgaggcactgatgccacagttgccgacaatcaccgtggtcacgccctggctgagcttgggcagcatctgcggctgtcggatcaccacggtgtcatcgtgggtgtgcacgtcgataaaacccggtgccaatacgcgaccatgggcctcgataacatgctcggcctcggctgtggacaagtcgccaatagccttgatacgcccttgatgcaatcccacatcggcgagatagcccggggtgttgctgccatcgatgatcagcgcctggcgtatcagcgtgtcgtacttcatatcagtctccaagcggcaggctgtcagggccgccgcggtaatcgtccagggccagtttgatccggcgcaggcgctcctggttttcatccggcagggccagcgccagctcggtggcgagcagatcgatggccagcagcatgccgtagcgggctgcggtgggtttatagataaaactggtttccgccggttgcagcggtagcaacacatccgccaactgcgccagaggcgaattggcgagcgtgatggcgacgatgcgggcgtcgtagctgcgtgccagctttaccacctccaataactcgggggtcagtccagtgagggagcagacgatcaatgcgtgctccggtcccagggtggccgccgtgacccgcatcatcaccgggtcatggctggcggcaatcgagtagcccagccgcaccaggcgtacctgcaattcatcactgcacaggctcgacgggccgcccatgccgaatgcatggatcatccgcgccttgcccaatagattgaccgcatcaacgaaactgggttgattgaaccccgacaggtgctgacgcagcgtcgcctcgatatcgccgaggatctgccgatgaaacgccgattgttccggcaaccccgcagggtccaaaaagcggctgcccacaccactggcctgggccagttgcaggcgcaaatcgcgcaagtcgcggcagccgacgctacgggcaaagcgtgacaaggtggcggtactgacctcggcccgctgggacaatgcttccaggctggccgaggcggcaaagcccacatcctcaagcatcagcttggcgatacgcccttcgccggcgctgaaagagtcctggcgggcgcggatctggtaaaggatgtccatgggggctccgggttacaggatgaggcttataaaaccagtgacaggccgtaggtgagaccgaaggcgaccagcgaaatcagggtctccagcacggtccaggtcttgaaggtctggatcaccgtcatattgaagtattccttgatcagccagaagccgccgtcattaacgtgggaaaagatcaccgaacccgcgccggtcgccaataccagcaattcagggtgtggataacccaagcccagggcgacgggggcgactacgccagacgccgtggtcatggccaccgtagccgagccggtggcgatacgcatcagggcggcgaacagccagcccatcaccagcggcgacaggtggaacgcatgggccaggccgagaatttcgttggtcaccccggcgtccaccaggatgcggttcaacccgccgcccgcgcccaccagcaaggtgatactggccgtcggcgcgaggcattcgttggtgaacttgagaatcgactcacggttgaagccctgggccaggcccagggtccagaagctcaccagggttgccaccagcagggcgatcaccgagttgccgataaacagcaggaactggttgaagccagtgcctggggtggaaatcacgttagcccaaccaccgatcatcatcagcaccaccggcaacaggatggtgcccatggtcaacgcgaagctgggcaggcgggtacgcggttcgcgctcgatgaactggcgctccaacgggttttccgccggcaggtgaatatgcggcacgatgaacttggcatagaccggaccggcgatgatcgccgtggggataccgatcaaaatcgcatacagcactgtctgcccaaccgaagcgttgtaggccagcaccgccatcatcgccgccgggtgcggcggcaccagcgcgtgcaccaccgacaggccggcgaccatcggcaggccgaccatcaggatcgacacccccacgcgccgcgccacggtaaaggcaatcggcaccagcagcacaaacccaacctcgaaaaacagcggcagccccaccaggaatgcaatgcacaccatcgcccagtgggcattgcgctcaccgaagcggttgatcagcgtgcgggccacctgctcggcgccaccggactcggccatcatcttgccgagcatggtgcccagcgccaccaccagggcgatatgccccagggttttacccacgcccgcctcgtacgaacccatgatggtatcggccggcatgccggccatcagcgccaggccaatggataccagggtgatgacaataaacgggttgagtcggtaacgtgcaatcagcacgatcaatgcaatgatggcaatggcagcgtatgccagtagcccgaagcccggtgatgcggccatgcggtactcctcggaaagggtcacgtcgaattggttgtgaaactcataaatcattaccgagggatattttcaatttttatgaaagtaattttcgcccacagataagcgctgtcgcttggggatatgtccagcgccagcccatgaaaattcggggtgggttcttacatgaagatcagaggatgtcggaaactcaagcgccgccctcgagtcatagaatgcgcctccactctgttcaggaaaccgctcatgattcgcaccacaatcgccgccagcaccctgcttctgtccctgtgcggcagcgcttttgccgcagacaatgccgcattgaagaaatgcatggacagcgccaacaccacggcggacatggtcaactgcaacgccaagcaaaccaaggtgcaggacgaacgcctgaaccgtgcctacaagaccgctattgccgcccaggacggcgcgcgcaagcagcaactgcaagatgtgcagcgcctgtggatcaagtaccgcgatgccaattgcgccttcgccggcagtgctaccggcggcactatcgatcaggtcaacggctccggctgcgtgctggacatgacccagacccgtgcccaggaactcgaagacctggtcgggccttaatatcagtcgtggtgaaccttcgcacgcttgagcagtttcttgcagcgctcggataaatgcagcacccgcaggtgcttgccggccttggagtagcgttcacgcagggtcatcagcgcggcaatcgccgaatagtcgacaaagctcaggtgacggcaatccagcgtcacctgggccgggtcgttggccgggtcgaattgattcaggaacggcgtggtcgaggcaaagaacaaggtgccatgcaggcggtaaagcttgctgccgtcagcttccagatgttcatccgcgtacagctcccgcgcctgctgccaggcgaagttcagcgccgcgatgacgataccgcacaacaccgcggtggccaggtcggtgaacaccgtgatgatcgtcaccgccatgatcaccaatacatcattgagcggcaccttgttgatcacccgcagcgacgcccaggcgaaggtctgctgcgacaccacgaacatcacgcccaccagcgccgccaggggaattcgctcgatcaaaggtgacagaaacagaatgaacaacaggatcatcaccccggcaaacaccccggagaaacgcccgcgcccgccggagctgaggttgataacggtttgcccgatcatcgcgcaaccacccatgccaccgaacaggcccgagaccatgttcgctgcgcccagggccacgctttcgcggtcggggtagccacgggtctcggtgatttcatcggtgaggttgagggtcagcagggtttccaacaggccaaccatcgccatcaggaacgcgtagggcgcgatgatgccgagggtttccagggtccatgggatctgcggcagggcgaaggttggcaagccgccggcgatatgcgccatatcgcccaaggtgcgggtcggcaggccaagcaggtagaccgccaggccaacccccaggatcgccaccagcgcggggggcacggcacgggtcaggcgtggcaacaggtagacaatcgccatggtcaccaccaccagggcggtcatcacatacaacggcgtgccactgagccagtgttcgccgctcttgaaatgctccagttgcgccagcgcaatgatgatcgccaggccgttgacgaaaccgagcatcaccgagtgcggcaccatgcgcaccagcttgcccaggcgcagcaggccgaatgcgaccatgatcagcccgcccagcagcaccgtcgccagcagatactccaccccgtgttgcaccaccagcgcgacgatcaccaccgccatcgaaccggccgcgcccgagaccatacccgggcgaccgccgaacagcgcagtcagggtgcagatgataaaggcgccgtagagccccatcagcgggttgaggtgggctaccagggcaaaggcgatgcattctggcagcagcgcgaaagacgtagtgaggccggccagggcatcggcgcgcagacgggtgaggttcatggagtaccagggagttgcggggataaggcggggaatggtacggaattgcggcgggtggggctagcctcgaagaccgagtcgcctcaatcgggagcaagccccctcccacacttgaatgcattccaaagttggaattcggtcaaatgtgggagggggcttgctcccgatagcagcacctgggtctcaagcgcacatcacaccatttcgtcgcgaatccactccaccaccgacgtacgcttcggcacccagcccaacaactcacgggcatgcttgccacgcacccggctgttggaacccagcccgtagttcgccatttcatagccccattcggcctcagcctcggccaatggccaatcctgcggctcgcccaggttcagcgcttgggcaatggccgtggtcatgtcgataaacgctgcttcgccgctttccacaaagtagaacgtacccggcacgtttttggtcagcgccagcaggtacagggccaccacgtcttcgatatgtacgttggaccagatgttctgccccgggcccacatggcgcaccacaccacttttgcgcgcctgcttgagcaagcgcggcaattgcacgctgtcacgcttcacgcccaggctgttgccgtaaatcagggtgttgcagatcaccgccgaattgacgccgtcgctggcggccgcgaggatcaggttgtcgatcgccacgcgcgcggccttgtcgacggtcggctccggcaggttgtcttcgaagtagatgacatcgctggccttaccgcccgacgcatcgccgacaatgctcgagccgctggtgtgcagcaacggcttgttcgagcctttcaaggcgaccagcagggtttccacggcggcgcgatggtcgctgctggcggcattgatcactgcatcggccttgtgcgcctgctcggtcaacacggcggcgtcgtcaagggttccgatcaccggggtgatgcccagggcagtcatctcggcggcttgctcggcgctacgcaccaggccggtgacgtggtggccggccttggccaggccggtggcgatggaaccgccgataaaccctgcggcgccggtaacgaatacgttcatggaggttgctcctgactgggtaaatgatggagccagtatcaagcacccctcccagccgaataagcccgtatcgcccaattcactcttgcgtgcagatcacgaatcagcgggcataccgcgccagtttggcctgaataaaatccaggaaacactggatgcgcagcgccaattgcgagttgcggtagaacaccgcatggatcggctggcgataaccgctgttgaacgcctccaacatcggcaccaggcgcccggtgtcgatgtcgtcgatagtcatgaagttcgacaggcaacaaatgccctgcccctccaacgctaattgccgcacagtttcgccactggaggcgctgacgccgggctggatcagccagcgatcaccgtccacatggcgcagcggccagtgattgagggtttcagtgtgggtgaagccaagcagcgtgtgatcggccagttcggctaccgtcgccggcgtcccgtactgcttgaggtagtcggggctggcaaggatatgcagcggggtcgaacccaggaaacgcgcatgcagggtcgaatcggccagggcgccgatgcgaatggcgatgtcggtgctttgctccagcaggtcgatgatcaggtcgtcgctgttgagctccagctggatttccgggtagaggctacgaaattcggcgatgtacggcacgatcccatgcagcataaacggcacggcagcgttgatacgcaggcggccggccggttttttctggcgcgacgacaggcgctcttccagctcatccatctgtgccaggatcaccttggcctgctcgaagaagtacttgccctcttccgtcaggtccatgcgccgggtggtgcggttgatcaaggtggtgtcgagcttggcctccaggcgcgacaaggtgcggctgaccgccgaaggggtctgtccgacctgctccgccgcggcggaaatcgaaccgcactcaatcacgctgacgaaaatctgtagctcatcggaccgggctttcacaggcgctcctcgtaatcggttcagcgcagcttacaccgagcggttggcgactcagccactgatcaacaggtggccccccaacagcgccatgccgataaagaaaacgcgcttgaataacactgcgctgatgcgctggcgcagcgcctggcccagccacatgcccagcagcgccggcagcagtgccaacattgaagcactgatctcaccgccgcccaaggtgccccgccacgccaggcctgcggcgagcgccagggtcgatacgctgaacgacaggcccagtgcctgcaccaactgatcgcgattcaaacccaaggcttgcaggtagggcacagcgggaatcacgaacacgccggtcgacgaggtgataaggccagtgacggcgccgcacagcggccccagccaacgttcggtggccgggtctacccgcaatgccggcaggaacagcccactcaacgcatacaccagcaacgccgcacccaacccacgcaccacccaaggcccgccacccatgcccagccacacactgccaagcccggtgccgaggaaaatcaacaacagcatcggccacaagcgtttgaccaaggcgctcaaatggccgccaaacgccagttgccagaggttggtcactgtcgaaggaatgatcagcaacgccgcagcctgcgccggcaacatagccaggccgagcatgcccatggccacggtgggcaggcccaggccaatgatgcccttgaccgtgccggccagcaggaaggtgccgatcaccagcagcgtcaaggcagtaccaaggttttgatagaacgagaggaaggtattcataagcatcattgtgggagctttcgccgggttcgaaaattcgccatatactgaccctgactcttgatttgcctgaggctgatgccatgcactttgatctgatcgacctgcgcctctacctgcacatcctcgataccggcaatatcaccgccggcgcggctcgcagtcatttgtccctggctgccgccagcgcacgcatccgggcgatggagtcttcactgggcatcgcgtttctcgaccgtggccgccgtggcgtcaccccaacccctgcgggcaaggccttggcccggcacgctcgcctgctgctgcaacaggccgaacacctgcgacaggacctggccgaatacgccaatggcgtcaaaggccaggtccgcctgctgtgcaacaccaccgccctcagcgaatacctgcctgaactgctcgccggctttctgcgtgaacaccccaacctcgatatcgacctgcaagaactgcccagcctgcgcatcacccaagccttgcgccagggcacggtcgacctggggattatttctgatgcggtggacacccacggcttgcaaaccttgccgtttcgcgatgatccgttggtgctcatcgtgccccttgaccatccgctgaccacagccagcttcatcgacagcttgcagtacgactacgtaggcttggcggccaacagtgcgctggcggtgtatctggaggagcaggcattgcacgcaggctttcgcctgcaaacccgcatccgtgccgacggttttgatggtttgattcgcatggtcgccggcggcgccggcctgggcatcgtgcctcaggccgccttggatcgctggccgtcggagcgccgtttcaaggtccagcctctgcgcgaaacctgggcctgccgcaagctgctgttatgcgcacgcgacttcgaacaactgccgggttacgccagagctttgttcgatgccttggccctgcccttgcggaaaaacccgtaatacaccgccgacagtatcagcaggaacggcacgccaaacaccagggtcatcttgaacgcctcggtgaaataagtggtgatcatcaccgctcccatcagcaccagccccagcaacgtagtgtagggaaacaggcgcagctggaaggacaacttcgccccgccatggcgcttacggtagcggcggaagaacaggtgtgtgaggaagatcatgaaccaggtgaagatcgcgccgaacatcgagatcgccatcatcagggtgaacgagctttccgggtacaccacgttaagcaaggtcgccagggcgatgcccgagctggacagcaacagggcattgagcgggatgccgttcttgctcaaggcgcccatggccttgggcgcaaagcctgcacgagacaggctgaacatcatgcgcgtggtgatgtagagctggctgttcatcgccgacagcgccgcgatcaggattacgaagttcatcaccccggtggcaccaggaatgccgatggtctgcatcaccgtaacgaatgggctctgggtctggcccgcctggttccacggcacgatggcgagcatcagcgccagggtcagcaggtagaacaccaccaggcgcacaatggtggcgcgaaaggctttcttcaccgcctgttccggatcggcggcttcaccggcggccacggcgatcatctcgacgctgaggtagctgaagatcgacacgatcaccgcgatccacatgccgctcaagccatgggggaaaaacccgtcgtgggccgtgtagttctgcacgccgtagtccgggttgccggagccgaacaccacatacaccgcaaggatgatgaaaccgacgatggcactgatcttgatcgtcgagaaccagtattcgaagttaccaaaggtctttacgctgatggcattgagcaggatcagcacgctggaaaacgacacgatccacacccactccggcacattggcaaaccagtacttcatgtacatcgccaccgccgtgacctcggcgcctacggccagcacaatcgccgcccagtaggcataacgcaccaggaagccggccagtgggctgatgtagaactcggcataggcgccaaaggagccggaggtggaatgggccaccgtcatctccgccaggcagcccatcagcaacaaggtgatcagcgcgccgatggcgtagctcaccagcacgctcggcccggcatagccgatggcataggcgctgcccatgaacagcccggtgccaatggcgccaccgatggcgatcatgctcatctggccggaagtgagctggcgccgcaggcccagttcgcggtgggtgatctcggcaaagccgttgtctggcgtggtcactggtgtgcccctttattattgtgattacacagcaagcgctggttttctgtaggagcgagcttgctcgcgaaaaacctgagaacgccgcgtgcattcagaattcgcgcgttatcgttgacgatcttcgcgagcaagctcgctcctacaatgggttacgctgttgtcaggtaacgctgtttcggactttgaattgcggctgatcccaggtgcggttgtcgaggatttcaccgaggatttccacggcgtcccacacctcggtaaagcgggtgtacagcggcgtgaaaccaaagcgcatgatccgtggttcgcggtagtcgccgatcacaccgcgggcgatcagggcctggatcactgcataaccttcggggtgttcgaagctgacgtggctaccacgccgggcgtgttcacgcggggtgatcagcgtcacgccatgggcggcgcagcgactttcgaccaacgtgataaacaggtcggtcaatgccagggatttagtgcgcaggctggccatatcggtctgggcaaaaatctccaggccgcactccaccatggctaacgaggtgatcggctgggtgccgcacagatagcgcgcaatgccggtgctgggtgcgtaggtggattccatggcgaactggcgggtgtgcccgaaccagcccgacaacggctggcgcaccacgtccaccaacaccgggttgacccacacgaacgcctgggagcccgggccgccgttgaggtatttgtaggtgcagccgatcgcataatcagcgccggcccgatgcaggtcgaccggcaccgcgcccgccgaatgcgccaggtcccagatgctcagcgcgccgcactcgtggctcaaggctgtaagcgcctgcatgtcgtacatgtagccggttttgtagttgacgtgggtaagcatcaccaccgccacgtcctgatcgattgcctgcggcagctcgtcggggctgttgaccaaccgcagggaatacccctgttgcagcaattgcgccaagccctgcgcgatatacagatcggtgggaaagttgctcgcctcactgacgatcaccttgcgcccaggcgcacgttggcgctgcacactcaacgccgcactgagcaccttgaacaggttgatcgaggtggtatcggtgatcaccacttcaccgtcccgcgcaccgatcaatggcgccaggcgattacccaggcgcagggacaaatccgcccagccggcgctgttccagctgcggatcaaaccattgccccactcctcggcaatcacctgttgcgcccgcgccaatgccgccactgggcgtgcgccgagggagttgccgtcgaggtagatcaccccctcgggcaaggcgaactgggcgcgcagtggcgccaatgggtcctgggcgtcgagggcttggcaatggcttcgagtggtcatgggctgtcctggtttttataagtgaggatgcagcaaataatgaacgaagctttagagaattttcgtgcaaagtggtgggtaacaggctaattaagctgtaggaaattcgaatttaacctctaaatacgcggatttattcaaagcatgattctcgacgccaccgacctgcgcctcctgcatttcctgcaacaggatggccgtatcagcaaccaggaactggcggaaaaagtcgcactttcgccctctgcctgcctgcgccgtctgcgcctgttggaaagcgagggcatcatcagcggttaccgtgcggtattgaatgccgagcagttggggatcgagctggaagccatcgtgcacctgtcgttgcgccaggatgtagaggactggcatgagacctttatcaagaaggtgcaaggctggccggaggtggcaagcgcctatgtgatcaccggcgccagcaactatgtgctgcgggtgcaggcgcgcaatctcaagcatttttcggactttatcgtgaaccacctgaaccgcacggcgggggtgatggatatcaggtcggagattgtgctgcagaagatcaaggaccgggatgaggtgttggatctggtcgtgcgcaaatagcaccaacaccacaaatcaaatgtgggagggggcttgctcccgatggcggtaggtcagtgagtaaataggtgactgacactctgctatcgggagcaagtcgaatcgtcgcaccgcccctcccacatttttgaccgcgttgatcagtcttccagggcgcgtacgcgttgcatgcgtttttgctcaaccggtgcatcagccacctgcaactcaaaatcaaaatcaatctgcgcaaaccgcccttgcacaccaaactcccgtgccagctgcggatcgtcactgaagcgaatctcggcaatcagttcatcgcgcgtggcataggcaaagtcatcatgcaggtaaggatcatccgacaggttgatctgggtggtcaggtgccggtgcccgggcgccgagatgaagaagtggatatgcgcagggcgttgtccatggcgccccagttggtcgagcaactgttgcgtcggcccggtgggcgggcagccgtagccggagggcacgatgctgcgaaaacggtagttgccctgggcgtcggtttcgatgcgtcggcgcaggttgaatgccgactgagtcggatcgaaccatgaataggtaccgcccgtattggcctgccatacatcgacaatcgcccccgccagtggcttgccatgggtatcgcgcacttgcccacgcatgaacaacggcaccgcgtcatcctggccatcatccaaccgcgcttcgtacttcgacaacggcgcgccggctacgtacaacgggccttcgatggtgcgcggtgtgccgccggacttgccggcctgttcatcggcggcgtccatcagcaggtcgaggtaatgctccaggcccaggcctgcggcgagcaggccagcttcctggtttttgcccagttcattgaggtagttgaccgccttccagaattcttccggggtcacttccaggtcttcgatgatgttcacggtgtcgcgcaggatccggtacatcagcgccttgacacgcgggttgccggcgtcattgaggttaccgctggcttcttcgagaaaccgttgggcgtgagcagtctgggacaggcggatggtcatggtgcattcctcatcttgtcattattagctttttaaaaggcgcttagcggtcgtctgcatggatcgacgacgggtgccggcacagcgcattcacttcgatggccatgtagggaaacagcggcagttgcatcagcaggtcgtgcaggtcctgcacgctgtcgacatcgaacacgctgtagttggcgtagtgcccggcgatgcgccacaggtggcgccatttgccctcttgctgcaggcgctgggccagggctttctcttcggccttgaggctgtcggcgcgctcggggtgcatgtcgaggggcaggtttacggtcatttttacgtgaaacaacatggcagcgcctcttagtgtttgtcacgacggaagaacgccaggcgctcttcatcgagcgccaggcccaggcccggcgcagtggaaatatgcagctggaaatcgcggtacagcggctgctcggtgagaatgtcttcggtcagcaacagcgggccgaacagctcggtgtcccacgccagtttgctcagggtgaggaatgcatgggccgaggccagggtgccgatgccaccttcgagcatggtgccgccgtacaggccaataccggccgcttcggcaatcgccgccgtgcgcaacacggcgcgaggcccgccgttcttggcgatcttgagggcgaacaccgaggccgcgccttcgcgggccaggttgaaggcatcctcgacacactcaatggactcatcggccatgatcggcaccgggctcgacaggttgagccgggccataccgccgcggttattgcgcgagatcggttgctcgatcaagtctatgccgttgtcgccaagcacttggcacgcccgcagggccacggcttcatcccatgcctgattgacgtcgacacgcacactggcacgctcgcccaaggccttcttgatcgcgatcacgtgggtcaggtcacggctgatttcaccggcgccgatcttcaacttgaaaatgcggtgacggcgcaggtcgagcatcttctcggcctcgccgatgtcttgttcggtgttgccgctggccagggtccaggccaccggcagcgcatcgcgtacacgcccgccgagcagttcgctgaccggcaggccccggcgtttgccgagggcgtcgagcaaggcgctttcgatgccggacttggcgaaggtgttgccgcgaatactgcgttccaggcgcaacatggcggcgttgatattgttcgcatcctggccgatcaacagcggtgcgaagtggcggtcgatgttgactttgatgctgtcggggctctcgttgccgtagctcaggccgccgatggtggtggcttcgccgatgccttcgataccgtcggcgcaacgcaggcggatgaccaccaaggtttggttttgcatggtgtgcatcgccagcttgtgcgggcgaatggtggggaggtcgacgatgatggtttcgatcgactcgatggcgcaggtcagcatggcaatacccattgggttctttataggttttggccgattctgtgccgtatttttgcggggttccaatatagaatgggtctcaagcaataccttcaaggtatgaaaggagccgatatggaactgcgtcacctgcgctatttccaggtgctgggcgagaccctcaacttcacccgcgccgcagaacgcctgcacatcgcccagccgcccttgagccggcagatccaacagttggaggatgaactgggggtcattctgctggagcgtagccgccccttgcgcctgaccgaggccgggcgatttttttatgagcatgccaatgtgttgctcgaacaattgggcaaggtctgcgacaacacccggcgcatcggcctgggcgaaaagacctggctgggcatcggctttgcgccctcgaccttgtacggcgtgctgccggaattgattcggcgcctgcgcaaccatgaggccctggagctggagctgggcttgtcggaaatgaccaccctgcagcaggtcgacgcgctcaaggccgggcgcatcgatgtgggcttcggacggattcgcatcgacgacccggccattgtccagcgggtattggtggaggatcgcctggtagccgtgctgcccagtggtcaccccttgctggacgcccccgccaccctcgcccagttggccgccgaaccctttgtgctctaccccggcaacccgcgccccagttatgccgaccatgtgatcgcgctgtttgacgcccatggcttgagcctgaaggttgcacagtggaccaacgagttgcagaccgctatcggcctggtgggtgccgggatgggtgtgacattggtgccagcgtcggtgcaggtgctgcatcgggcggatattggctatacaccggtggtggagactactgcgacctcgccgatcattctcagtcgacgggtgaatgatcagtcgccggggctgagtcattgcctgcaactggtggaagagttgatctgatattccatatgcaccacaaacccagtgtgggagggggcaagccccggtacaaaccggggacatcgttttcaaaggctgcgcaagcgcttgcgttgcagggtttggctgggagactcatcaaacagcttgcggtactccgccgaaaaccgccccaaatgagtaaacccccaacccaacgcaatttccgagatggtacgcaccgaaccttgctcaagaatctcctgacgtacagcccccagccgatgcttcttcagataagccatgggcgagagcgcaaagtacttgcgaaacgcatcgaacagcttgaaccgcgacaccccggccgccgcctccagatcttccaggtgcaccgcttcgcgggcgttgtcgtggatgtactgacgcgcacggatcaggtaatgcggcaattttacgcccagcacatcacgcagttcttcggagtaattattcggctgggccaggatcaggcccttgatcagtgagctttccaggtcgcgagtaaacgccgcctgttcgtaaagctcgctgctgcattccagctccgcgatgaagtaacgcgccatgcgccaccacgcagccggggcaccttccaccgcgtccatcactgattcaaagcgcagcggcgcgtcgatgggccgttgcaacaaaccttccagcgattcactcatggctgcgcgggtaatcaccacctgcaacttgcggcagtcaccggaaatcgccagcacctggtgttcattgggtgaaatgatcacgccctggtcgcggttggaactgaggcgttcaccgttcttgctcagttcctgctcgcccaccaatggcaggctcaggctgtagctgctgaagtgctcggcgtcttcgatgtcgatggtcacgtcggtgccgtattcgatcacgcccagggtggtggcgcgggacttgaacacgttggcactgtggtgaaaacgcaggcgttcgggcgtcgccgttgcgaggcgatgggggccgcaaataccggacatccagctgcgggcgccctccaggtcgaagcgttggatatgaatatcgcgtgtctggctactcatcgggctgcacccacggcggttaggcgtttgcgcgctctggcggcgcgtcgttgaacatcgacagcaagttccaagccacgccagcaccatcaccaccgggtggatagcaaaggtcgactatgtggataaagcccaggctttcgtgaccttcacctgcaatcacagtagcgcatgctgtcacttgcgcgcaccgtcgtgggtacttgctgcccaactttgcggcccagcttcccccattaagcggatagcccgccaccatctcacaggctcttaatggctaaccgtttagccatgatcaaaaggtgcctcccatgagtggtgcaagaagcgtcgagcagtggaagagctttatcgaaagctgcctggattttcgcccgaccgatgcggtgtttcgcatcgcccgcgacatgttcaccgagcccgagttgttcgagctggagatggaactgatcttcgaaaagaactggatctatgcctgccacgaaagcgagctggcgaacaatcacgacttcgtgacgatgcgcgccgggcgccagccaatgatcatcacccgcgacggcgaaggtcggctcaacgcgttgatcaatgcctgtcaacatcgcggcaccaccctcacccgggtgggcaagggcaaccagtccacctttacctgcccgttccacgcctggtgctacaagagcgacggccggttggtgaaggtcaaggcacctggggaatatccagaggggtttgataaagccaccagaggcctgaaaaaagcccgcatcgacagctacaagggctttgtgtttatcagcctcgacgtgcagggcacggatagcctggaagacttcctcggcgacgccaaagtgtttttcgacatgatggtggcgcaatccgccacggggaagctggaggtgctgccgggcaagtccgcctacacctatgacggcaactggaaactgcaaaacgaaaacggcctggacggttatcacgtcagcaccgtgcactacaactacgtggccacggtgcagcatcgccagcaggtcaataccgagaacggcacaggctccagcacgaccttggactacagcaagctcggcgccggcgacgccaataccgacgacggctggttcgccttcaacaatggccacagcgtgttgttcagcgacatgcccaaccccagcgtgcgctccggctacgccaccatcatgccgcgcctggtgcaagagcacggccagcaaaaggccgagtggatgatgcaccgcctgcgcaacctgaacatctaccccagcctgttcttcctcgaccagatcagctcacagctgcgcatcatccgcccggtggcctggaacaagaccgagatcatcagccagtgcctgggtgtgaaggatgagtccgatgcggatcgcgaaaaccgcattcgccaattcgaagatttcttcaacgtctcgggcatgggcacgccggacgacttggtggaatttcgcgaagcccagcgcggtttccagggccgcctggagcgctggagcgatatctcacggggcagccaccgctgggaaaccggacctacgcccaacagcgaagccattggcatccaaccagccatgaccggcaccgagttcacccacgaaggtttgtacgtcaaccagcaccgtaactggcaacagttcctgctcaagggcctggaccggcaagcgctgacactgcgggaggtgaagtgatgaatgcgcaattgcagtaccagatcgagcagtttttctaccgcaaatccgaactgtgcgacgcccaggactgggatgcctatgtgcagctgttcgacccacagagtgaattccacctgccgcagtgggactcggaacacgtttacaccctggaccccaagcgcgagatgtcgttgatctattacgccaaccgttcgggcctggaagaccgcgtgttccgcctgcgcaccggcaaggccgcctcggccacaccgatgccgcgcaccttgcacctgatcaacaacgtgcgcattgccgaacaaagtgacggcaccttggaggtgcgcttgaactggcacacgctgttttatcggctggctacgtccgagcagttctacgggcacgcaacctatcgcctcaagcccgagggcgacagctggctgatcacgcgcaagcacgccctgctgctcaacgacaccatcaactcggtgctggatttctatcacctgtaacgttggcgcattcccctgtaggagcgagcttgctcgcgaaaaactcaaatacaccgcgtgcatccaagttgcccggcgtcatcgttaaagttcttcgcgagcaagctcgctcctacaagggtttatacctttccacggagtcatgtgaatgaatcacaaagtggccttcagttttgccgatggcaaaaccctgttttttccggtgggcgccaatgaaattctcttggatgcggccctgcgtaacggtatcaagatcccattggattgccgcgaaggcgtgtgcggcacctgccagggccgctgcgaatccggaaactacacacaagactatgtagacgacgaagccctctccagcctcgagctgcaacaacgcaagatgctcagttgccagactcgggtgcagtccgacgccaccttctacttcgacttcgattcaagcctgtgcaatgcgtccgggccagtgcaggtacgcggtacggtgagcgacgtgcagcaggtctccaccagtacggcgatcctgcaggtacaactgcagcagccactggatttcctgcccggccaatacgctcgcctcgcggtgcccggcaccgaaagttggcgctcctactccttcgccaatcggccgggcaaccaactgcagttcctggtgcgcctgctgccggatggggtgatgagcaactatttacgcgagcgctgccaggtgggcgaccagatgctgctggaggcgccattgggggcgttctacctgcgccatgtcacccagccgctcgtgctggtggcgggcggcacaggcttgtcggcgttgctgggcatgctcgatgagctggcggccaacggctgcgcgcaaccggtgcacctgtactacggcgtgcgcggggccgaggatttatgcgaagcggcgcgtatccaggactacgcggggaaaatcccgggctttcgctacaccgaagtactcagcgaaccctccaatgactggcccggcaagcgcggttaccttaccgagcatttcgacctggccgaattgcgggatagatcggcagatatgtacctgtgcggccccccgccaatggtcgaatccatccaacaatggctggcggatcaggcacttgatgacgttcagctgtattacgaaaagttcacccagagtaatatctgaccctcagcacttctgaggggccgatgcggcgtgcactcacccttgagaaaaacaagtagaagggaatgttaatggcggatgacatggttaacccggtgggcctcaagcgtggcctgaagaaccggcacattcagctgatcgccttgggaggggcgattggtacaggcttgttcctcggctcggccggggtactcaagtcggcggggccgtcgatgatcctgggctatgcgattgcaggctttatcgcgttcctgatcatgcgccagctcggcgagatgatcgtcgaagagccggtagccggttccttcagccacttcgcgcacaagtactggggcggctacgcgggctttttggcgggctggaactactgggtgctgtatgtgctggtgggcatggccgaactgacggccgtgggcaagtacatccagttctggtggccggagattccgacctgggtcagcgccctggtgttctttgtcgcggtgaacctgatcaacaccctgaacgtgaagttcttcggcgaagccgagttctggttcgcgatcatcaaggtggtggcgattgtcggcatgatcgtgctcggctgctacctgttgttcagcggcactggcggcccgcaagcctcggtcagcaacctgtggagccacggcggtttcttccccaatggcggcatggggctgctgatgtccatggccttcatcatgttctcgttcggtggtctggagctggtcggcatcaccgccgccgaggccagcgagccacgcaaggtgattcccaaggcgatcaaccaggtggtgtaccgcatcctgattttctacgtcggcgcgctgaccgtgctgttgtcgctgtacccgtgggatcagttgctgcaaacccttggcgcgtcaggcgatgcctacagcggcagcccgtttgtgcagatcttctcgctgatcggcaacgacaccgccgcccacatcctcaacttcgtggtgctgaccgcggcgttgtcggtgtacaacagcggcgtgtactgcaacagccgcatgctgtttggcctggccgagcaaggtgacgcgcccaaggcgctgatgaagctcaacaagcaaggcgtgccgctgcgggcgttggcgatttcggccttggtgacgatgctgtgtgtggtggtcaactatgtcgcgccgcagagtgccctggagttgctgtttgcgctggtggttgcttcgctgatgatcaactgggcgctgatcagcatcacccatatcaagttccgcaaggccatgggcgagcaaggcgtgacgccgtcgttcaagaccttctggttcccgttcagcaattacctgtgcctggcgttcatgctgatgatcatcagcgtgatgctggcaatcccggggattcgcgagtcggtgtatgcgatgccggtgtgggtggggattatctatgtggcctatcggctgcggatgaaaaacgcgacggttgcagtaacgcaataaaccatgtgggagggggcttgctcccgatggcagtgtgtcagccagcacatccagtggctgacacactgccatcgggagcaagccccctcccacatttttaactgcattccaaatgaaaagccccggtgatccggggctttttgtttagagggtggagcgtactcgccagagttcgggaaacaataccgtgtcgagcatcttgcgcaggtaacccacgccttcggtgccaccggtgcccggctggaagccgatgatccgctccaccgtggtcacatgccggaagcgccattggcggaacgaatcctccaggtcgatgaacttctcggccaactgatacaaatcccaataccggctcgggtcgcgatacacctcacgccacgccgcctccaccgactcatcatgcactgtggccgccgtcgggtcgcgctcggcgcgctgggggtcaatcgccagccccgccttgatcatcaggttgatcgcctcgtcatatagcgacggcgtggcaatcgccacctgaagttcctgcaacaattgcggccgatgggcatggggccgcagcaatgccgggctcttgttgccgaggatgaattcgatctcgcggtactggaacgactggaaccccgacgactgccccaggaacgggcgaattgccttgtactccgacggcgtcatggtcgccagcaccgcccaggcgtgcaccagttggtcgaagatccgcgagactcgcgccagcatcttgaacgccggcggcaactcacccaggcgcacgtgttcgcgggcggccttgagttcgtggagcatcagtttcatccacagctccgaagtctggtgctggatgatgaagagcatctcgttgtggtcaggcgacagcgggtgctgggcgctgaggactttgcccaggtccaggtagtcgccatagctcatggactcggaaaaattcagttcggcgttatgccattcttccggtggctggtaatcggcagagaagggacattggctcatcgcgtgggctccttgagcgggcgcaggattgcgcggaccgggctggcatcgaggttggcaaaacgcagcggcagtgcgatcagttcatagtcgccctccggtacctcatcgagcacgatgccttcgaggatcgccatgccgtggcgggccacagcgttgtgggagtccatggtcttggactgttgcgggtccagggacggcgtgtcgataccgatcaggcgcacacccaggctggcgagcagttcaatggtttgtggggcgatggcggtgaaattcgcatcccattcggtgagcggcgcttgtggataagtgcgcagcagcacgcgctccggcacgttatccacacggccttgcaactggtgtggctgcactagcgcgccgctgcccaggcaatgcagcacccggcacgggcccatgtacacgtccaacgacacttcgccaatcggcgcaccgtcggcactgtaatgcagcggagcatccacatgggcgccagtatgcggcgacaaggtcacgcgccccacattcaccgggcactccgggccgaactgccacacgcgctcttcctggaacggcgtatcgcccggccaggttggggtcgccgtgctcaagggcgggctgatatcccaccacgtttttattgggttcattgcaaggctctcacggggtactggggtgaatgatacgagggccagctctgaattttcttgcgaattctggcgtcataggcgaattctttcgcagttactgcgataaaaagacaaattaccgaacaattcacacagatccaatgtgggagggggcttgccaccgattgcagtgtgtcagtagccatagcagtgactgacacactgctatcgggagcaagccccctcccacattaactgcgcttctgggcataccgatgtcgagtccagaccaccagccccagccgcgacgctatagggttcgactcttctacccttgcctcggaggcatcatgaccaagcccatcaccgtactgcgcgacacccacccactgccggtcctggatgcctgcaaatgggaaaagctcgaaggcgacccgcacaccgtcaacctcaacgcctacaccagcgaagacggcagcaagataatgggcacctggatctgcacgccgggcaagtggtatgtcgaatacgtgaagtgggaatactgccatttccaggaaggctactgcgtgatcacacctgaaggcatggagccgattcatttgcgcgctggggatatctttgtggtggagccggggatgaagggcacgtgggaagtggtcgagacagtgcgtaagtattttgtgtttgcctgacccgcaaaacccgggagccagctgtttgctggcccccggaaaccgccctatttaggcttgcgatagctgttgatgatcgccgagaagtccttgcccccttccccacgctggctcatcgattgatagagctgctgggccactgcccccaggatcaccggctgatgcgcctggcgcgcagcctcagtggccaggcccagatccttgagcatcaaatcggcaccaaaaccaccggtgtaaccacgcgatgaaggcgcggtctcgatcacgccgggccaggggttataggtatcggaactccagcagcgcccggtggagctattgatgatgccggccagcacttgagtgtcaataccgagtgcatctcccagggccatggcttcgctgacgccgaccatgctgatacccagcagcaggttgttgcagatcttggcgatttgcccggtgccgacatcaccgcagtgcacgatattgcggcccatctgcgccaataccggctgaagggtggcgaacagttccgggttggcgcccaccatgaaggtcagcgtcccggcttgcgcgccgccggtgccaccggagaccggcgcatcggccacggccacaccctgttttgccgccactgccgctacatcacggatggtctgcgggtcgatggtgctgcaatccaccgctggcacgcctttgccgatgcctgccagcactccgtcttcattgagccagacgctgcgtacgtgggcggcggccggcagcatggtaatcaccagttccgcgccttgggccgcgtcacggggcgagctgctgatggtgccgcccaattcggcgagttccttgagtaccgcctggttcaggtcgaaaaggttaagcgcgtgcccagccttgatcaagttacgggccatgggcgcacccatgttgcccaggccgataaatgcaatcttcatggtcgtctcccaagttcagcgcaggttgatggtggtgttaacaccatcgttgacggtgtcgtcatcgaaccagcggctggtgacggttttggtctgggtgtagaactgcaccacttgcttgccatacgggccgaggtcgccaagcttggagccccgggagccggtgaagctgaaaaacggtactggcaccgggatcgggatattgataccgacctggcccacatcaatttcgctctggaacttgcgcgccgccgcaccgctctgggtgaacaggccagtgccgttgccgaacgggttggcgttgaccagggcgatggcttggtcgagggtgtcgacttccagcaccaccagcaccgggccgaagatttcctcggtgtagatgcgcatgtcgggggtgacgcccgagaacagggtcggaccgacaaagttaccttgttcgaagcccggcacttgatatcacggccatccagttccagcttggcgccttccttcacgccgctttcgatcagctccaggatgcgtgccttggcgcgcttggagatcaccgggccgacatccgtaccggcttcgctgccggcgttgaccttgagcttctgcgccagggccttgaggtccggcagccactgcttggccgcgcccaccagcaccaccaccgaagtggccatgcaacgctggcccgccgcgccgaacccggcgccgaccagggcattgagggtgtgttcgcggttggcatccggcagcaccacggcgtggttcttggcgcccaccatcgactgcacacgcttgccatgtttaccggccaggtcatacacgtgggtgcccacggcggtcgagccgacgaaggacacggccttgatgtctttgtgggtgcacagtgcatccaccacgtccttgccgccatgcaccacgttgagtacgccggccggtacaccggcttccagcgccagttccaccagcagcatggttgacagcgggtcctgctcggatggcttgaggacgaaggtgttcccgcaggcgatggccatcgggaacatccacagtggaatcatcgccgggaagttgaatggggtgatgccggcgcacacgccgataggctggcgcagggtgtaggtatccacaccaccggctacgttctcggcgaactcgcccatttgcagggtgccgatggagcaggcgtgctcgaccacttccaagccacggaaaatatcgccttcggcatcggcaatggtcttgccctgctcagcgctgaggaccacggcgatacgcttggaatgttcacggatcaaggcttgtagcttgagcatgatgcgcatgcgcgcgccgataggcgtcagcttccaggtctggaaggcgcgatgggcggcgtcgatggcagcgttgacttcatcggcagtagcgaacgggactttggccagcacttgctgggtggccgggttgacgatgtcttgccactgcgtggtcttggactcgacccactcgccgttgatcagcaacttgacctgttgcacggaaatatcggcagatgcgttcatgtggtctccagaatcttgtatttatgcagagaaccaaggcgttgaatcgccttgaagaatgaggcgttcggactgtttttggagtatagatgtgcaaacttctaataagaacgcacataaaagccggtccaatatgcaaaaaaacatcacctccctgggctccctgaactgggatgacctgaagtttttcctcgaagtggcccgcacccgcaaagccagcgtggccgccaagcgcctggcggtggactacaccaccgtgtcgcggcgcatcagctcattggaagtgtcgctcggtaccttgctgtttgaaaaatcccggaccaacggcttcgtcctcaccaccgagggccaacggctgctgggctacgcggagaccatcgaaagcaccttgcacatggcctgcgaacaagtctccggctccggcgtggcgctgtccggccacgtgcgcatgggctgcaccgaaggcttcggtagcttcttcgtcaccccgcaattgagccatttcgtcgacacctatcctgcgatctcagtagatatcctgccgctgccgcacttcatcagcctgtccaagcgcgaagccgacatcgtcatcgccctggaacgcccggagcacgggccctatgtgtgctgcaaactgtgcgactacaaattgcagttgtacgcgacccaggactacctcgaccaacacccgccaatccgcaaacccgcggatttggccgagcatccgtttatcagttatgtggatgacttggcgttcagctcggagctgttgtacctggcgaatgtggtgcccggcgccagcgccagcctgcgcagtaccagcgtgattgcgcagtacgttgctgcgcagcagggacggtcgatggcgatactgccgtgctttctggcggcgcaggatccgcgcttgttgccggtgctgggagagcagatcgcgattacgcggcagttctggatgtattgccgggaggatttgcgcaagttgaagcggattacgttgttgtgggattacatcagggaggtgacggagcagaatcaggggttgttgatgggggagacgcgggagatcaggtttgcggattaaagcaccatcaacgacgattcgctttaaattgcaggacgtttcctagagaatccttggcctattgcgctgtagcgtttggatcactagcctccctgggtcgctgcacatcagcgatcgggtttagcgatccgggtttcgagcgtgacactgccccaaacagtattagctggcgtccgtcagcttccctgcttttttactccaagaaactcgcgatggaagccgccatggatgtgcgcggcgagcaatatgcatgggctgcgcattatctgtgtgagatgggcaaggccgtggtggatgacttgacgcaggcgatgacgccgggccgttaagcgaataccgttcgaatgcgggaggagccttgctccctcccacatttaaaccgcgccagcctcggcaatttgcggataccgagcccgaacttcgcgcagaaactcacccgcactgctcttgagccattcaatcagtcgagcaatatccggctccgactgacgcccgtttcgacaaatgatgtagtaggccgctggagacatcatcacgggactattcaacgcaactaacgcaccaccgtccagttggtcatacactaatgcagtcctgcccagcgctatccccccacccttcaccgccagactaatcgccagactcgaatccggaaatctcggcccatggtgataaggcggcgccgccagcccctgaaacgcaaaccaactttcccatcccggacacacctgatcgtccacccgatgaatcagcggattgcgggcgacatcctcaagcgcaatatcacccttcaaccgcagaaactccggcgaacaaacggggaacaccgcatcgcgcatcagtaattcgacatgatgatccgggtagtcgccgtaccccatcaccaccgcgacatcgtattgatgagcctccaggctggcgcggttcatgtcgacgctggtcaacaccagatctagattgaatgaggcctcagtgtgagaaccgtgcatcctggggatcagccatgttgaacagagagaagacgtgcatgagaggtacagcggttgggatttaccggggttgagtgaatgcagcaccccatccagcgatttgaagaaaccatcggtaaccggcaacaaagcctgcccagccaccgtcagtttgacgccacgcgagtgccgctcaaacaacgacacgccccaccactcctccaagcccgcaatttgatggctaatggcgctggcagtgaggttgagctcagacgctgcgcgcgcaaaactaccggtttgcgctgcgctgacaaacgcttgaagcataggtgtgggaggcggacgctgggccatcaggtgctcactttgatcaagatgatcccgcaaacaatgacgaacgccgaaagcatccgtcgccaaccgaaccgttcatgaaagaacagtgcagcaataatggcgccgataataacactggtttcccgcagagctgagaccttggccaccgcgtccaatgacaacgcaaacaacaccaacccgtaagacgccaggtaaaaaacaccgcctaagagtccaactcgccaatgcccacgtatcgcacgagccaagactgaacgctctttgtaaaacgccagcatcgggatcggaatactttggaacactgtcaggtagatgatgtactgcagcaccgtctcactggctcttacacctttggcatccaccaccgtgtaagacgcaataaacgcaccggcgcacaccgccatcaggatcggcttgaacatctgcgccgtcatcctgcgcacaaaggtcaggctgataatccccacacaaatcagcaacactcccgtcaacgcctggcatgacaactgttcatgcagcagaaagtaagaaaacagcgcgaccagtacaggtggcaccccacgcatcaccgggtaaacctgaccgaaatcacctgtttcgtacgctttgatcaaaaatagccggtagaccgtattgagcaccacggagacgagtatatagccccatacctctaggctaggcacactgacaaacggcaacgccagcaggcatatcacgagcgcagtgccatcgaccatggccaaggtcatgaagcgactactaccggcgcggactacggcattccaagtggcgtgcataaaggcagagatcaagaccagcgtgatcgcgatatcggaattttccatggggctcggcttatggcggatatgggaggacttacgttatgaacacgaatgcatcatggtttgcgtaaccacatccgtagcatataaccattcagatcactcaaaggctcagcatcattgatctcggagcgtggagcattcatatcttccaacctcgaataattctcttaccgtcaatagctcagcaaatgcgtcttttgaaagccggactttagatacttcctggcgaaaattactgacatttatattcatcgcaatcctttacggtagttacttatagcgtccatttaactaagcccaccacttgcgaaaaagcgaaacttcatcagcccagccattaaaattcgtcatgacaggcctttcctacagagaaaactcctaatggtcgttggtaggttttcgcggcgagcaatacgcatgggacgcgcgttatctgtgtgagatgggcaaggccgtggtggatgacttgacgcaggcgatgacgccgcgctgttaagcggaaactcccgcgagcagaccgcaaaacaaatgtgggagggggcttgctcccgatggcggagtgtcagtcaccagttgtattggctgacacactgctatcgggggcaagccccctcccacattttgaatgtatttcaggttaaggcaggtgaattgccttagtccgcgatcactacaatcgacacccggcgattctcggttcggcctgccgttgtcgtattcgatgccaccggctcgctgctgcccaggccgcgcagttggatattttcttctttcattcccacgcgggtcagcaccttgccgacgctcttggcgcggcgcagggacagcgccacgttgtagggttctttaccggaagcatcggtgtggccgtcaacgcgcacgcgctcaatgcctgcaccaaccagggcgctaccgatgcgctcaacgatgtcggtgctgggtttgttgagggtttcgacgtcgctgccaaacagcactttgccagacaggccgaaggcccagccttcatcggtcagctcgaagccttgttgtttgagcacggcaacttgcgccggggtcaggcccttgggcggtggcgtctggcagccgctgagggccaggaaggcaacgagtaaagaaataaacaaaacgcgcgtgttagcaaacaagggaatcaactcctgtgttgaacgttgacgacggggcgctccgactccgccgtttgctggccgcccgaggacagtcgtttggcctggtacatcgctgcatcggcggcgttgagcaaggtgccgggagtggcgccatgatcgggataaatggcaatgccaatactgagggaggtcaatacctgggtgtccccaggcagtgggatcggcacgtccatactggcaatgatcttgtcggcgatgcgctgggcgtcttcggccttgtgcaggggcgccagcaacaccgcaaattcatcgccacccaagcgcgccaccaggtcatcctcgcgcagttgcgcacgcacgcggtcggcaacggctaccagtacggcatcgccggcggcgtggccgaagctgtcgttgatgtctttgaagcggtcactgtcgagaaacagcaccgccacttgctcgttgaccttggctgcgctgcgcaaggcacggatcaaccggccttcgaagaacgcgcggttgggcaggccggtgaggctgtcgtggctggcctggtgagccagggtttcgttctcgctttgcaggtggctctgccaggcttccatctcgccgagcagggcattgaagtcgctgcccaggctgtcgagttcggcgatctgcgcggagggaacgcggcggtcgaagtcgcgctcgctgcgggccgcgtgggccacggcggccaggcgctgcagcggcacggtgataccattcaacagacgccgcgacaagtgcaaggccacccaggcgctgagggcggtgcagatcagaatcccgaccaggccgctgagcaaaaagcgcaatagactgccaccgtggccgaccaggtgaatgctgcccacggtttgcccttggcgcaggatcggttggctgatgggctgttcaagcagggcgtgcgctatttgcagctcgacacgtgacaacatgccggtttccgggcgtacccatcgcgccagcaatttgccattgatatcgaaaacttccgcctgggccacttcctcggtagaggcaatcaggctcagggcttcggtagccgccgcgctgtcattgaacaccaccgccgcttccacggtgtaattgatggaacgggcgatcaggtgcaggttgtgctcggcgtagacccgcagggcaagtacgccgagcagggtcagggacacactggccagggtgaccgccaccagggccaggatcatatgcccacgggcaatcaccgagcgcagggtcggccgcaccttagtaccgctcatgaccctggcgctcgacggcgagataactgcaacacgctggggtggatgcgcacgccgctgcgggcgacggaatccaggttgacctcgaacgatacttgctcatcgcttactcgcaggcagaacagactgcccacggtgcattggtcgccgccttcgctgatgctgagtaccgggtggccaatcaatgaggtgaacaagcggctgcgttcgtccgcggtgagcttgccgatgtagacggcgtcacaggcgttgacgatgtcgggatgatcgaccagcaggcgccgtaccagcaccggacggccggtagcctgggtggtgcctttgaccaggtcgtctgtgtattgggtcggcccgacaacgcacagccgcaactgcgcaggctctaccggccatcgggcgtagctgaggatgccgagcaccacttgggtaaccgcttgggcacgctgctcggcgaggctttgggtctgtgccgacagaggcgtcacgagcaggcacagaaccgccaccagtaacatgcgtctccagctcaaactacgctctgtgggcgagccagccacgttcatgcagcaattctctcaggtgttttccaaggtgatgccgcaacgatagcacagcggcggaaaaccccacgaaacacggtttgcgcggggcgcactattttttcagaaaaatcagacagctgaatcagaaatattgcatgacctatcagtcagtttcttcaggcacggcgtccaattccagcatcagcccgctcaagcgcttgaccttgcggcgcacggcctcctcaaacacgccagcccgaggctcaatcaggctgaaccagcgcttggcgcgggtgataccggtataaatcaactctttggtcagtaccgggttcagggcatccggcaaaatcagtgcggtatgggtgaactcagagccttgggatttgtgcacggtcattgcgtacacggtttccacgtcattgagccggctgggcaacacaaagcgcacgccgccctggccatcgttacgcgggaaggccacgcgcagcacctgggggccaccgtcgctttcgggcaatttcagcgcgatgccgatgtcgccgttcatcaggcccaggccgtaatcgttacgggtcatcagcaccgggcggccttcgtaccactgctcatcgccttcgatcaggcgcactttgcgcagcgccgcggtgatgcgcaggttcagcccttcgacgccccaagggcccttgcgtacggcgcaaagcaactggaacgcgtcgaaggcttgcagcagctgttgcgcccaatgggtccaggcagggtcgtcccgccgcgtatccagcgatgggcgtgcagattgcagcaggttcaggtagtagcgataaccttgggcgccgtcgccctgcccgtccagcaccaggcgctcaagtgcgtggtcatgttcacccttgaggctgacgcagaagaggtcgtcgtggcggcgtgcggccaacagctggcgggcctcttcggcgttttgctggttgacccaacgcgccagttggccgatgccgctgccctcaccgaagcggcgcgaatagcgcagcatcactacttgctgggccaggggatgactgccatcgaggtcttcttgcaggccactggtactgaggtcttcgccgctgaccgcttgcaaccattggcgcgtgtgcgggctgtaccagccggcttcggcatcgcggcacaagtcgccgagtacggctcccgcttccaccgatgccagttggtccttgtctcccagcagtatcaggcgtgcatgggccggcaaggcgtcgagcaggttggccatcatttccaggtcgatcatcgaggcctcatccaccaccagcacatccagaggtaacgggttacccaggtgatgacggaaatgtcgggttcccgggcggctgcccagcagacggtggacagtggtgacctgagtggggattttttcccgcacgttgtcggccactgtcagcgatagcacttgctggctgatggattcggtcaggcgcgcggcggctttaccggtgggcgcggccagacggatacgcaacgggttgccggactccacggcgggcgcttgcaacagcgcgagcaggcgcaccaccgtggtggtcttgccggtgccggggccgccggtgacgatactgaatgcgccgcgggtcgccagggcacaggcgagtttttgccagtcgatcacgccatccggcgccggttgatcgaacaggcgattgaggcgctgcggcaaatcggcggcaacgatctccacactcgcaagacgctggcgcaaggcactgtcgatacgccgttcgtaggcccagtagcgccgtaggtacaggcgcttgccggacaacaccaacggtcggctctgggcggctgcgctgccatcgaccgccagcgcgaccagttggctggacgccagggcatgacaccaatgggcaccgtccaggccatgcagcagctgtgacggcagcagcatggcgccggtgtgcgggtcgccctcgggcggcagtgacagggcgaagtccggtgccttgagggtttcgaacaggtccaggcagacgtgaccatggcccaactgatggctggtcaaggccgccgccaacagcaccaggggatcggcctggggatcaagctcatgcaggaagccgacgaaggctttgtccaaggcgcgcaaccagccacggtcgacccaacgctctaacagttgcagcaggtcggcggcgcggctcaggggtgtcagctcgtccagcggtaacggcgacaggttcatagcagcactccttgttcccaggcgggctcaaccttgggcgggataggcttgccctggaacaacaggtccagcccctcgatcagctcacggggtggccgggtgaaatacgcgccctggctcaccgcctgggtaccgcgcaggaacaggtacagggcgccgccgacgtgctggtcgtaatcgtaatccggcaaacgcgccttgagctggcgatgcagggccagcaggtacaatacgtattgcaggtcgtaccgatgctctaggatcgaatgccccatggcatcaagggtgtaggctgaatcgtcgggaccaagccagttggatttgtagtccgccacgtagtagcggccattgtgctcgaacgtcaggtcgataaaccccttgaacataccgttgagcaacaccggctcagcggccacgcgggaggcaccgccgtgggtgtgctggcacaccagcttgtcgagggcgagcacatcgaccttgtggctggcgaaccagaactccatttcgatctggtactgcttcaggccgctgagggtgacgtggtcgttgcacaggggcagcggcgtttgcagcagatgacccagccagccgctgagggtgacgatccagccctcccagttgcggcgattacagcgtgcgcccacggctttttcgatcgcctcaggcgtcacgttgaaaccctcttccccggcccactccaacaacccgtgaaggaaggtgcctggattagggccgcgtggaaaacggtgtatgtcaccgccggacgccaccacttcccgtggtgcatccgggtcgaggcgttcgtcgtcgaacagcttctgggcctgtgggctttccggtgcttcgaggctggcggcgctcatgctgtcgccaatgcgcaaggcgctgtaggaagcgatccaccagttttccgcagccttgcgtttaggcagcaacggcgccagcagggtcgcttcattgcgtggcgggtggaacaggatgtcttgcgcatctggcacaggtgcataactgatggccgggcagccttgctgcaagtccaacagccagcgcgccaggtcggcggattcgcctagcgacgcaccggctcccagcagatagcccaaggccgagaggtgcaaaaccgaactgctgttattaccgcgcttgaggtcggcgatgcccagccagcacgcgtgtttggcgcgggtcaacgccacgtagaacaagcgcaggtcttcggccaggcgctcatcatcggcctgggcaatcagctcggccgtcggccgcaggctcacttgggacttaccctgttcatcgtggtaatgcagcggcaagcgactgccatccaccggtttggccgagcagatgaacggcaggaacaccaagtcatattccaggcctttggatttgtggatggtcaccaccttgaccagttgctcatcgctttccagccgcaggatctgctcttcgccagcctggcccgacagcgccaagtgttcggccagatgacggatcaacgcctgttcaccatcgagttccgacgcggcttgttgcaacaactcactgaggtgcaacaggttggtcagcacacgctcgccatcactgcggacgatgagggtttgcggcaacttgaagtcgtggagcaggcggcgcagcatcggcagcacgccttgggtacgccagatcgagcggtaaccccggaactgcattacgcgggattcccacgccagttcgtcctggttcagacgctccagttccgccaacgacagattcaaggtgacgcaggcaagggcagcgcgtagcgggcgctcgacatccggctcggcgcacgccttgagccaggccaacaggtcgtgggcttcctgggcggcgaacaccgagtctttatccgacaggtacacgctacgcacgccacggctggccagttcagcacgtacggcctgggcttccttgccgtcgcgcacgaggatggcgatgtttgagggcagcacaccggtgaaactgtctttcgtgacaaaccccgccgtgccttgctgcccgccgttgagcagcgcgacgatctgcgtggcacaggcagcagccagttgttggcgataaagcgcgttggaaatcggctggtcggtgggcaggtgccaaaggttcatggccggcagcgtctggccgtcaacctgcagatgctctctgcggccttgggacagtaccgggtggaacggcaccggattctcgccattgggctcacgaaacagaaacgcgccacggccggtttcagctcgctggaacacgtggttcaccgcctcgaccatcgcatggctggaacggaagttggtgcccagggtgtgatggcggccggtggtggactgccgggcgcgcaggtaggtgtagatgtcggcgccgcgaaaggcgtagatcgcctgcttgggatcgcctatcaggaacaggccactgtcgaggtggttctcctcgatgcggtagatgctgtcgaagatgctgtattgcacagggtcggtgtcttggaattcatcaatgagcgccaccggaaattgctcacggatcacactggccaggcgctcgccaccgtcggcttgaagggcggcgttgaggcgaatcagcatgtcgtcgaagcccatctctgcgcggcgacgcttttcttcttcgaagcgtttgccgacccagccggcagcatgttgcaacaccgctgcgtctggtgttggcaaggcgtcaaggctggctttgaggccggccatggcctcgatccctgggtgctgcggcggctcacctttccaggcttcggccatgccgtcgggcgtcaggcgcgtgaagccggtgccgatgtccagttgttccagggcttcatcagcggcccaggcgctgatcttctcgaaccagggttcgaagtagcgcgcttgcatcttgcgaccatcgacagctttggccgcaacagcttgcaggcagatatcgcgcagctcgacggcccattgttgccaaggcgccttgaggcttaccagcgctgcgcgacgttcttgcaggcaggcgttgatcagctccgccggctcacgactttcatcggtgggccgttcgctgccgaacagcgcacgcactcgcggcatcagtgcagcggggccgccccaatggctgcgcacccagctgagcgcgtcgtcgtgcatcgggtagcagaacagccgccagtagtcgcgtagcacttcgcccagcaggtcgccatggtcggtttccagagtctgggtgaacaggctgccgctgtcgaacgcatgttcgcgcagcatgcgctggcaccagctgtggatagtcgagacggcggcttcatccatccattgcgcggcgatgtccaggcggttggcgcaggcgggccactgctccggggggtactgatcgcgcaggtcggcgatcaacgcatcgggctgttcgatttcgtcgcgaaagaaacgcgcagcttcggccaggcggatgcggatgcgctcccgcagctctttggtagcggcgtcggtgaacgtcaccacgaggatttgtggcggcaacagttcgcgcccgaaaccggactcatcaccgccgtggccgagcaccaggcgcaggtacaaggcggagatggtaaacgtcttgccagtgccggcactggcctcgatcaactggctgcctttgagcggaaacgccagggccaagggtttgccaatcatgcgccggcctccgtactggagagtgatcgccacggggcgttgagcagtgggcgatacagggtttcgcaccagccttcgaactcttcgctggcaaccaaggcggcgtagtcgggaaattgccgcgtgagcgcgggcgtttcgcggcgttcgccgtcggtggtgatgccatcgccttcgtaggctttgctggccgcggcctgggccttgacgggatcggtctggccgagccaggcaaaggcggttttcaccgcgacgggtagcggcgtgctcatgccggtgtgccaggccagcagcaggttgccaaggatttcctgcgcaatgggcttgtccagcggagccagcagcaaggtgtcgtcacttgccaccaggccggtactcagtggcaggccgcaggcgcaggccaccacatgattgacccagggtcgaatcaggcggtgccacttgcgggtcttgatcgagccaatgctgttggggatggtggtaacgcttaacaaaccgccatcactgcgtcgatgcaggccgctgatccaaccttccagctggatgccctgatactcaaaactgatcggctcagcagcggtatgcggggttggccaaagggccagaaggtgttgatagcgttgcacaaggtcaggcaatggctcgatcagttcgttacgcagacactcaccgaaaccgaccatcggcagcagtccgctgccttgcaggcgcagcgcctgggcattgagggcctgatcgaggtgatcgggctgggtcagtgcggcgctcagcaggctgtcactgaggctgtagcgttgcagtgcgtccagcacgaagggctcttcgtcggccaggggaacttcggcagcttcaaagaacactttcaggcgctggctgaagaagtgtttaaccgggttgcgtaggaagtcctgcaactggccgaggctcagcggctcttcctgttggtgttgcgccagcgtattttctgggccgacggcgaccggggtttcatgcagcaattgccattcgcgggcataactgaacagcgggtcgccttcgtgaaagtagcgggcactgaagggctgcagaggatgttcctgggtcattgcgtcaatcagcggtgtatcggttttggcgtgctgccagccgctggcgaggtgatcgcgcagttgaccaatcaacaccgaggctgggcgatcgctgttatcgcggatgctgcgccctacccagctgatatatagctggtcgcgggccgacagcagcgcttcaagcagtaagtagcggtcgtcttcgcggcgtgaacggtcaccggggcggtagtcgctgcccatcaggtcgaagtccaggggcggctgggcccgcgggtaatcaccatcattcatgccgagcagacagaccagcttgaacgggattgcacgcatgggcatgagggtacaaaaattgacagctcccgctaggaagcgttgggacaggcgcccctgatccagtccggccaaccacgcctcacggaccacggtaagcggtaactcgtcctgcaagccaacggactcgcaggtttccagccaagtctctcttagttgttcgagctggcctagcaggtagtcatcgtgctcactgctgggcaggaaaaacagctgcatcaagcgttgcagtcgctcgccccaggcctggggggaggcgggttgggacaacgcctggtgggcatcgctcaaggcatcgagcagggcgaccagcgggccgatcagtgccgcatcgaggccaccgatttcatcgtagggctcaatcccattgcaggccgtgccggtgccgacagcgtagcccagcagcatgcggcgcaggccgaatcgccagctgttttgttccagttctgtaggtaggcctaaaccagcgcgttgctcggcattcaggccccagcggatgccggcgccttcgatccagcgatgcaaggtgggcaagtcgcgctctttgatagcgaaacgttcgcgcagggcgggcacgtcgagcaggtcgaggatctcgctgacggggaaacggctgtcgggaagtttcagcaggtgctcgacggcgatcagcagagggtcgcggccgcgctggccttggtcggtaagggtgaaaggaatgaagcgtggatcatttcgttcgagctggccgaagactgcgcggatgtgcggcgcgtagctgtcgacgtcggggaccatgacgatgatgtcccgggggcgcaaagttgggtcggcgctgaagcgttggagcaattggtcgtggaggatctccacttcgcgctgggcgctgtgggcaatgtggaagcggatcgaagcatcgtgctccaagtcgacagggggccacagctcacgggtttcattcagcgggcgcagttcgaggatatcgtcctggagctggttgagcagcgtggtgggttcactgtcgctgaacaagtcgatgcggccgtcacggaatgcggcccgatagctgttggggtcatcgtagctgtctagcaggctgatgtaatcacggccttgcttgccccacgcggcgagcaacggatgggcgtgctgatgtagggtttgggggtcgatggtgaccggcatgccggctttgcgcgcctggcgtttgtattcgtttcgcagcaggtccttgtcggcgacgatatcggaccagtggtggcggcaagggttatgcacgcaaagcaggacctggctgaaacgggccagacccgccagcgcttccaatgcctgggccggtagcgatgaaatgccaaagacaatcacccgggaaggcaagccggacggcgctttttcaaggctattgatacgttcgataaaacgttggtgaacgccggctcgactttgggccatgccctctgctcccacgtccagcaacaacgcacgccataactcggcttgccagcaattggcagggtcgagcggtttggattcgcctcgactattgcgtagttggtggcggcctgcggcccaatcttccagccaatcagcgcggtagacctggtattggtcgaacaagtcagccaggcgctcggcaagttggtagcgtttgcgcaggtcggtgtcttgggtcaggaagcgttgcaaaggctcgaagtacggctggtcaatcagctcgggtaacaggcgcatcaggcgccaggtcaacggggctttatcgagcagggacttcggcgggatttcgtcacggcccaggaccatgcggtagagctgccacatgaagctgccaggcagctgcacatcgattgcagcagcaatgccgcaaccgcccatatcgtcttcctcagggtcttcggccagggccagcttgagccactgggcgataccgttgctttgtaccagggcgatttcattttccaaaggcgccagtgggtagcggcgcatccaactgaccaccaggctacgcagttcgtccaggcgattgccgtggaccaccatgaatccagcgctgagggacgttgcgtccggcataacggcttccttgggaaaagcaaaatcgaggggtggactttagcactgtggtgcacggaccggacacatggctgacaggtgcgcggggacagggtggacac

SEQ ID NO: 13 - DNA, 200112 bp, Pantoea sp. OXWO6B1
gagaacctccgccaccagccccgcatctttaatttctgccagcgctttagccgtttgcagatactggctatgaggattggccgcatcgacgtgcttcttcatcacgtcgtcagtgtaggctttcacctcgatgacgttgtcatccacatactggcgcgtggcgagcacaaccgaaggatcaatcttcaacgtgacggcactggtgctgttcacaatcagaatcatgcgtacggtctgagtacggccactgccttcctgcagctgtggcttgtaggtttccgcgcagttcgcgacggcaaccattacgccatcggcgtcatagagaccaatctcgcggatccagaagccgccttcgccttcagggataatctgttcagcgataatctggctgctgttcacggcatccaccttcagtgaattcagcgcagcacggcgtttttcgccaaccagtttggtctgcgcagggtccggcgttggcaaagtgccgccgccatcacccaccgccatttgggtaatctgtagttgggtacccagggctgcggcattggccagctttgccgcgccctgattggtcagtagggcaaaatatttcgttgtcatgctctcacttccgtcaggtcaataagatggaccgctgcgccggtgtaaccggaaccgcctgcggtgataacttcaggtgtatagggataaacggttaactcgtcaccgctgtagctggcaactgctacgggtacagtccccgtagtatccagattgatggacaggccaatcaaatgacggctgaccggtttggcatcagcaatcagccgttccagctcgttgtacatcgcttcggtaatgccgttgtccagcacgccgacatcaatgcgaaaggtgccgggcgcttcattggtttgccaccattctttaatgcgaatcagatagccaagcggctccaccacacggcgcaaagagccaatggtccctttatgtttatggatgtattccgatgcagccaccacgctgcgtttggtactttcgctccagcctgaatcccaacgatccaccgaccaggcccatgccagataaggcagtagctctaccggacaggtctgtgcattccataatctgcgcagcggaaccgggatggactccagcactgcacaggcttcagccgcggcaacttccagagctgatgaacccgttggcagcaggcgtttactcatcggaacctcctaccgtgatctggtagccggtgcagaacgcggcctgggttttatccaaaaccacatcggccaccggctgcgccagttcgacgcgctgcacgccttcaacatgcagcgcggcatacagcgcagacttgcgaatatcgcgccctaaacgtgcctgggtgttcacgaatgcctgcagttttgcctctgaagcggcacgaataggttcggcttctggccccggatagaggtacagcgtggcctcgacgcggtaatccacaatctgtgccgactgcacggtgacccgatcggcaaccgggcgaacatcttcctcattcagcgcggcatccacgattgccagcaggtccgtgcccgccgtgccattaccttcgcgggacagcaccgtaacggtgacgctggccggagagggactgatagcagaagcatccgccacgcgcccgtcagcgctgcgtgcatgaaattcataggcacccgatgggcccgcgacgctcagcccttcaaacgcggcggcaatgcgggcgcgaaaatcttcatcccgttccatcaccgcctccacaggcggcgtaaccgtgttatctgccggcgtcagtaccaggcgtagtacgccgttgttggcacccaactggtccagatcgctgccgctggcccaggcaaccatcaccgccttggccgcttcgttaacgcgctggcgcaggatgatctcccggtaagcattctcctgcaggagtttcaccagcgggtcggactccagcgccagcacccgggcaaccgatgcctgctcatctgcagggtagagcgaaatcaaggtggctttgcgttcggcaagcagcgtttcatagtccagcgtttccaccacggttggcgcaggcagctggctcagatcgatagtaggcatgattcaactcacagggacggttaacgaaaaatcctgcgcggtgtccgcacggttgccggtgatttccaccaccattccgccgtcaaacgcagattcaaaattaatggcagtcaggctgatgcgcggctcccactgcagaatcgccatataacaggccgacatgatttgcaggcgcaaccggtcgttctgcggctggtcgatcagcgccgacagcagtgaaccgtagttacggcgcatcacccgcgatcccagcggcgtcgtcagaatgtcacgcacagactggcggacatgttcaagttcaaccagcgtcatgcccgtttcgcggctcatgccggtgtagcgtgctgtcgtcataatggcgctcctgtggtaccaccgctgtcgcccggatgttgatgcgtatgcagcactttgccgttggaggcgaagctgccgccgctgtgcgacacatcgcccttcatggtgccgccctgtgtgacttccagcgtggcggttttaagtaacgtggtgcactccacctctggcgtatccagcaggattttgacggccgctttaatggtcgccgtctgaatcccttcggctttcagggtgccggttgcaggctcatactcaatgaccgcgccatcagggaaggaatagtgcagcgcatctgccgaggccgagggtgccgggctggcgtcagagaacacgccgggtaacacaaagccgctgttcagctcgccacccagactcatgatcaacacctgctcgcccaccgagggtgcattccacgaacgggttcttcccgcccgggcactcagccagtgcagccagttggtggtgttatctccggtttttacccggcaggttccctcctccagattgatggcggcgacggtgccaatgcggaccatattgcgcagcaagcgcttgatttctaatatttgctcattcatggcgttagtttcacgttgcgagagaaaagcagcaatcgaatgccgtttgctcaaagatgactaaacagcgcgtcagctgataacggttggcgctatgacgtccattcactgaccagcttgcctttgatatagagctgccagggccgctctacattttctggcagcgcaggttccggcaaatgagtgatgtgtaacgcgtcattctgctgctcaacccagacgcgttcggtcagttgcagagtgatattcaccctgttacgcccttcttccatcgcatcgagagtaaaggtaaagccggtgcggcgcttctcatcagaaaccatgatgtcgggctgattttcccgaagccatgtcagcagcggaaccatgatcagatcgatatcatcggcgtagtgcgtaatggtgacagccagctggaagtggtattcaaacgacagcgagctggctaaggtggaaaccaggtttccggactgaatcgctatattcaggttgtcaggattttgctgtagcagcggaacgctgtttatcagcacctggcgtagttggttcactttcaacatcatgctgctcctggcacgctttaatcatctctacctgcaacccgcatgatgcgagcgcagcctctaactggcggttatccgccgccaaatcaccctgcgtttgcaggttgttctccggaatggggcaacttgtcacgcgtggacaaccagtccagataatctcgggcattgctgaaggcgggacggctgtgcagccggataacgtcagcaggcaaagcagcagcgctccaggcacgtaaagcgggattggcatcggtttctcttctgatggttgtttctcgatggagcgcctgcgcgctggcctgggtttgttgcagacgcaacgccgcctcacgttttcgggtggcttgcatatctgcattgagctgagccagtgcggtgtcccgacggctaatgtcggcggctaacgtactgaccctgtgctgtgcctcatcccgttgatgagtcatgacgctgagccgccagcccgttaacaccagggcgctaagcaacagagcgatagccgctgcaaccagtcgcatcatgctgctccttgtaaacaccaggccatttcacgctggcggcggttatcgaggcccgggttgtaagtccctttgacatatacccaccgcttaagctgcagacaggcgtcgtgccagcgcccgctgttgatcaatcccgccagcgttgatttacaggccgcgcggacgcccacgttaaaaccaaatgacaccaccgcgtcgtagacctggggcggcatttcacgcgtcatgcactggtcgatgccgcgctcaacgcgcatgacgtcatacaccagattcacggcggcctggcgctcgttcaccacgctggtcggggtaacgccctgcgtatgaccaatcccgttggtccagacgccagcgctgcattgataaggcgaggtgcggcagccttcggcatcggcaatcagcctcaggccagcgtcagaggttttcagcatcttgatttgcggtaccaacgcggccatggccagcacggccgcgaccgcacaacgcttagcggtctggctcaaaacttagcccctttaggttgcgctgttgtagctcgtaggttttgcgacggtagtaccagttgataaaaaacgtcgcgacattggtgcacatggtcaaaacggcgacgccagagccaaccataaaggcgatatcctgcggtgtgtgacggccaaaccacatcaggacaatcccgatgaggtaattaatcagagaactgattttttccattggcactaatcccacagattgagggtctcaccggtggccgcctgaggcagctccggtaacaccaccttgcatccgtgcggtaacgttgggccgttttctgccaggccgggattggcggcataaacctgttcaaccgcctgctgcgtgcgtccgtagtaacgccagcagatctcatcgacggtgtcttcctgtcgtgcgtaaatcagcattgattggccccttatgagcgtaaaagccgtggtcgaatgggtgataaatcaagcgcatccgctgtaggcggtgccgggcttcaaaggcccgatcgggtctgcgaaaacctgtcttcagcattgaatcgccaggccacaaaacgcccgataaatgccactaccggataacccgagcggtgccataaacgtgggggatttgctcagcgcggcctgtacggtttttcacgcctgccgtcgccggcacttgtcaggagtagtgtgtgcttcggcagacgcttgctcaacgcaaggccgtccgctcaaggctgggtgggcaggacgtggagggaatggctggataacccagctgaaaggcggaaaaaggccgggatgcggtgaacacatgtgcgatgacccgcaacgatcgatgcggtcaacaggcagaggaaagtcgccgtgataaaaggcagggcaaatcgggaacaaaaaaagcagagcgacagggagctggcgaacgcgaagaaggagcggcagcagtcaatggatgaggtagcgcataaaggcaaacggccgggtcccggggtttttctgtgggtgacagtgccgggtatgaaaagggcgttgcacggtggcgcattccaggccggcgtggcggttgcccgcgcctgaaccctctcttccgttgagatggctcaggcgacgggcaaccctgctgatgtcacagtgaaaacgtcgccgtcattatttttttaaaggcgtagccgagaagacaacagaaaagtggttatcggaaagggtgtagttagcagcgatttcggcgatcaaatttaacgctatttccctgtctcgttcccggcaggctccttcgctggtgagcctggcgataagttcaacgcgttcaagcatgactcgctcatgtaattcatttcccacaattccctcccccaaaataaacactgtacatacatacagtagcatagcattcattaactgtggaagcgttttaagatagttcgtaaaaaattatatcgtgttgataggaatcaacttttatccgaccacctggcagacaggttggtgcctgctcctgccagaagcgtaagaaaaatcaatagattttcttcatttaccccgtaattctacggaattttcacccctcttttttcgtcagctcccggctgaggcaagatcctgcacaatggctgaaccgccggtaaagcatcgcttccgtcactgagtaaacgcgtgccgctgacaggtgcagacgtggaccgacagcttagccaggggtgccctcctccttttttctctccacgccggtcgtctgtgcgcggcgcctcagataacgggcgacggaagaagaggcggtctgccgggtccgtacagttattaacagaactccaagacaataacgcggaatgcgatttttcgccgtcttcttcttcagcacgtttgggcaccagcttccaggttttcagccgggtcaaaatgggcgtgtcgatgccgacagctgtggcatacacgcccttaattgactgggtttcttcaccaaaggcattgcagatctcggcgggctgataccaggtgcgcaccgcaagcgcatcgcgtttcacaaagggaccgccctgtgcatgaatatattccgcccattgcccggcgtcagccgcatcatgcaccgccgcaaattccacgctcaggccatgcgcggtgtcactgtctgccatacggcgcagctcacgataaaccgttacgggcgcgccaccgataaactgaaactgacggatgtgccagcgcgccgcccatgctgacaccgccatcgccgtctccttcaggggtttaccgctctcgttatccagctcgccgtccagcgcatagccatcaatattcttggagacgtatttggcaacgtaaccggtcgcgctccctttcgccggatcgatcgcctccacatgaaaccgcgctttgcgtgcctttgcgctggtcagttcatcgctgtcctgctggcaggcgtaatggcgcacgatctcgtctacgcgtgcgacgtgctcagggcgcataaacatcagcatgtgccagtgaggcgtgccatcgtgatgcggctccgcaacgcgcaacccaaaaataccgatattttcccggtgcagtttggcgcgcactttctgccagagcgtgcagagatagcgctgtgtttctgccgggctggccccctgccatttatgattacggtggccgctctgtaaggtggcgtgatagcaagacggcgcggttaaggtatagaagccagcccggaagcccatctcctgacaaatcgtttcgaagccacggatgcgcgtcatcagttcagcacggcgaatggccggattggcgacgctgccgtcatatttttcgatcaggctgatgcgattgccctcttcatcttcaagatccatcccctgaaggaaatcacgcgtgcgccgacgctgctcgcgccattccgccaccgccatcggactggcgtaaggcgagtgctttttgttgacgttcgccagcgcgatatgcagatgttcacgccagaaggcactgattcgacgcagttgccctttccaccatttttccgcctgcatacgcagaatggccgaggtcacgtcttcagggcagaatacgcgggcactgacggtttcccacaacggcggcatctggcccagttcacgggtaatcaccgccgccgtcatatacagacggtgggtataacggtaatcggtttcagcgctggcctgggaatgcagttgcaccagctcggcatgaataaaacgggcgatatcgcccgccagcaaatcggtgtcggcacgggacatatccggcaggcgattaaaccgtttcatcagctcccacagcgtgcccgcggctctggcggcgccttgctggcaggacaggctgcgggctaactgggcgacaacgcctggccgcatatcatgcagttgataacgtcggttcacagactcaacgcgtggcaatgtgcgctcaacaaaggtttttgctaagtaagcattggcccgggctgtgccctgctgctgttccagactggcgagacggcgtttgacgtccagttgcacaatccgggcctgggcagcgaggcttttctgcccctgcagccacgccgctatctggcgattgcggtgctgctgctggtcatgggtaggatacgggctggcgattgccagccgcggggcgttccatgggtaagcgaacgacatcatcgtacatgcccgaaatgaaggcgcgttcttaactcgctgagttcctgacaaggcaggcagcgggttacgccctggagcgcgcgacgacgcgcttcaggaatcggcgcatcgcactcttcacagaacgaggcaccgatcgccacaggacgttgcgtaacctgagcaatatgctccgccagaatctcttcgctgcgctgctgcgcaatatcaatcgcatccgccatcagcgcatctcacctgattcattttcataacgttcagcctcagatcgcaacagctctgcggcttcaatgccgtttaacgtctgccgcgtaatatgcgatgccatggcgcttaaccgcttagccaccgccaatgcacaggctttacgctcgttatcgagcagtttgttcagggtaaagtggctcacgttgttcattgaatgtgtctcgctattcatcatgtctctctccagattttgggcaaagcgatgcccgacgggtttacgtcattgagtggtgggtgatttatttattcagtcagaaagcagtccgccgtggagaactgacgcggcaacctgtttccccagcgcgccagcttgttcatcgcaataatgatgtgctcacggcgcgcctgatcgaaatactggaagggcttgccaatctcctcccgcctgaacatgcccggacagtcgcggttagccagggttaatacgcaaaatttaaagtcgtcatgttgatgattgaaataacgaagcgatgggtttcggttgttatcgcgcagcaaccgccagcgctgacggaactcatcaaacgtcattttttcgccgtgactggagtgttctgccgtgaaaccctcctgaacatacagagcggcgggtgactcacttatgacctggacggtgcggttcataggctcctccgataaacgttgcatctgctgttgatgacaaatcaatgtcatcgccgaggtggctgtcgcctgtgatgggcggcggcttcgcgcctgtctcatccgtcacgtttgttaagcattaagcgaaacgacagcgttctgctcagcgcgatttatcccgccgctcacactacgcatttccgctgcaaaagcggcctgagcgcggttcttctgagtaaaacgcccttttacgctgcattcagcctgtcctgactgcgttaaccctgtgtctcagtgtggcgataaggttctggcatgatgattgtaaaaatgagcctcatcaggcaaaatccttcgttatcagatacagccgcaccctgtcacatcattcaaaggctaacttaaaccggaggatacttagactaaatctaagtgtcaatgaaaatgagcgtttatactaatttcaaatttccgaactcgagcgcagaagctctggatcgcgtcgtcgatgcctatggctttaccatgaaaatgcagcttgcagatcaccttggaattgcggcaagtagcctgtctgcgcgctataaacgtgatgtttttccatcagatatcgttttacagtgcgtgatggaaaccggtgcagatttgcagtggctgattacgggcaaaggctcaaaattctcggaaagcaaacctgatacgccgacactggttagaaaaaagctaatcagcggaaaaatcgaggaagcgggctatgtgatgctggataaagcgttatacgcgccgctgaagcaggagccgcgtaatgcttttttactgttagcggaaaccacccaatacatcattgataccgattttgaagatatgcatgacggcgtctggttggttgaaattgaagggaccgccagcgtcaggacgctgacgcgcattccggtcaggaaagtgcacgtcagcgggataggcgtggcatttgattgcggaattgatgacatcaggcttattgggcgcgtcgttctgacgattcagtaaaccgacttattgcgacctgcaacgtcttatcactgtcaacgcgttgccgacagaatgcgacatcacgcgggacgcccgtctcaggccgcccgcccgttaaaaacagctatccgttcacggctgccagaacgaacagccgcccgcgcagcggctgcttgatcaccgcttgcgtttgctgcgcctggagcaatacaggtgttaaccaccgcctgcgcatccagagcgacaagcgttaacggttaatacagcccggctttccccacagaagagaaaagccgcatcttgtgctccaccacggctttggccgccgccattggacggacgtacagcgcgcttggctcatgcccgtttgactgcaactcttcctgtagcgcgacgtaaaacgcctttttcatatcgctggagatattgattttccccacgccatacttaatcgactccgcgacctcgctgtctttgttacccgagccaccgtgcaggaccagcggaatcgtcagccgctgcctgatggctttaagacggtcaatatccagtaccggctgtttaccgacaggatacaaaccatgtgaggtgccaatggccacggcaagcgtatctaccccggtttctctggcaaaccgctccgcctggtcgggatcggtgtaaagaatttcactgtgccccccttccgcgctcccctctgccacgccaatcgtacccagctcggcttctaccgagacgttaactttgtgggcaatggcggtgatatcgcgcgtcagggcgatattctcttcaaacggcaggccggaagcatcgatcatcaccgaggtatagccggtgcggatggcggttaagatatgctccagcgtctggccgtgatcctgatgaataactaccggcacggaggcgttaacagccagctctctcagataggtgataaaactgtcaccgacaaaagcgtgctcttcgggatgcacttccaggatgacaggagattgcagggattccgccacctcaatcaccagccgggcaaactcagcggaggcgatgttaaaggcaccgacgccaaattgattgtcctgtgccaccttcagtaacgctttcatattaatcaacataattcactcctgcggtaaatgttgcggatgatctttcttaatcactctgaggatcagtgcggtaaacagcgcaccggcgagaatggcaaacagatagcctgtgacgtgcgtaatgacgttgggtatgaacatcacgaagatcccgccgtggggcgcgcgggaagcacaaccgagcatcatcgacagtgccccggccagtcccgagccggcaacgatggcaggaatgacgcgtagcggatcagcgaccgcatacggaatggcaccttcggtgataaaagagaggccgagcacataggtcaccttgccggtttcgcgctcctgaggactgaatttctttttaaaaagcgtggtggcaagggcaatgcccaacggaggaaccatgcctgcggccatacatgccgcaatgggctcgtagattcccgtcgacatcaaaccaatcgcgaacatacagacggttttgttgagcggcccgcccatatcgaaagccaccatcatcccgataagcaatccgaagatagccgcattggcatttcccatatcggtcagaaaagcagtcagactctgcaacagcagcttgatgggttggccgaccaccagaatcatcagcgcaccggtcaggaacacgctcaacaggggcacaatcagaatgggtttgagtccggcaatggcggtgggcaggttaatgtacttcaccaccaacagcgtgatatagccggccataaagcccgccagtaacgcacccagaaagcccgatccggtgtgaatggccaacatgccgcccaccgcgcccgaaacaatgcccatgttgccgctaatcgacttgctgatacccaatgaaagaatcggcagcattaacgcaaaggcggcaccgccgccaatatcggccagcatttttgctatcgggttatagcggggatcgccaggcgttgccgcggtaataccgaaagagaaactcagagcaattaaaataccgcccgcgacaacaaaaggaatcatcaggtttacaccagtgatcagatgtacatagatgctcgacagggtcgtttttttgtctttttccctacccggtgaggtcgcgtcttgtggcgtgacggtgcagatttctccggttaaggcacccgacaaaatgtcgtccagcaatccagcggcatctctggccgcgcgggtaaccgatacggtaataatgcttttaccgataaagcgggagcgatcaatcattttatccgcggcaataagaacgatatcggcacgtttaatatcgtcttccgtaaaaatataatcgctctcaacggcaccctgtgtttcaacaaggatcgtgattccttttttctcggcgctcttttttaaattggcttccgccagataagtgtgtgctacgcctgtgggacaggcggtaatcgcaataatattcattattttctcccggtgaaaggcttacccctgggtgttattgactaataaattaaacaactcctctttcgtttctgcgtttagtaatgcctcgacgacatcatcatcgccaagcgcaatagaaatttttgccaggagttttatatgcccggcgccgctgtctgcttctttcaccgcaaacagaatcaccagcctgacggctgaatcgtccatggtttcccattcaacgggagaggccagtttggctaccgctattcgggtttcattgacccacggtgatttcccatgcggaatcgcgatttgattttcgaatccggtggagcctaatgcttcacgtagcatgacatcgtgaataaaaccgtctttattgctgataatatttaattcacacaggcttgccgttaatttctcaataacctcgcctttatttttggcctcaagattcataaatacacaggcctgatttaacagatcggccactacgattttattatgcatccgttcctccgttaccatgactgtctttattaaggcactccatcacccgtaaaatgtctctgtttgaaaacagggcagaaacataggcaacgggatgttcagtctcttcaagcctgatggtcgaaataattaagtcgcacctggctttcttaatcgcttcattcagacgggcacccggcacaatgtcgacgatctcccattccggaaaggcgcggctgattcggctggaaagcagctgagatgtgccaatgccgctggaacacaccagcatgacgcgtttcgtcgcatgacacttttctaacgcgttctggatataaatagtcagataggcaatctcatcatcggacgccgtcggcagcccccactgttgattaagctggaatgcggcctgtttgacgacgttaaacaccgcggcaaactctttacgtatctcatccagcaatgggttgtgaataacaatgcggtaggccagacgattaagcatgggcttcacatgtgacaccaacgcattaagcagcacgctgtcgctgcaaatattcttttttaataaagaagacagccgcgttgttaaggtagtggcgtagttcacggcgtcgtcgtcatagtgcgttgagggttgaaaaccggcactaaacggatgccgaccagacgagatgagatattgataaatgtaatgcacctctactggcgcgaaggagaccgcgtatttttcctcaagccatctgaccgcttgccgggcgactgaccattcctgattgttataacctgtcatgtccgaatccgtcggcgtcggtggcgtgccgttaagcgctctttttattgtcaccagtagatgggaaaacaggttggtataatagggttcgctgattgagcagtgcagcgcttcttctatataggtgatgaggttaatacagcaggccacattgtcactgccaaattcctccaccagttgaacacgcgaaaaacgatcgatgcgactgtcggcgacagggtaatcgctcatcacgctgaaggtaataatctctttcagcgccagacgaatatcccggtcgctgccggtaatacaggttccgctatggctacgggtaatgctcagtgaaaagggcgttaaccagacctcaatttttcttaaatccgccacgatggaagagcggctgataaaatatttttccgctaaggcgctcagcgttagcggtaatggagaacaggtaagcaggtctgttgtgatggctaccagccttttattcttcaacaaaccttttacctcttccccatgcagatccacaggcaaggcaaaaccattttccagtaacaatcccaggccgggcttactaaggatacgactctccttgtcggtaaaatagtgattgaccgcatccacgtcgcgccgcaacgtactggctgaaacgttcaatgtctgggcaatatccgttgccgagcgccattcgccctgagaagctaaaagattaattaacgccttttgtctttttgttagcacgttgactcccggcttcgctagatggtccagatgctcggtcattaccgttatatctgccttattccggtagagaaataccaaaccatggcgttgatatgaccataatagtgaacagtgcacctgctatgctgctaacccggttccattcatgcaacatagcgcttgtcgagaagcgtcaggatgagcgggcctgagcatcaggcccggaacggttaatgcccgccaaagactttttcaacttcttcgggtttatcatgtacgccaaagcgatcgactacggtttgtgtcgcagcgttcatgccacgaatgtctacatctgccccagcgcggcgaaatttaaccaccacgcgatcaagcgcattcacagaggtgatgtcccagaaatgagcatgggtgacgtcaatcaccaccttttccagcgtctcctgaacgtcaaaacagcgcacaaagcgatcggcggaggcaaaaaacacctgcccggtgacggtatagtgacggcactcgcctgttcgcactgaactgaccgccataaagcgcgccactttggtggcaaaatttaatgccgcaatcagcacgcccacgatgacgccaaatgcaagattgtgggtaaagaccaccactaacacggtggcaatcatcaccacactgcttgagagaggatgggtgcgcaaattcgccaccgaccgccaggaaaaggtgccgacagaaaccatgatcatgaccgcaaccagggccgccatcgggatctgagaaacccactggcgcaggaacaccaccatcaccagcaacgtaatgccggcagtcagcgtggaaagccttccgcgcccgcctgattttacattgatcaccgactgaccaatcatcgcgcaaccggccatcccgcccataaaagaggtgcaaatgttggcaatcccctgccctttgcattcccggtttttgtcgcccgtggtgtcggtcatgtcatcaatgatggtcgccgtcatcatcgactccagtaatcccacgatggcaaggcctgcggagtacggcaaaataatcagcaaggtattcaggttaaaaggcacatcgggcagcagaaaaaccggcaggctgtcaggcagcttgcccatatcgcccacggtgcggacatccagatgcagcagcagtgaggccgcggtcagtatcacaatacagatcagcggagaaggcagggttttatcgaccaggggatacagataaataatcgccaggcccgcagcggtgagcgcataaacatgccagcttacatgggtaagctccggcaactgggccagaaaaatcagaatggccagcgcattaacgaagcccgttaccaccgagcgcgacacatagcgcatcagatttccgagtttgcaataacccgcaatcacctgaagtacgccggtgagcaacgacgccgccagcaaatacgccagcccatgctctttaaccagcgtaaccataagcagcgccatcgcgccggtggacgaagaaatcatcgccggacgcccgccaaaaaaggcgataaccaccgggatacagaatgcggaatagagaccgacctggggatcgacaccggcgatggcagaaaaggcgatcgcttcaggaatcagcgcgagcgcgacaacaataccggccagtacgtcaccacggacgttccccagccagtcctttctcgtcgaggacagcaacatagtattttctcaaattttggatgcagttaacccataagggcagatttcagacagacagaatcacatccacagacgggatgttagtgatgcgcgtccggacaggttcaggacggcaaaggagggggaaaactcagggcggcgtaatacgcataatgattaaaaactccttatcagcatgggctggctgcagcaaggatctgcagtcacattgccatcagtcatgtcaggcaatgccccgttcagggagatactctacacaaaaaatcacccgcactgaaagccaaaatttaccttaacgccggaaaaacacggggaagccgcaggtaaaattcccgataagccgttgtaaaaataatgtttattaatgttgaaaacggtgcctgccacagggccattttcatcggcaaggcaaagcaaggcatgagtgagcggttagtctgaggtgacaaaccgctctgacgcgcagctacaccctgaaggcttcaaccatcccacgtaacgaatgtgcctgttcagacagggattgcgaagcagatgaagactcttcaaccagcgcggcgttgttctgggtgacgccatccatctgactgacggcaatactgacctgagaaatcccctgcatctgctccgacgaggccattgaaatctcgtccattgcccccgcaagctcgttcaccatgccaacgacttttaatatgctttctccggtgcccgccgccacatgcacgccgctgtccacctgctctacggcgcgttcgataagttccttgatctcttttgctgcggtggcactgcgctgcgccagtgttctgacctcgcctgcaacaacggcaaacccgcgcccttcttcacccgcacgggcggcttcaaccgctgcgtttaacgccaaaatattggtctgaaacgcgatgctttcaatcacacccgtgatgtcgcgaactttggtcgcgctgagcgcgatttcattcatggtgtgggacattaactgcacttctgactcaccggtgcgggccagcatcgctgcatctctggccacggtagcggtatgttgagcgctggcggtgttacttttcaccgtcgcagtaagctgttccatactggccgccgtttcctgcagggcggcggcctgctgttcggtgcgtgatgacagttcagtgttgccctgtgcaatttcgtcggaggcggatgctaccgatcccgccgattctttaatttgcgtaaccaggcttcgcaggctggtttgcatgttcgcgagtgaggccagcaggctggtggaatcattatggcgcaaggtgaccggggccgtgagatcaccactggcaatggcggcagacagcgcctgcgcctgcgcgggttcgccgcccaactgacgcattaacacgcaggtgatgatgtaacccgccgccacggaaaccgcaacggaaagcgaggcaaggatcattaaaatcaacgttgctttgcggacgttctgactggtgctttccaccgactgctcactgtcctccatttgaatattggtcatctcctttaacgcgtccagcaactggccctgcaacggcctgacggttttaatgagataggttaccgattcctgctgtttgttttgcaaccccagctgtcccgcgtgctccagggccgccagaacagggccttcgctgctcacgattttatcgaaggcttctctggcctgcggggttgaatcttttgcgaccatggcggcaagccgctcccggttatcgatatagcgggctttttgcgtaacgatgcgctgccattctttttgcatctgatcggcttcgttgagtagtgcaaggttacgcacaatcaccgccatatcgcgtaacccaccgtacatatccatacccagacggtatttcttcattttgacattgacggcatcatccatgccgtcacgggcattattcaggccagtgtaggccaccgatgtgcatataataaacagcgtaattaacagcccaaagctgatagtcaggcgcgtagagattttcatttggagtccctgtttatggtgaaaaacaggtatcggttaaattaaaaaaaaccccagtaaaaaaagcattaataataattatagaataacaacccactgataattatgattttttcttaatttataaaaaagtttgacggatgtgattttataaactaataagatgtaataaataaacatatttacaaacaacaaatttattaaaaatagtttacccgcatgctttcagtgcagaaaaaataatatcaaactcatttctgcagcataatcgttcggtttgccgcgctcattaccgcgatttgcactgccggtggcgtctgaacggtcaggtagcccctcagcaccgcaggatgtcgtaccagcaaaagaggaagataagcccgcatcagcacatgaaaacggcaggctctgttgaccccacggcatcatcttacctaagcgttatggcacaggttgttattgttgggtcggcccacaaggtaaagggctcgcagggtaccagccgtgcgtcacgcctctcttttgacggtagagagacgaacgtaacgtgttatcactttaatttttgcgtgggcgcatgctagcatgctttataaatattactttgaaatacacgctgtaattaaacgcgcgcattatcggcatggcttattaaaactttaatattttttatttttttagatcgccaagcgtatttataaatcaccaccaacccaatacctatttatgattagtagaataacgctgataaaaaccgttaatttggcttaaccccatccaaaagaaaatattgtgcatttcgatcatggaaaataacacgacgcattctataatactcttcactatggaaagtagaatctcccccgcgtgtttaaacaggcacattacgcctgcttttttagacgcaaccccatgataaatatgcattcttgtatcagattataaaaagactaaaaaaataatttttgatgatcttcatcaaaagacaccatttcacctggaattcaataaatgaaaaatattctcgataaaatcagtctaccgacaaaattcctgatactgggaatttttgccttggttttatttgccttaccaacctatttatttatccagacgggtaatcaggccatcgatgctaagaaacaagagctgcagggcgtaccggtcgaaaaagagatcctgactttacttaacctgattcaacgtcaccgcgctgaaagtgctattgctatttcactgaataaatatgataacgccccacgcctggaacttgccgctcagatagatgcgcagagtacgaaaatcgccgctgagttacatcagtatgatactcatgcccagccgacacagcgttttgatgaggtcaaaacagcctggtcgcagcttcagcaagacgtctcgtctggcaaactgacactcgccaccagtctgtcacgccatgctcaggtgattcagaacttactggacactaatcaagatattctggatctgtatggcctttctttagatgcagacctgaatacttatcaacttattatgagtatatatggcaggttgcctgagttaactgaaacccttggacgcatcagggccgcggggacatccgtgattgcagcgggtgataaagcatcagaatccgcacgcggtgctatggaataccagattgacggtggcaaagcggcgctggaaaaattcagcaacgtattgaataaagcgtttgccgtcgagccggatttaaaatcggaattcagcccaatcgccgttgatgcttaccaacgttcagcgaacgtccttaacatggccgatggcgtgtttattgcaaaaaatgttcaaattaccccagtagagtatgtaaaagcgtttacccaggccatcaacacctataacgatcttggcgttaaactgagcctgcaactgggcaaaacacttaacgaccaaatcgatcagcgtcgtcagtcacaatatatcttgttggccgcactgctggccgttgcgttactggcaatatttgtggcggtgatgattagtcgttccgttacccgcccggttaaagaagccgtttcgcttgccagtaaagtggctgcaggtgatttaacaactgcgataaccgtgtcgggtaaaaatgagattgctgaattactgaatgcgctggcacaaatgcagcagcgtctttctcatctggtgtcgaatatcaaaaataacgcgtcaaccattgcacattcctctgaggaaattgcgatgggtaataacgatctgtcttcccgcactgaagaacaggcggcttcactggcagaaacggccgccagcatggaacagctttcttccatcattaagcaaaatgcggataacacgcgctacgcgtctgatatggcggtatccgcaaccagcgctgccctgaagagcggcgaagcgatgacctccgttatggcgacaatgcagaaaattcgcagcagttcaggacaaatcgaagaaatcacctcagtgatcgacagtattgccttccagacaaatatcctggcgctcaacgcggctgttgaagccgcgcgcgcgggcgaactgggcaaaggttttgccgtcgtcgccgctgaggtgcgggcacttgcacagcgttctgccagcgcagcgaaagagatcaaaggcttgatcgagcaatccgttgtgcaatcgaatgaaggtttaacgctggcgcaggacgcaggcagcaaagtgaaacaaagtgttgaggcgattgaacaaacctcccagttgatccgcgatatttcatcgtcttctgaagagcaaagcagcggcgtgagccagattaatattgcggtcaatcagatggatcaggtgacacagcaaaacgccgtcctggttgaacagtcagcctcttctgcggatgaactggcaaaacgagccggtgatttgcgcgatatggtgtctgtattccgtacggcttaaaggcgtctctctttacactgccgcccgcgttttacccacgcgcgggcaattggttaaccattgcccggcagagtccgggcaaattttatcgacagaaatacgcaaatcgcacagatgatgaattgaatgataaccgaaagaaacttattctgttggccgtaaaaaacacaagaccagtcaacggtgagcctgccgcgcattaacatcaggggaacggcatcgtcacagtcgggacggtggattctcattttgatgctgagcacctatccgccgggctaacctgtgctaaccttgcggtctcagaatcgccattcggggagaatatgaataacgtttttgacgaaaaaatgacggatatcatcatcggtgagatggtgacgcagctactgaatgaggatgcggctatttcctggagcattctccttgagaggctgcagcagtttctggataccgagcaggatgaagtcaggcttcgtgcagccttgcgggccatggaggagatacgcgtagaaatgttttcccatcagtctgaaaacaacagttccgttgaaaccaatgtcactcaccttcatcaccttcactaagtcttgcgcgacgcgacggatgccccttttagccgtcgtgcgtcgtgcgcccgatcagatgccattaacgttaccaacatgattacagcgctaacccagcagccccttctctggctgacagaggtcagatgagcgacgacaccgcatctgaagatatctacaccgttattggcaggatagtcgcccgtctgcttaaaccggatggcgaagtccatctgcaggatatactgcgttcgctgcacagcttcagtgagcaaagcacagagcacgatgaaaagagagcgtgccaggaggcgattcgcttgctctcaaaacagcttcactgatttttaatttgcccttacctactggggatgccgggcagtcactgtcgcaaacccggctctcaacatcgctgtttcacgtaggtctgccctgcggtgaaaggcgtttatggctgttcgtctgaaggtgtacgccctaccacgatctccagacagctacgaagcacatccagttgtacaacgtcttctgtacactccagttcggcgattaaactgataataatggctttgctggtgactttttgcccgtggatgacaatattacgaatcactgcatccagcactgcactttcagcctgaagtttgtcgcccgcactgcgaaagaggcgcataatttccacttcagtcgtgctttgctgaatgtcgatgttgttctgcatgatgagtcttcttatcagtctcagtttagggtgaacacatcataaccctcgccagttgggcgaagtggggatgtgcttgtcctgagtagtctttattgaaactactcttgggtaagtaacaggttttttatgagaagggatcagccatcatcaatgcttgcggcgactgtcagaaacgctctgaccaaatgccagaacggcagactccatcggatcgcgcgcagaagcaaattcacttcgcacttcagcaagcgcgacctcaatcgcctcgcgccgtgctgcatttgcttcattcaccagcatagacttcagtctgttagcgagcgtggcaccactgattttgtcattactgtccagtagcgcagtcaccgcctcgcccatcactatctcggtgagtttctcaagtttatctttctgcatacccgcatctctgatgacattgtgccctctaaaaacgggcaacccagcctcaaacgctcaggcctctaatgacctgcttttttggccgttcagattaatgctgcgggacgttgtaatcggttaacgcaacgcggcactcatttcagcggtcaaaaagcatgccgataagtttttgataatgctgctcttcctgcgggccggtcgactggctgaggcgacggataagcgagctgcagatggccttacgattaaggctcttaccggcgtgcagtatctcaagaataacctgacccagtgtttctttttcagaaggctgcgtgtcgttgccaaaataacgggcaatatcacgtacggtgttcgacgtagtttcgttctgacgcatgttaaacctccagatgtgaaagtgagtaaactctaaccaagccttggtcactaaacttatacaacatctgtaaaattgtacaggaattctgggtggccgctgcacgctgaatggtgcaaaaagtgctatgccatttataacagtcacttgcgtgagtatcagatccttaactttttcgccccgcatccatcctgacgccgatcttgtacatgacgaggtgaaatctttgccccctttgtacacctttgctcaccacgttatctgtcttcgtcttcttcaggcctgagacgaatcacattttcatgcggcttaccgctttcgtcctggcttgcggccatcagccaacgcagtcctgaatctgaacgcacctgcgacagcctgaactgtttcagccagtggcgggcatcacaaatttccgccaacctactgtctcgggtttcctcttccgccatctggttaagttctgcgataagcgtatcgatacttatttctctgtcaccgagagcaaggctgaccacggcttcgccaagaataagatgacctttctcatcgtcgtgaaataacacgttctcctcctcacataacagattgatcatggctatatcatttattttagtggtgacatgacagatgacaaaatatttcctgacatcccgggaattattccatccacctgaatatcttacctttgagatgcattttttaactttatgaaaaataaaaaatttatagttttaaattttaataaacatcacgaaatagaataatcttaaacaggatctggtcagggtttaccgtgccagagccgatgccagaaggcttcgcagggtatctgctgttctgtcttcgcctgggcaggctgacaataaaagtcggttctgtattgtagcctgccctgctttattattttcgccagacaacctcttttataccgatataaaacgccagacaacccgaaaaatataaccctacagagtatgcgcgttagtgtttcaacggacagaagcatgatgaaaatcgccaaaaatacctggcctgctgacgggcctgttttttttagcctgtgaagtggcgggagaattaaggagacacaacagctcgccagccaggcgagatatccgccatgttaagggggatggtttgtcttggtttaggatcgccgtcgccacgtcgcggatcaaaaaaagtaagccgggcggctcctgtttttcttttcagcgggatcggtaattctcctgtacagtggtccccaggatcggttaagttgcgcacaactctttctactttgttctaaggaacactatgcgccagggcagtttgccacctgcggaaaaaactaacggtttggcacactatttcaacaagattgatcatccacgccagcttgaaaccctggggaggatagccgttgaaatacttcgcgagaataagcccgtcagtcgacgcatcatctgtctgaagcttatcggttgtcttgaaaaagccaccagtgaagatgacaggctgcactatcgtggacttctgaccctgctattcagtcagtaacgttgaaaacccccgcttttgatcaatcagcacgccggttataccgcgtctgcctgactctgaccttcgctcaacatcacatctgaacctgacttcaacgccgtagcgccctgctgccaggcctggtgcgatggttgacgtcccggacaggtgcatcctatccatgctgccagccaatgccttctcgctatcagagaagccgtttttttgctgtaacaccgataaaaaaatgcccgcacctcgttaaagggtcgggccggagttctcagggaaatcctaaatgacttccaaacagcgttatcaaattagttcaccatctggattgtcgccagtcggaatcagataatttttcttcatacctgaaacaggtctctaattttttgctgatatgtgccgtttgaacgctcaaaacccgttatacatcacacttttgcaaagtcttctcgacctcgctcaatgttctgttcagggcgtcgataacagtattgtgagttgattatcacaatgattgtcctgaccaaacgttgcttacttcggcacctttcacggtgccgttttttttgccgctatgatgccgggaaagggtaaacctggtgagcaatgctattgcgaggttgtcatatcccctcgccaccctgccagttaatgcgaaggcgtaagatagagggtttcaaaccgtgatgcgctaacaggggaaccggtttggttgccttgcaaaatatcgcatgctgccgcgcaaataaaatcgtgctgggcgcggttctcaacgccttctgctgctacgctgatccccatatttttacccagtgacgcgatagcgttgatcaataatcgggctttgttactgttctcaagctgaacagtaagggattgatcaattttaagtcccgcgatgcagcgatgctgtaacaggctgagcgaggcaaggctgcgaccaaagtgatcgatgataaataacgccccggtagcctgaacggcctctaacacctgagatgtactttcccctacatcggtaagcagcggttcatcgacttcgagatcgataaagcccgcgtcttctccggcacactgacgaatcacctcttcaagtccagcttccattagctgacgcggaaacaggttaatactgacgcgcagaggcagattttgactccgccattgtttaacctgactgacagcagactgaataatccatgttcccagggtgatggacagcgggcttttgatcagcatatcgatgaactcagagggaagcagcaggccacgggccggatgcatccagcgaaccagcgcttcacagcccattaactcgccattgaacacatcaaaacgcggttgataatgcagcacaaactgctgctggcgaacagcggcttccagttcacgttcaaaccgacgtcgacctaactcagcctcgcgaaattcaggctgaaacaggacagactgccctttgccacttgctttagcccgatacagcgccaaatccgcagccgacatcactgaagacatatcacttgcatgcaggggaaagcttgccacaccggtgcttgcgccgacctctaccgcagaacccatgtaataaaaaggtgtctggatagccgcagtgagccgctgggcaatatccattgcgccatcacagccacagggcagtaaaacgataaactcgtcgccccccaaacgggccgctgcgatagcgtgggtgcagactgcgcggatctgctccgccacatgacaaagcaaagcgtcacctgccgcatgaccgcgcgtgtcgttcacgtctttgaaactgtccaaatctgtcatcagcagcgtgtaaggcacaccggattccgtcagcttgctgagttgcgtcatgaaggcactccggctggcaagccgggtaagcatatccagtgaggccagttcgcagagtcgcgcttcgctttcatagcgtaacgtcacatcccgaatgatcatgccaatatagcgctcaaagccctcctgccagcccgaaaaagagacctccgctggaaactcctcgccgttgcatcgcttgccccaaatctgcaaggtacgcggcgtggagatcgcgccctcttcatgttcaagtcggtcaagctcattacggtaatcggtctgacagcgttcagggatcagcccggcgacgtatttaccggccatttcgtcagcgtcatagccaaacattttcgtcgcggcagggttccagaacgtgataccacggttcaaatcagtacagatgatcgcgtccggtgaggttaccgatatggcttcgaggcgctgctggctggcatggcgcaaaaccgacatgcgatgaacttccatgcggtccatgaccagtgcggccagatcggtcaggttgtggcgatccgttgtgctcattgcggggcggggatgattatcggtcaggcatagcgtaccaatacggtgcccgtctggcgtaatcagtgggacgccggcataaaaccgaataaagggataacccagcaccaacggactgtttgagaaacggggatcgtcgagcgcatcgggaacgcaaaggatatcgtcgctttccagcgtgtgatggcagaacgcgacgcttcgtgaggtttccgtaatttgcagaccatagcgagacttaaaaaactgacgtttctcatcaatcagcgacacgaaggccaccggcacacagaacaatctggccgccagaatagtcagtcgatcaaaggcttcattgggcggcgtgtccatcagttggtactgtgccaacgcacgtatgcgtgcttcttcggagccgctttcagttgagtgcttcagagtgtgtcctcctgaggtcatatactgtggccgggcatctcacagtaaaaagaggacgcctgcaatcagacagaaccaggtaacgcgcaatacatcaacctgaagccgcaacaaaggtccgcctgtgcagcaaaatgtcggttatcagaaacctgcactgatagcgacacctgctcttacatagtgcccggtattgcagttatcgtccgttcaggcctgaacttcatagccagagacggctttactctgtcaaacggtaaaaatcgctattttttgtcttgcggcaccagttcatagtgaggatgacgccctgccagcagcagcagcagttcgtactccccttgactcagcaaggccaccttccccgtagcttctttggtctgccaggcgcgcaaactcagatcaaagcgttcagcggcaccttcctgcgacaggccggcagcaattcgcagttcacgaacattattctggacgggcacgggccgtcggacgattgaatttcccaaaccaggctccctgtggatgaagtagggtaacagtacgtcagccgatcagttcagtgtcggctgagacctctgtctgcaaccgttgcagcacacctttcataaggatttttaatcttatctgctgaaatgtcaaaccagcggcttcgcctgcttcgggattatatgcctgtaaaaaaaacgtctgatcggcagcgcttattttttattaagtgaagcgtcgatatatttaaatgactcaaagttttaggttttattttacgctgcatttatgtaagtaaatatttattaaggattaatgaatttacgggcaacaaaaaaccccgctttagccgcgaggttttaaaaaacacagcaggaaacgggtccgcctgctgcctataaccagcccatcagtgcgtttatatctgatgagacagacgtcgattatctgccaaacgccacccaggcctcatcgtctttggtcggtacagacgcgatatgacgctttgccggaacgggcttagcgacgacaacactggccgctgacgacgcgggtaaggtaaaccgggttatcacgctggtgagcgtttccgtctggttactcatactctctgccgacgccgagatcttctgtaccaacgtactgttttgctgcgtcacgcggtcaatctcagccacggcaagcgtcacctgagaaatgcccttgctttgctcttccgatgccagcgcgatctggctgatgagctcgttaacgctgcccacgctgcgcagcacctcttccatcgtgcttccggcgctgtcagccgcaccgcgcccttcgccgatgcgcgctaccgtattgccaattaacccttcaatctctttcgccgcttctgcgctgcgctgtgccagtgagcgaacttcactggcgacaaccgcaaacccgcgcccctgctcaccggcacgtgcagcttcaaccgccgcgttgagcgccagaatgttggtctggaacgcaataccgttgatggtggcagtaaactggcggattttctcagcgccttcagcaagcacacccatagcggtcaccacggttttcaccaactgctcacctttctgggtcgtctgggcggtaacacttgccagctcacgcgcctcacgactgttttcagcattgtggcgaacggtcgccgtaagctgctccatactcgccgccgtctcctccagcgccgccgcttgggtggccgttctgttcgacagatcggcattgcctttcgcaatatcgcccgcctcaaaatgtaaaacggacgcgttatcacgaatagcctggacggtattcaacagactttgttgcatttcttttaataaaggaaccattagcccgatacaattcttacccaggtcctcgggttcacgtgtcagatcaccatcagcaatcacgcggaagtgcgcccgcagttttgctaccggccgcaccagatggatgacaagatagcgatcgcaaaaaatgagcagcgcagcgaccgcagcgagcgtaatcagaaacagattcaccagccgctgatgttcctcacgcagcggggccgcattagcagaaagctgctgctcaagcgcggcaagccgttcctgagccgccgcagggtaatcctgaggcgcgctggtcagagcggtgcgataacgttgccattcatcacccgccggtgcctgagaagcaatgtccgcatggttcgccgtggcgttcgtctgcacttgcacactggcacggttaaggaaaataagctgttgagtcagggcattactgcggctggcttcgcggtcaatgtcgtttattatccgtgaaccatacgcgccggctaacgcaataatcattacggcagcgataagtatccacaggacaacacgtctaatcgtaaaattttttagaatattcatggtatttccccagtgttgcgacgtaaaaaaaacacttcaataaaatattcacatctaatagttgcgggcaaaacaatagcgcgctactcttctgaggttattgtggcagcgttattgaaaaaatagaattaaaaatttgattaaatgtttgcatcgttgataactgataaattcattaaagaaaataaaaagagacagaaatccaaatcacgcctattattcagcgagaaaaaaaactattttaattttcctttcgctgaatctggccttgttccggtgctttttatccgccactttttctttttaatttcgcgccgtgagcaatccggggcggaggacacacatgcttatgaatctcgacggtgatcatgaacgccgcactcgtgcccttgaggcccttcgctaccccgatgaaagtcgggatgatgtgctgagaaaatttgtcaggcttgccagtcaggcactgagcattcccggaagctttatttcggttattgatgatgaatttcagtatattcgtgctgcgcacaattttaagctggagcgttcctcccgcgaggattcgctatgtcgctatgccgtggacagcgattctccggtggttgtgccggatacgtacctcgacagccgattcgcgcaacatcccctgatcattggtgcgccctttattcgtttttatgcgggtgtgccgcttaaaaaccgcgacggcatcaatttgggcacgctgtgcgtgacagatattcagcctcatccttttacgcctgcacaaatcaccacgctgacgctactgtcgtcgttggtcatgtcttttctggaagcatggcactcggcaggatttatcgatccggtgacaaatctgccgaatcgccagcgcctgatccgcgacatgcattatctgactgctgccggtgacaccacattgcgtcgcctggtgctgattgactgtattgatatgccacgcgcctatgaactggcgcgctcaatgggcatgagtcctgttgaaagcctgcttaaagatgtggcgacgctgctgccattgcggctgcgccccgctgccagcgatattctttatactgtggcgactggacgatttgccgtgttgacccgggcggacagccgcatcagtgcaaactgggtggcctgccagatggagggcatcagtgcggacctgggggaaggtctgtcagtggcgctgagtacccataccggtgaagtcgattttgtctccggtatctttcctccccacgagacgttacgccaggcggtcagtgccttgcacgaagcgatcgatcgcggattaccctctttgcgctttagcgaagccacagacagcaggcgtacccaggacttcacgctggtgaacgatctggcgagagcgcttcgggaaaataatgggctgtatctggtttaccagcccaaaatttgcctgcaaagcggcaaacctatcgggcttgaggcgctgattcgctggcgccatcctgtgcaaggtgaactcgcacccgcaacgtttatcccgcttgccgagcagacggagatccttacggcccttaccacatgggtgatagatagcgtgattgcgcgtctgaaacgtctgcgtaacagctgcatccagctgccaatcacgattaacgtaagtgagcgtgatttctcgattgatggctttgcagacgtgctggaagagaagatgctgagggcaaaactgccgacctcgctgttggggatcgaatgccttgaaacagaacgcatcgtggagagcccttccgctatgcgcgggcttgaaatgctgaaactgcgcggcttcggcatttcacttgatgatttcggcacgggctacagcaatatcagctatcttcgccgtatgccgctggatgtgattaagctggaccggtcactgatcagtgagctgtcgtcggatacggcttcacgcatcatcgcccgcaatattatcgcaatgcttaaagagctggattatgtggtgttggctgaaggcgtggaatgcgtcgataccgtcgaggcattgacggaatatggctgcgaccaggcgcagggctttttctactcccgaccgctggcagacagcgaactggatcactggctgcactggaaaatgcgtgagatgtgctgagagaccgcatccgggtcagacagcaggatagcgagaaatatcgccttcgtggctgaccatcacccggttacggccatcatctttggccgcatataacgcttcatctgcccgccttaacaacgactctttatcatccgtatcgctcagcgttgccacgccgagagagacggtcatcgcgctgataaacggaaatgacgtcatactgacggcctcacggatacgttctgccatggcagccgcatcgctcagtgcagtgccgggaagcagcaaaataaactcttcgccgccaaagcggctcaccacatccagcgtgctgcatcgcttacgcagcaggcctgccaggcttactaacacctcatccccggcatcatgcccgtagcgatcgttgatctttttaaagtgatcgatatcgatcgcgatggcgctttgcacccgctcctcactgtgctgttccgcctggacataaaagccacgacggttattcagtccggtcagcggatcggtcatggctttatcattcagatcggcaacgtgcccagcaacggcctgacggtgttgctgaaccgcctctcttaacctgtccgcttcgttataccaggtgttgaccgatgacagcagttccgggctggcatcgctgccgccctcgcgaaccataccggccagtttttccagcggataagagatacgcgccgccagaaaagccatgcagctcgccgtgaggacgatgatgcccaggataaaccagaatgcgtttctggccgtatgtatcatcaggctactcacggtttctgacgtaccggacataaagatattccagtcggttttttgcaggctggcgtagccaataaggtattttttgcccgcgtcctcaatcataaactgaccatttgaggttgaagccagtcgtttttgcagttgcgggctcaatgccattcgggtgccaaccaaagcaggatcgtgactgaaaataacgaaaccgtcatcactgacaatactcactgaggtgccatcaccgtaataatgctggctcaggacatcacttaacatgctctgtttttttaggtaaatggtgccacagataaaaccgagataatgcccatctgtcgaaaacaggggctgggaaagcagcacgacgtaatttcccgaaggagaattaaagggtgaggaaataaaaggtttccgggccgcgattgcctgctctgtctctggggtatccacctttacgcccatcagactcaggctttcaggcgaaacagaggcgatgacggcatgacgatccaacaccgccaccgaattgaaaaaaccggactgctggaataaacgcgtcgtttcgcgatgcagcttgccgacatcattaagatcgacgatctgactggcactccatgccagctctcgctgggcaatggtcaggtaatgatcggttgtatccgccagcttacgcgcataggcgatattgctgtcgagcagtgactcttcgatattattcttctgaaacagaaacaacgcgcccagcagcagacctgacgtcagtatgacgcttccgatggatagtccggtaaggagcgttcttagatatatttttctgcgatacatatcgggttgcgctgagagtgagttaaacaaattttaaccgcctctgcgccagacaaacgcgagaataaacgccagattacttgtctttagtgctgaatgacgttacgcattgctgtaaaagcagcctgatactcttttttttgtgtcgtgcagcatttccgcgtcgtgaaggtgtaatctgggccagcggttacccaggcttttgggggattatcgttgccagatgtcctaaccggataacctctctggcgacgtctcattccccttattgataaccggaatcatccgatcaccgcacggttgcctgtggttttctatgcgctaataatgttcaacacgtaaaacagaccccgaggaagaccatgatgaaaagcgctgttcttagcatgctggccaagatttcaaaaatggatgccgaaactaaagaactggttgctcagacagaagcgcagtcactgttgctcagcgcgttgacgctgaccgttggcaaaagtggcggtgttgaagagctgatttcggcgatcagtcaggcaattaataccgtgctggagtcctctgacggcctgattaaatctgacgcggagcttctgctgaccaaatttcaggaacagctcacgctgacgcgtctggtcgatgaagagtcaaaagagtttctgaaaggcgtgtcccataagtctctttcctccgtctcgaataatgaaaaaattaccgactgctagccacgtcttctgacggcgaggcattaagcgcgtctgcctgttttttattgtgacgcacgtggtatggtaattatttgcctctacgaggacaaggtttgatgaaaaaacagcgagttggcattgtgttcggtgggaaatcgtctgagcatgaagtgtcattgcagtcggctaaaaatattgttgatgccatagataaaacccggtttgaggttgtgctgctgggtatagataagcaaggccagtggcatcttaacgatgcctcaaactttctgctaaatgctgaaaatccctcgctgattgccctgaatcgcaccgcaaaacacgttgcactcatccccggtgaacctcaacatccactgatttcccgtgataatgcccatcccctgtcccaacttgacgttatttttccggtggtccacgggacgcaaggtgaagatggctcgctgcagggattgctgcggatggcctcgctgcctttcgtcggatctgacgtgttgggttctgccgtcagcatggataaagacgtcaccaagcgcctgctgcgggatgccggtctaaaggttgcgccctggctgagcgtgacgcagtcacagaggcatcatctggacaccgaggctgtcatcgaacgctttgggctgccgctgtttatcaagccagccaatcagggatcgtccgtgggcgtcagtaaggttgatacggcggcagagttactcccggccctggaactggcctttacctttgatcgtaaagttttgatagagaaagggattaaaggtcgcgagatcgaatgcgcagtgctgggcaatgacaagccagaagccagcccctgtggcgaagtggtggtaaaggatgctttttattcttacgacaccaaatacatcagcgaaaccggcgcacaaacggtgataccggctgacattcctgctgctgttgatgatgcgattcgtcaggtggctctcaccgctttcaccgcgctggagtgttttggtatggcgcgcgttgacgtgttctacaccgatgacggtgagattatcgtcaatgaggtgaataccttacccggtttcaccaatatcagcatgtatccaaaactgtggcaggcggcgggcctgagctaccaggatctgatcacccgtctgattgagctggcgctggaacgccatcaacaaggcgcagcgctgaaaaccaccgtcaattaatcgcctccagcggcgtctgctcaggcaacgtcgctggtaacttcgctttgcgtattgcagggggacgtctgattgcggccatttcgcttagagatatagaggtttttatccgcggcggatatcaggcggttgaccgtctcggcccaggcgttacccggttgtgcctggccgtttgccagccccaggctgacggtgacggtgaccgcgttgccgtgcagtaaaaatttctctttgacgatgctctggcgaatcccctcggccagcgaataaatcatttctggcgacaggtcgaactgcacaatcacaaactcttcccccccaaaacgacagatatggccgtgattacccactaatggcgaaatacgccgggcgatctcttcaaggacacggtcaccggcatcatgaccaaaattgtcgttgaccgatttaaaataatccacatccagcaggatgacgcccaccttacgttgctcaaagaagggttcattgcgcagatgttcatacagccccgaacgcgacaggagctgggtgagaaaatcgtagtcagcacgcagcgccagacgttcattgagctggcgaatcgcatccatgctcaccgccacgattaacgggctcatgacgatagtggccacgcccagacgcgctgaggtcaggtggctgatcggcagcaggttggcatcgccctgaatgttcatgacgccgtgcgacaccaacacgatttggctaatgccggttatcagcgtgatcagcgtggtcaggggaaccggtaagacaatggcgcaccagattaatgcgggcaccgggagcgtgaggctgcccgcgccgcccattaatgcccccgtgatcagggacaacaccacggcgattaacgggacaagtttgcccagttgcagcaagcgccttgagagcatgacgcgccagtgtgacgttaacagaaacggcagcagcattaacgccgtggaaaactgctcgctgaaccagttcatccacgcgtcagcaaaggccgcgttaatgctgcctacctgcgccagtcctccccaggtggcgcaaccgagcgccgccaacaaacaggcagggaaaatacgcagtgcgttcgatatgcgctcactgctggaatcatgctgatactgccgccccatcaccatcacgcaaatgatgataaacaggatattggccacattcagcgtgaaggccggtaacgcccagcccgaaaacaccgcgtcgttaaataccatggcgctgtagcacaccagataaaaacgggctcgatgaagaaagggatagcgaagcatcatcccggcgatgaaggcattcaccggccagaacagggataagtcatggggaaaacgcagatgtccgccgacaaaacagaacatcagagtaatcataaacagccagagggcactctttttagtattgtgctcttcaaacagcttaacgcgcatacgtctggaccttgtcacaaagaggcttaccatcacgccgctcacggggtatatggcgttatgatcatttaaccctgattcttgtctgcgccattcagagaaaagcacccgtaaatgcgcgaacgttacgggtttaacacccgatacgagatataaacatactggcagacatccttgctcattatgtcttacaaataaaaaaatcggatatccgagatatccgattttaaaaaaaaacgacctggctgttgaggtctgcgtgactatttaaccgccacgggccactgactcaggcggattccccgtttatcagcattatcaccaaaatccttcagcacggccttaacatctggatcgatgtattctgcattatcgttatctacgattaccacgctattttcgggtatttcatccagcaagccctgcagtctaggattgtgcataaaagtcaggttttgctggaaacgcaaaacgtagtggtcgtcgtaacgcgtaagctgcagcgcattgcggtgactcttgtagatgctatagagaatctgtgtcgcaataccaatcccaatcccgaccagcatgcccagcgtgatgatcccgataatcgttgccaggaaaggcacgtactgttgtgcccccatacggaactgctcgataaacaggcgcggcgcggccagtttatagccggtgtacaacagcaccgccgccaggctggccaacggaatggcattcagcatttcactaaaccacatcccacaaatcagcagcatgacaccgtgcagcaagatagagagtttggtttgtgcgccagcgttgacgttggctgaactccggacaatgaccgccgtaatcggcatagccccaaggaagcccgccgtcaggttaccgatcccctgcgcaaacatctctctgtttggcgagggcgcagggttttgcgggcgcagctttttcagggcttcctggctcagcagggtttccagactggccaccagcgccagggtcagggcaacgatccagacctgcggattttgccatgccatccagtccggggtttccagctccgccatcatggcggaaacgctgtcaaacgcgggcaatgaaatgcgcggtaaagcgccggtgagctcagggaacaaacgtgcgccagcgaccgtgaccacacagccaaacagcacggcgaataatggcccgggtatccacgccagcgccttgatgcgcttaatggggccggttgtccatataaacagaatgaacaagcccactaacgacaccagcagcgccgacagcgagaacgtcatttctccgttcaccagcgacactaacttcacgctgccgcccgcccccagcgccaccggtatctgctgcataatcagcagtaaaccaatcgcggccagcatgcctttgataacgctacccggcactaacgcgatgaagcgtccggcgcgcaacagaccaaacaggcactgtaacagtccggcgataatcagggcggtcaggaaggcggagaagctgcccagggtcgccatagacgcgacgacgatggtgaccagtcctgcggccggtccgctgacggcgaaacgtgaaggactgagggaggtaacgagtattccgccaataacgcccgttaataacccggcgaaaggcggcagcccgctggcctgtgcaatacccaggcagagcggcagtgcgaccagaaacacaaccagccctgccggcacatcgcggcgtaaggtatccagattcatggtgaagactcctctgcagattgctgaatcaactctttcagatgacccgattgcaggtcgtaaacacagccaaacacgtcaagttcctgaccagactgccaggcctgccgtaccggttctgttgccaccaggttggcgaactgcaccagaacatttgcttcaaccagacgattaagcatctcgctctccgtctcctgcccggcttcgtggctaagatggcgttctaatccactacgcagaaaggcaatacgccgggccagagcggagtcctcagtggctaacgggctgcccggcagggctaaggcagcctgaacgccaccgcagccgtaatgaccactcaacacgattcgctttaccccaaggtaaaaaacggcatattgcagcacgctcagcaggttatcgtcctctgccacaaccatattggcgatattacgatgaacaaacagttcgccgggatgcgatcccgttaatacctccgctggcacccggctgtctgaacaacctatccataatgagtgcggtttttgctgatataaggatttttcaaaataggcggggttacgctggcggcgctgtaatgcccaactgcgatttttcgctaataagggtttaagtgtcgtcacaatcatcttctctctacgaccgggaatatcacttcctggctgaccacggagtgaacccgctcactgaatcgccgcgaacgggttacgaaatctgaagctcatcacattaataggttatagcggcttatgattactaatgcacacagaatattttatgccagaaacatccggcgctatatgtcagtattttttcaataaacgtcatgatcacgtaaattaccttaagaggtcataccacatacacattaaattactttaattattttatataaaaatcatataattaaaaataaagccgaaaaatgaaaactgacaaataaatacaaaaccgttgtcgttagtcagatggataaaaaagaaacaaggcgaaatgccaggattactcttaaatgcagaatttatgaatagcacgatcaaccgcctttattctgtataagcagttaatcgaactttgttaagggtgaaattaaagcaagagatggttaatttaatttgcgtgaaaataatgacggcggtaagtaaataatctcggcggcgagaaagagcctgcccacggcaggctcatcatattgacactttatttaccgttccaggccctcagccgcgcttcacggactgaaagctgctgttcaggcgtcagcttattgtaattttctgccatgccgctctcccagtcaccgtaaagtgggtttggcaacacaatgaactgggtgccaaatcgcgcatgattattttcgacaaacccctgacgctgcgcgttaccctgatgccaggtcgccccgccaaaatcattcaggttgtcaccgatatacaacacgacgttgtagccggcgtttttaatcgcatcgaagcgtgcctgtttgtttgaagagtcggttttcaggctcaccgttttttcactgacaccgctgaagccaagctgctgaaggttggccactgtggcagcgtaatctttctggtcgcggttggagacatagaatacggtgccgccatgactgttaacatagcgggcaaactctaccgcaccaggcacggctttggcctgacgcgcctgcgtccaggccgaccaggttttatcgctgaaaggctgtccattcttcgcctgccatgcgctgtaggcgctgttatccagcatggtttcatctaaatcgacaatcaccgctttgggcttgcccaccagcgaagccgactgatcaaaggccagacgtgcactgttaaacgcctgccaactgagcgcctgatattcacctgactgctggaaccagtttaacgccagcaccgattgctgccccagttgctgttgtgcctgctgctgggaagggtgtgcacaacccgcaagcgccagcgcaaccacggccgacagcgcgaaattcactgaatttttcatcgattcatcctaaggtgtgaaagatttgagtgggtaacgcttcaaaaatgtagcagttaacgtaagctgatggcagcagattgcacgctgtcctgacaggagaagaggatgtccgccatgccgcgttcgccgttacttgatgcactcgactgggtcgattatgcttttcagcccgctggcgcgccgccgcctgaggatgcggcctacggtcatcaacgccacagcgccgttgtgttaaccgacatccataatatcccacctaaacgttgcgaatcagatggcgtgattgccacgggccatcggccggtagcggtgtacaccgcggactgtttacccgtgctgttcgccgacagccaacagcaacaggtcgccgccgttcatgctggcctgcaaggcacgctggcgggcgtactctatcgcgccgtggaacaactttgcgcacgcggtgccacgccgcagagcctgacggttgcgattggcccggcgctggcaccctgctgtttcgagctggatcgccagcgactggcagacattgtgcagttgcccggtattcccctgccgctgcgctattatcatcaacagccgcataatcctcaggcacagcgcccccaggccctggccacccgagaaggtatctggttcgatttaccgcatctggctaaacagatgctgaccgatgccggggttccggcggggcaaattgaccagattgaccagtgcacctactgcacaacagagtcggggtccagttatcgctttaatacgcaccacagcagcggctatcgttcgcgctattcatggattcgtcgacgctgaatccaacgtcatcggttatacctgccctgctccctcagccgacggtttggcacctgactgccccatcgggtatggccgcttttatgatgcttctcacaccctgatgccatttcacttttttttaacaaagaaatggttaaagctaactcatccgaccactttatctgtgagtgattatgactgcgctgtcctcccactatcctgctttgtttaccccgcttgatctcggtttcactcaactcagaaaccgttttttgatgggatcaatgcatacgggccttgaagagcgtgaagatggcgcggccaggctggcggcattctatggcgagcgggcacgggaaggcgtggcgctgatcgtaacgggcggcgtgtcaccgaatccgcagggcgtgaccgccgaacacggtgctgtactgaatgacgacgcacagtgtgactggcaccgacagattaccgcagcggtacatcagcatggggggaaaatcgccctgcagatattacacaccggtcgctacagctttcagcgcgatctggttgccccctctccgatacaggcccccatcaatcgctttaccccgcgtgaactgagcgatgccgaggttgaacagaccattgccgatttcgcccactgtgcccggctcgcccagaaggcgggctacgatggtgtggaaatcatgggttccgaaggctatctgattaaccagtttctggtgcagcataccaaccagcgccatgaccgctggggcggcgattttaccggacgcatgcagtttgccctggcgattacccgcgcggtacgcgcggcaaccggcgaccgctttatcattatcttccggctgtcgatgctggatttaattcaccacggcagcacgttagaagagaccctgcgactggccagcgagctggaaggctgcggtgtgacgctgtttaataccggtatcggctggcatgaggcgcgtattccgaccatcgccacctgcgttccccgcgccgcctttgcctgggtcacgcgtcgtttgcgtcagcatgtcgccgtgccggtggtggccaccaaccgtattaaccatccgcaggtcgccgagcaactgttgcaggagggctgtgcggacatggtttcgatggcgcgacctttcctggccgatgccgcctttgtcagcaaggcgcagcgcggggatgacaacagcatcaacacctgtatcgcctgtaatcaagcctgtctggaccagatttttgccggtcatgtcacttcatgtctggttaacccgcgcgcctgccatgaatccctgatgccggtgacaccagcgcaggcacctaaacggctggccgtcgtgggtgccgggccggcgggcatggcgtttgccttgcaggcggcagaacggggacatcaggtgacactttacgatgccgcgcacgacatcggcgggcagtttaatatcgctcgtcagatccccggcaaagaagagttcagcgaaaccctgcgctatttccgccatcgtctgcccgcggcgggcgtggtgatcaaaacaggctgtcgggtgaatgccgcgatgttagcggacgccgatgaagtcatccttgctaccggcatcaaaccgcgtacgcctgagattcccggcatacatcatcccagcgtgctgagctatctggatgtgctggcggataaacagccggtcggcgcgcgcgtggcgattattggcgctggcggtattggctttgatacggcggagtacctgtcacagccgccacagacggaaaccctggatgatttttatcgtgaatggggcatcgatcatagcctgacgcagcgtggtggtttggtcccccctgagccgcagcgctcgccacgtcaaatctggctgctccagcgcaagcctggcaaacccggtgcgacgctggcgaaaaccactggctggatacaccgcagcagcctgctgtcacgcggcgttgaaatgtggggcggtattgagtatctggcgattgacgatgaagggctacatattcatcgtgacggcgaacgtctggtgctggcggtggataacgtgattatctgcgccggtcaggagccgcaacgcgaactggaagcggccttaagggagagcggcaagccagtgcaggtgattggcggggccgatgtcgcacaggagctggatgctcgccgggcaatcgctcaggccaccgcgctggcgttaacgctttagttaacgcattttcacggcgcgcagcaccacaaattttttgttagaggccaccagcgtgcagttgccaaacagctttttcagcttgtggtgataatcaaggtgacggttgccgacaatgcgcagctcaccaccatattgcaggcagcgcttagcatcgcggaacatctgccaggccaggtggtcggtgacggcgtgctgctggtggaacggcggattgcacagtaccgcatgcaacgtatcagacggatagccactcagcacattgttcacctggaactggcagcgcgacagatcgtcggggcggttgacctcaacgtttaaccggctggacgccaccgccatataagactcatcaaggaaatgcacctcggcctcagggttctgcgccagcgccatcagcccgatcacgccattaccacagcccagatcgacgatttcgccgtcgatattttccggcagatgctgcataaacaagcgcgcaccgatatccagggatgaccgggaaaacacgttggcgtggttgtgaatctgataaggcgttccgtccagcggccagacgtgggtgagcgatttctcgcgcagttctggctgggtgaactggctgtaaatcacgcgcgctttttttacggccagcgaggttttggtttcaccgataatctgttcaaacagttgcagcgttgaggtatgaatctctttcgcgcgtcccgctgccagcacaacggtttcaggggtaatgacctgacgcaccgcgcgcaattgctgctccagaagggccagggttttcgggattttgatcaacaccagtgccggggcggcaggaagggccgccaggctgtcgaggaaatggacctcgctgtcatcctgttcattgaggcgcagattctggcgagtggcctgctgactcagccaggagtcactgatatgccacactggacgtgcattaagcgcgcaggttaatgcgccgaagctgtcgttaaaaattaacgccgggccagacggcaggctttgctgcaacagatattcatcagcggcatcccaggcttgtaacggactttcgtcacgcatctgcgggaaacgatgcaggatcagtgtgcgatcgttcagttcaagttggctcatgaattctccggcgtggtacactttggttgattttcgccccaaaaagggggcgcagtatactgtctttcgccgggaatctctaatgtcctcacttatctatcttcagggttatcctgagtccatccttgaacaggtgcagacactcatcgatcgtcagcggttaggcccggtgctacaacagcgctatcccgatatgcatgacgtaatgagtgataaggcgctgtacgactttacgctggcgctcaaaaaccgctatatgcgaaatgccccgccgattaacaaggtgatatgggataacaagattaaggtcatgaagcatgcgctgggcttgcacaccgccatatcacgcgtgcagggcggcaacctgaaggccaaagccgagatccgtatttcgacgtttttccgccaggcacccgaaccctttttacggatgatcgtggtgcatgagctggcgcacctgaaagagaaaaaccacgataaggcgttttatcagctctgctgccatatggaaccggactaccaccagctcgaatttgatgcgcgcctgtggatgaccgagcaggcgatgcgcggcaacgcggcttagagaaactgctgggctttctgaatcaggctggttttcgtcagcgcccccataaaacggcgctcctgcggattattcaacaccggcaggcgttccagcgttaccgccgcaaaggcttcccatccttcccgtatactttggttttgataggccaccgggaaatcttcgtccatgacgcattcaaccggtgagtccaggttaatctcctgcgccagcacccggcgtgaaatttcatgaatcgacaccacaccaagaaaagcccctgccgcattgatcacatacacatagcgctcacgcttcagggagctcaccgccagcgcctctcctaccgatgcctccggctggagcgctgcccccggaataatcagctcggcgatgcgcatattatcgaaatcatatttcgcttcagagcggttaaaatggtgagtaacgaccggataggtgctggccatttgcaggcgataaaccaccattgttgccagcacggaggcaatcatgaccggaaacagcaaactgctgttgagcgtcatttccagcaccatcagcatcgccatcaaaggagcctgactcaccgccgccagcacggccgccatgcccacggcggcgaacagcaagacgttgtgaaggggaagatgcagcgccacgccaccgagcgcgataaccatgcccagcagcgcaccgatgagtaaggacggcgtaaacagtccgcccacggcattggagcccacagagaggctggtcgccagcatttttaacaccagcaacagcagtaatcccgacagcagatactgccccgccattaccttgacgatcacttcatagccattgcccaaaatatcggtagagatcagcgccagcaggcccacggcgaatccccctgccccaagccgcaacggcaatgaggtgacccgactgaacagcattttagtacgtgcaatcaggcgaatcagaagcaaccccgccagcccggacagcaaaccgatcaggacagtaatcagcaggctgttgatatccatggtgaagctgacatccgccagcggataaagcgcatgacggaaccccatcgcccacatggtcattaccgccacggccgatgacaccaccagcgggatcagacgctgcagcgccgacatgccaaaggcaatctctgccacgaaaatagccgacgccagcggcgcatgataaaccgatgaaagaccggcggcggcggccatggcaacgacatcactgttttttaactgcaatgagcggggcaagacacgaccgattatgctgccacacagggcggcgagctggaccatcgggccttctttaccgattgaggcgccgctgccaatactggctatcgacgacagcgcccgaaaaagcgaggttttggtcggaacagcgtcaaggcgggcattaatcacttcgagatagtccgtttttacggtttgctgctgctcaatcgccaccgcataacgcaggaagaatcccgccagcaggccgccaacaccgaccagaaccggccagaatatccagggccagagatgcaacgactcggtgatatcgttgctgcgaccaaacagcaactgattgataaactcaatggtttcgcggaataacaaggtaactaacgacgccgcacagccaacgggaatggcaataagcaatgtggtccagtttagtgcgtgtttacttcctttcacctgcgctcccagtcttgtgcttaacgtgcgttatccagccatattattggaatggagatctcaggatcaacgtctggcgttgcttgcccggtttcagatgctactctgcggtttttacacatgcaggaggctaactgtgattcgctttgccattgtgggaaccaactggattacgcgtcagtttattgatgccgcacatgaaaccggccacatgacactctgtgccgtctattcgcgcagcccagagcaggcggaagcattccgtcatgactatccctgcgaccatctctttacgtcgctggaggccatggccgccagtcctgacatcgacgccgtgtatatcgccagccccaacgcactgcattgtcagcaggccatgctgtttatgtcacagggcaaacacgtcatttgcgaaaagccgctggcctccaatctgcaagaggttgaggcgataatcgcctgcgcctttagtcatcaggtggtgctgttcgaagcctttaaaaccgccagcttaccgaactttattcaactgcaacaggggctgccaaagcttggcacactccgcaaagcgctgctgaactattgccagtactcctctcgttatccccgttacctcaacggcgagcatcccaacaccttcgatccccgctggtcaaacgggtccattatggatattggctactattgtctggcgacggccgtcacgctgtggggcgaaccccagcaggtttttgcctctgccagcctgctggaaagcggcgtcgatgcgcacggcacggtgatcctgaattatggtcagtttgatgtcactattttgcattccaaggtgagtgacgccatgctggacagtgaaatccagggcgaagccggatcgctggtggttaaccggatcgccgagtgccagtcagtgacctttattccgcgtgaaggggataaacagaatctaagccagccgcagcatatcaacacgatgctgtatgaagcgcagacctttgtgcggctggttgaacagcgtcacgtcagtcatccggcactggagatttcccgcagcgtcgccagattactgaccgaaattcgacgccagacgggcgttgttttcccggccgatcggccctgaatgtaaatatttcaaaatatgacattcatcgattgattcctgaccaccaggcacgtaacttacccgcttgcaaaggggagtaacttgtaagctgattgatcgtcactacgttgcgcacgcatccggtcatcaggcaacccagaatcgattcctgagttgtaagtgagaccttgccggaaggcgaggtttgcttacactgaataagcggctgacgtcttctgacttcagccgtttttttatttttagacaggatacgattatgcaaactgtaggtacgccactcctctggggcagttttgcggttgtagtgcttatcatgctggcgattgacctgttcttacagggccgtcgcggttcgcaaaccatgacctttaaacaggctgccgtctggtcactgatttgggtgtccgtctcgctcctgttcagcgccgcgttttggtggtatctggaaggcaccgccggacgcgaagtggccaccagccaaaccctggcctttctgaccggctacgtgctggaaaaatccctcgcggtcgataacgtctttgtctggctgatgctgttcagctacttctctgtgcctgccaacctgcaacggcgcgtgctgatttacggtgtattaggcgctattgtgctgcgtaccatcatgatcttcgcgggtagctggctggtgacgcagtttagctgggtcctgtatatcttcggtgccttcctgctgtttaccggtatcaaaatggcgatggcaaaagaggatgatgcggcggtgggcgacaaaccggtggtgcgttggctgcgtaaacatctgcgcatgaccgacacgctggaaggggagaaattctttacccgtaagaacggcgtgctgtttgcgacaccgctgctgctggtgctgatcatggtcgaattaagtgatgtgatttttgccgtcgacagtatcccggcaatctttgccgtcaccaccgatccctttatcgttctgacctcaaacctgtttgcgattctgggtctgcgcgccatgtacttcctgctgtctaacgtggcagaacgcttttcgatgctgaaatatggcctggcgctcgtattggtgtttatcggtatcaagatgctgattgtcgatatttaccatattccggtagcgatatccctgggcgtggtgggcgtgatccttggctccaccctggtaatcaatgcctgggtaaatcacaagaacgataagaagcggctcaaccagtaatagtgcatccccgcccgcaaaggcggggatgtttcttcgtccgcgacaaaaagtggataaccagagtggttcgccacctgtcaccgcttttccagcagaatgaagtcagcgtgaacgcgctgtcgttctctttaatcacggcggtgtaaggtgtgactgaaggcggttacggcccggatgaaggctgcgcttctggtgtgatgaacctgcgccgaaacgttaaaggccgtggctacgggcaggtttatgcgtcgcaatgacggattgaatcaccgggaacgaaagagtgggaaaacgcttttggccggatgatgtagcctctgttctggagcctgctcagcacttcgctcacgccgtattcagccatttctttgaccggataaatgacgctctcaatttgcgggccgagatattgggtcagtccaaagctatcgaacgcgatgaccgacatggtatcgggcacacttcttcccagcgtttttaatgctctcaaaccgccggcacaggatcgctcaccacagtaaacaagggcggtaatctcaggatggcgcgtgaccagttcaagcgtggcctgctcgccaaaggcctgatcgtagctaccggacagaacatagcgggtatcccatgacggattgaccgtgcgtatcgcatcggcacagccctttacgcgagcgatggcactgcgacgcgattctggccccccgacgacggcaatataacggtgtccggccgtgatcagcttttgtgttgcttcaaacgcggcgtcgtagtgcccaaacgacacgcccgcgatgaccgaggtttccgcagcatcaagaagtgcaacgggtttgtcctgggtgtaatgcgttattttgtcgtcagccagatggcgaatataaagcaggaaaccatcacagttaatctcattaagcttgcgtaatgcgttctcttcttctgtggcatccgcactttctaacaccatcagcatcttaccgttggcattcacctgcttgtgcaccgcactcatcacggaaccaaaaaaaccagagatgttatctggcaccagcatccctatcaccccgctacttttacttaccagggagcgggcgctcaaatttggcgtatagctcagcgtcctgattgcgttttccacacgaacgcgggtttcttcttttactttttcaggctcattcagaacccgggtaaccgtaacccgggagacattcgcaagtcttgcaacatcaactatcgtgctcatggtgatccactatgaataaagcagtaatggtgaagaaacccgggttcatcgtacggagaatcaggacttatttctatacatttcaatcatttctttaatcagttcattcgccagcatggccgtcattaaatggtcttgcgcatgaaccatgaccagcgtaacagggactttcccttcgccctcatctaatccaattaattgggtttgtatcgcatgtgcccgtcccgctgcctcttttgaacgcatcaacgcggcgtcgcacgcctgccattcatgacgttttgcatgctgtaacgccatcatcgcttcgctcttactttctccggcgttcgtaatgatttccataacgaccagttcaatattcatttttaattatcccaggtggtattaacacgtcgtttcagtttcctgagcgagtaactgtttttcataggctttgaaaaacggtaaccagatcaggcatgaaatcgcaaaattagtcagcacaagtatgatcggcccgacagcccatccggcggcccagggggcacctaataaagccggtgtggtccagggaacgatagatatcggtttatccacaaatcccgacgccagcgcaaaccatgccacagtggcattgataagtggggcaccgacaaacggaatcagcatgacgggattcataataatcggcgaaccaaatatcaccggttcattaatgttaaaaaaggagggcacaatacttagcttgccgatagaacgtaaatgtgaagaacggctgcggatatacatcatgaccagtgccagcgttgaaccacatccgccgataacgatgtaaaaccgccagaacggatcgacaaagctgtttggcagtgcctgccccatttcaagcgccagttgattggcggcgatatttgccagccagaaaggttgcaataaatttgtgacaatagctgcaccatgaatcccacaaaaccacagcagatgcgagagcagtacacaaatcagaacggcggtcaggctgtctgaggcggtgaccaggggtttaaaaaccgccatgataagctcgggcaataacatgccggaaacgtgttgcagcagaagtgaaagcggataaagggtcgcgatcataatcaacacgggaaccagcagttcgaacgactgtgctattttttctggtacctgctccggcaagcgaatagtgaaatttttcgctttcaggagtcgcattaactcgatggaatagattgaggttaatagcgccgtaaagatccccgttccgcccatatacatggcgggaatatttccgttagtgaaaggcgcagcgacaatcagaaatgaacacaatgaaagtaacccgcccattaatggactgagtttatagccctgtgccaggttatagccaatccccacagcaacatagatcgtcatgatgcccatcgtcatgcgaaagggcagcatgatcgcttctttatggttggtggcaaattccagccacatttgcccgaaagcaaaggtcgtgtcccgggaaaaaggcggaaaggccagtatcatcagaaagctgcccacaatcataaatggcatggcagagataaacccatcacgcacagccagcacgtggcgctgcccaccgattttacctgcaacaggcgctatcttcttttcaatcattgaaataataacatcatacattttcatgagttacttcctcatattggcgtacgtttagccaagtaattcgagcgcaaactttaatacgttgtcacccttcatcattccgtaatccattggattaatagcttctacttttttatttttttcggcggctattttcctgaattcctcaagtttatatcgcacctgaggccccaacaggcagagatcataggtttcaatgctttcgttaaatttctccagtggaaaggcctcgatttcaatatcgatgttttgctctacggcagatgccttcattttttttacgagtatagaggtgctcatgcccgcattgcagcaaagaaagattcttttcattttattcatcctgatggttaattatttaaatttatattgttggaaatttgataaatagtttttatcgagttcaatgcccaagccgggattcatctcttcaacgacaaagtgaccgtctttaacgttatgttcaagcgcctcctggacaacccgataacgttcatcctgccagtaaggaaaccattcctgaatttgaacattggtggtacagatatcaaattgcacacaggcagccgttaaaacagggccagaagcattatgtggctggatggcaatttgataggtttctgcaaaggcagcgatttttttcatttcggtaaaaccgcctgccagtcccatatcgggctgaatcagttcgaagatacggttttcaatgaaaggcgcaaaatcataacgggtatataaacgctcaccaccggccagcggaatatccaccttgagtttgacttctgctgaggcgtttatcagcagcgtatcggtcggttcttcgtaaaaataaggagagaacgcttccagttgtttcccccatttaaccgcgtcggacacattcaggcagccatgaagatcgagcatgatatcaatgtcatcgccaacggcttcacgcaccgctttaacccttgcgatggccatatttccccatgctttgctgacgggacgatcgggcgtagacttttctcccgttggcgacattttaaagggatcaaatttcagccctttatagccctcgtttaccacccgcagcgcccgttcagcgaactcttctggtcgccaggcatcgaaataccagtggtttgcatagagcggaatcctgtcacggcattttccccccaacagttggtaaaccggcagattgagtgccttacctttgatatcccacagggcgatatcgattgcactcatcgcgccatatatcgccagcgatcggccgcgcgcccagtaggacttatcaaaacactgttggaaaatcagttctgaatcaaaaggtgagcggcctgtaaggtaagtctttgtcagcgactcaagcacgggaataacggacttggcaccgacgccgtagctcatcgcgacttcgccgataccggaaatcccttcgtccgtttcaatctccacgataatcaggttatgacccggttgccgggcgcgaagatcgacgtcataaacgtttaaaccggttattttcatattatcctccctgtttttcattatgtgcacgtgcacatcactaatcaaccagcagtctgcgatcgagatctcacaataagaagaaatgtgcacgtgcacacttaacagagtaaaagtcgtttcggctgtaaaatctgtcgccgttaaaaagacgagtcaggtgagcgcctgccgttaattttgcgagtgaagcccgctaaaccggacagccagaatccacaggagaaaagtgatcaagcaggttcgtagattgtgccggatcgcgtgggtggctttcaggcatatctcttatgggatgcacaaatacggcgttagtgactcgttttgagcgaggagtaatgaagtctgtttagcggcctaacgctatgggtgagcagctatttcaggatctgaggcccaggcagcctgctatacgaaatccatgtggcccagctcgccgtaacctgatgtcagtcggcgcggttgcgtcataaaactaagggcggcagccatgccgcccttacgcttacagcgtcacgccgcttttaaaaatagccagttcacgaaaatcatttttttcattgttggttaactgcccgttggcaatcgccacaatggtgtcaacaaagtcggctaacagcgcgtccatgttcatgccatcgagcagtcttccggcgttaaaatcaatccagtgcggtttcttttcagccagcggcgtgttggtggccagcttgaccgtggggacaaatccgccgtacggcgtgccacgcccggtgctgaacagcaccatatgacagcccgcccccgccagcgcactggtcgccaccgcatcgttccccggcgcgctcaacaggttaaggcccggtgcggtgagacgttcgccatacttgagtacgtccacgacctgactttgccccgctttttgtgtacagccgagtgacttctcttccagcgtggtaataccgcctgctttattacccggtgacgggttttcatagatgggctgatgatgatcgataaagtactgtttgaagtcgttaatcatcgacacggttttgtcgaaggtggcccgatcccggcaacggcccatcagaatacgttcggcaccaaacatttcaggcacttccgtcagcaccgttgtcccaccgttggcgatcatctgatcggaaaagcggcccagcagcggattggccgtaatgcccgaaaatccgtcagagccgccacattccagaccgaacttaagctcgctgagtgtgcccggtgaacggcggtcgtgacgcattttttcatagagcgcatgcagccgctccagtccggcttcgacttcatcgtcatgctgctggcacaccataaactcaacgcgatcgctttcaaatgcgcccagggtttcacgaaacacatccacctggttgttctcgcagcccaggcctatcactaataccgcgcccgcattcggatggcgaaccatgttttgtagcatggtgcgggtgttgtcatgatcctgccctaactgcgaacagccaaaggtgtgactaaacagaaaagcgccgtctgtaccggctgcatcctgcgtctccttcagaaagcgctgtaaaatctgtcgcgcaatcccgtttacgcagcctacggtcggtaaaatccacagctcgttgcggatgccgacctcaccattggcacggcggtaaagctgcacctcacggtcgcccggctgggtggttaaagccatctgctcaggcacatagtcgtagtgatcaaggtcactgagattggtgcgggcattgtgggaatgaatcagctcccctgccccaacggcctgagtcgcatgcgcaatcggcaacccatattttatgatcaactcgtctttgccgatggcgcgcaaggcaaacttgtgcccccgtcccacatcctgaagcaacgtgacgggctgggcggcgagttcaatcgtggtgtcggcttccatatcatgcaacgccacggcaacattgtcctgcggatgaatttttatggcgtcttgcatggttatctccgttggctcagcgcgtcacgtataccgtgcgcgaggatgcgttgcaggtgctggctgaccgtttcggccaggccgggttgctgtgttaaatcttgtccccagtgctgagcatcacttaatacgcgactgaccaacgctaaaggagagatttgctctgccgtcacggcggcccagccctctgagtagcgttccagccagtgcggctcatcctgcagaggccagcttttatccgccgattccccgcgataaaacgcaatcagggctgccagcgcaaacgtcaggagctgtggccactgccctgttttcacatgcgacatcagcaaaggttgcaacaaacgtgtacggaacttggtcatgctgttcagggcgatggaaagcagtgcatggcgaataaacggattgcggaagcggcgcaacaccgcgtcggcaaaagcgttgagctcatcggctggcagatccaacgtgggaataatctctttgcgcagcagcgcatcgacataagcagagatttgctcatcgtccatcgcctctcctacgctctcgagccccgcaagacaggcgaccggcaccatcgcggtgtgggcaccgttcagaatggccaccttttgggctttgtacggggcgatatcgtcaacgtggcggacagccggcgtcagtgcggcaagcttcagttcgtcaaacagcgccgtgggtccctgaagcacaaactggtaatagacttccccggccaccagaaaacggtcctggtaccccagttgatcttcaagcgcggcgctgtcggacggaaagccggtcacaatccgatccaccagcgtgttgtagaacgcacagcacgtatcaacccagcgttgaaacgcctggggcagttgccagagatcggcatagcgcagcaccagagtgcgcagcatatcgccattgtgatcgatcaactcacaaggcacgatgagccagcctttctctttatcccctgagaaatgctggtaacgcgcccaaagcagttgcgtcagcttgcccggaaagctggatgcaggccgatcgcttaaccgatcggtttcgttgaacgtgatgccggcttcggtggtattggagaacacaaaacgcatctcgggctgatgagccagcgccataaaatcgtcaaactgctggtaaggctgaatctcacggttcaggctgcggatcaggcggctttcgctcacctgttccccctgtgtgttcagcccgcgaatcagcgtggtatacagaccgtcctgctgattcagattgtcgcggacgtcgcgattacgcggcctgaccaccaccacaccggcgtctgtgccctgatgttcattgagccagtcaagttgccagtcgataaaggcacgcagaaagttaccttcaccgaactgaatcacgcgatcgtggtagaccgcgccgggaaagtcgtggcgattcagccgcttcatggtcaggctcccagctcaatgccaaaatagtcacgggcattgttgaagcaaatgttttgtaccatctggcccaacagcgcttcatctgcaggcgcttcgccctgttcgacccagcggccaatcatctggcacagcagccgacggaaatattcatgacgggtataagaaaggaagctgcggctgtcggttaacatcccgacgaagcggctcagcaggccaatttgcgccagctgcgtcatctggcgctgcatgccatccagttgatcgttaaaccaccaggcggaaccaaactgcattttccctgcctggccctcgccctggaaatttccggccatggttgccagcacttcattatcccgcggattcagacagtagaggacagttttaggcaaggcgttattgaggttttgcgcgccaagtaagcgggccagaggttcggcaacaggctgatcgttgatggagtcaaagcccacatctgcgcccagcagttggaactggcgttggttggtattgcgcaacgctccaatatggtactgctgcacccatccacgacgagcgtattcccagccaagccataccagcactgcggttttaaactgggcgatagcctgcgcatccggctttgcgcctccgcgacgatgcgccagaatgctgtctagcgtggtttcatccgcatcggcataacacaccacatccagcgcatggtcggaaattttgcagccgtgtgccgcaaagtgatccagacgtttgctcagcgcctgacgtaaatcatcaaagcgctgcacgctgatatcggtcaggctttccagtttttcaatccacggcaggaaggtgtcggcttcgatattaaaggctttatccggacgccagcttggcagcaccttcaccttgaagctgctgtcttctgccagcacacggtgatgtgtcagatcgtccagcggatcgtcggtggtgccgaccatcttaacgttcatctgctgcatgatgccgcgcgcagtgaaatcgtcctgcgccagtaaatcgttgcagcgctgccagatctcatcggccgttttttcggacagcagcacgccggtaatgccaaagggacgacgtaattccagatgcgtccagtgataaagcggattaccgatggtttgcggtaccgttcgcgcccaggcattgaatttatcccgatcgctggcgtcgccggtgcacagcgcctctgccacaccgttagcccgcatcgcccgccacttatagtgatcgcctttcagccagatatcgtaaaggttggcaaaacgatagttttcagcaatctgctgcggcggtaaatggcagtgataatcgtagacgggctgatctttggcgtagccgtgataaagacgacgggcgaactcagtgtccagcaaaaaatcttcggtcatgaaacgcgacatacaaagcttccttatgggattacccctgaatgactcaaagttatcataccaattttggctgactgcaggtttttttacgactcaggtcacatttaagcaagatgatcacatcccatatggaccttattgtcgcctgcagcgcgctaactggctgtgatctcatctgtttgcagtatcccacaagctattgcgggtttttgtgatggctttcaacttttaaagttgtataacaagttaggctctcgctttaccgcaaggtaacaaatttcttacacaaggcaaggcagataacggtcgctggtgcaggaccggcgggcgtgagcagagctgtatcacgagatgtcccgctccagataacaacagcggtaagaccgcacaaacaactggaagaggtacagaatgcgtaagatcaaaggattacgctggtatatgattggcctggtcacgctcggaacggtgctcggctatctgacgcgtaacacgattgccgtggcagcgccaacgctacaaacagaactgcatatcaccacccagcagtactcctatattgtggcggcgtactctgcctgctacaccgtaatgcagcctgtagcgggttatgttcttgatttattaggtaccaaagtgggctacgcggtatttgctgtactgtgggcgattttttgcgccgcgacagcgctggcgggaagctggggcggtctggcgttggcacgcggtgcagtgggtgccgcagaagcggcgatgatccctgccggactcaaagccagtagcgagtggttccccgctaaagagcgctccgtggcggtaggctactttaacgtcggctcgtcaatcggtgcgatgctggcgcctcccctggtggtctgggcgatcgtcgcgcacagctggcagatggcgttcattatctcgggcgtgctgagcatgatttgggcgctctgctggctggtgttttataaacatcctaaacagcagaaaaagctgagtgaagaagagcgtcactacatcatctccggtcaggagcttcagcatcaaaccggcaacagcaccaaaatgtcggcactgcagattctgcgcaatcgccagttctgggggatcgccctgccacgtttcctggcagaacccgcatggggcacctttaacgcctggattccgctttttatgtttaaggtttatggtttcaaccttaaagagatcgcgctttttgcctggatgccgatgctgtttgctgactttggttgtatcctgggcggctacctgccaccgctgtttcagcgctggtttggggttaacctgatagtgtcacgtaaaatggtggtcaccatgggtgccgttttgatgataggtccaggcaccatcggtttatttaccagtccttatattgctatcgcgctgctgtgcgtcggcggctttgcccaccaggcgctgtctggtgcgctgattaccctgtcttccgatgtgtttggccgtaacgaagttgccaccgccaacggcctgaccggcatggcagcctggacagccagtaccctgtttgcgctggtcgtcggtgcgttggccgatacattaggctttagccccctgtttgccgcgctggccgtgttcgatttgctgggcgccatcgtcatctggacagtgctaaaaaatcagcccatatctgagcttcagacaccaccttctccttctgcggctgcgacggtacgtagctaatcctgcgggctggcttgcgccagcccttttcatctcttaccgcaaagtggtataacaacttatcttatctgatcgttaccttggacggtgtcatggacctcactgaatctcgtcgactttatcaacagctggccagcgagttaaaacgccgcattgaaaacggggtttatcaggtgggtgagaaactgcccgcagaacgcctgatcgctgaagagatggaagtcagccgcacggtggtgcgcgaagccattattatgctggaagtcgaaggctacgttgaggtgcgcaaagggtcgggcattcatgtcatttccagccagcagcaaaaccgggttgccgaaagcagcagccagttagagtttgccgcctttgggcctttcgagctgttgcaggcccgccagcttatcgaaagtaacgtggcggagttcgcggcaacccaggtgacgcgcaaagatatcgtcgatttaatggcgattcaggagaaagcccgtcaggaggatcatttcagggactctgaatgggatatgaagtttcacgttcgcatcgcccagtcgacgcaaaacagcgccctggccgcgattgtagaaaagatgtggctgcaccgcttgcacaatccctactggcttaagctgcatgagcatatcgatcagcgcagtatcgtaagctggtgtgacgatcacgatcagattctgaaagccttaatacgcaaagatcccgccgccagtaagctggcaatgtggcaacatctcgaaaataccaagcagatgttatttaacgccaccgccgacgattttgagttcaacgtcgaccgttacatgtttagcgaaaatccggttgtgcttccggatgcagacacgattccacgttaacctgacttaataacagtcagttaatctgcaatagtgtcaggacatgtaaaactcctttttacatcgtgatacagagggtaaaactcctgttcgtttaggagtagttctgtctccgatgcatgatttttgttacagttatcacccttttcttaccttttgcgataagggcttatcaaatcgctgatttaacaatcagttctggaaggatccagaaacgcttgctcagacgacgctctcaaaatatataacaaatgtcagtctgcgctgaggtccctgtgggacatgattaacgatgatgttcaggaacgattgatggaaattttgcaagcgctgctgcatgccttgtggcaacaggattatgaaacgctttctgatccaacgctggtatgggcgatttacggcgttttatttatgatcctttttctggaaaacggcttattgcctgccgcttttctgcctggcgacagcttgctgattctggtgggcgtgctgattgccaaagggaccatgggcttcccgctgaccattctggtcctcacgaccggtgccagcctggggtgctgggtcagctatattcagggccgctggctggggaacacgccgacggttcaaaactggttatcgcaccttcctgcccgctatcatcagcgcgcccataatctgtttcaccgccacggcttatcggcactgctgattggtcgttttattgcttttgtgcgcaccctgctgccgacgattgccgggctttctggtttaagtaatgcccgtttccagttttttaactggatgagcggcttcttatgggtcgtcatccttaccgtcctgggctttgccttaggtaaaacccccatcttccgccgttacgaagatgaactgatgtttttcctgatgatgttgccgttggcgttactggtgattgggctggtaggctcgctgattgtgctgtggcgtaagcgccgggcaaaccagcgtggtgagggctcatgaaactgttacaggtcattcctaaacgctggcttccctggttaattggtggcgcatttgcgctgattgctatcagcatggtgcccaacctgatgcgtcatgaaaacgtggtacagattcgcgtttcacatgcgggtgcgccgatgcccgatggcttctatctgtatcaacagctgagcgctcagggcattcgtatcaaaagcatcacgccctctggcgatgcgctgattatccattttgataatgaagagcagagcctggccgcgcagaaagtgctgcgtcgcctgctgccagaggggtttatcgtcgctcaacacgacccgatgcctcacctttctctcgcctagtccgtattcctttcttatcgctcatctcaccgacaaggtgtgctgagcgtttttctgtatatcggtgatctttggactttttccacctgatgtctatgcttaaactaaggctggttatcaacgcagtgcggaatgcttgtgcaccgcgttgaattaagtcaggcaacaatggaaggtacaaagcctaatgaaacacaaattactgctgggaatggtgctgttttctctttcaggctcgttgatggcagcacagtcgctgtgtcagcaaaaagagcaggatattcagcgcgaaatcgagatggctcagaagcataacaaccagcgccgtgtaaacggcctggagcgcgccctgaccgaagtgcgggcaggatgtaccgataaaaagcttaaagcctcacatctggaaaaaattaacgctcagaagcagaaagtggctgagcgtgagcgcgaactcaaggaagagcgcgacgaaggtcatgacaaggacaagattgcgaaacgcgaacacaagctggaagaagcacgccaggagcttaagaagttacaggcggagccctattaatcggattcaatctactgatgttaaaggagtattttatgtctaaagacacatcatcggaatatttgcgtgctgaactgaaaaacctggcggatacgctggaagaagtcctgagcagcggaactgaaaaatcaaaaggtgaactggataaactccgtcacaaagcgcgcgttgcgctggacagctcccgcgagcgtttaggtgaatccggtgagcgcctggcggccaccacgcgtgaagccgcacaaaaagcggatggttacgtgcgtgacaacccatggcacggcgtaggtatcggtgcggcgattggcgttgccatcggtatgctgatctcgcgtcgttaatcatgacggattcacagcagaaccacggaccggccaaaggggtcatcaacattggtcagcgtattgttaccacgctggtcagtatggtcgaaacacgcgttcgtcttgcagtggtagagctggaagaagagaaggctaatctgatccagatgctgttgatgcttggcctgaccatgcttttcactgcttttggcctgatgagcctgatggtgctgattatctgggcagttgatgcgcagtaccgtttaatggccattgccatcaccaccggcgtgctgttcttgctggcgctgatctttgggctatggacactgcgtaagtcacgtcagtccacgctattgcgccatacgcgcaaagaactggctaacgatcgtgatctgctcgaggataaccactaatgagttgccgtgagcgtcaagcgcgcatcgatgaactgctaaagcaggttcagcagcaacgcctggatctgagcgcggcgcggcgtggctggctggagatcacggcctcttacgaccgtggctggtttacgtttttaagtttgaaacgttatctggccattggcagtagtgcgttagccatttattccattcgcagccctaatcgcctgctccgctgggcgaaacggggcttcggtctgtggagtacgtggcgcatggtgaaatccgctcttcccccgcgttgaatcccccaaagccagcccgattgcggctggcttttgctttttatcaaatttactgaataacatcgacagtttatattgcttacaactgtaacccctcgctactatcatctccagctatcagcccggctaattgccatcatgcggttaacgggaatattcactgcgggcagcgtcgccttgcaaacttttagcattggagcttatgatgaaaaaattcgaagacagtggtttgttggccgcccgtatcctgatgactatcctgtttatcgtttctggctggggcaaaattaccggttatgccggcactcagcagtacatggaagcgatgggcgtgccgggtttcatactgccactggttattctgctggagtttggcggcggcctggccattatgtttggcttcctgacccgctttactgcactgtttaccgctggctttactattctgaccgcgtttctgtttcacagtaacttcgcagaaggcgttaaccagctgatgttcatgaaaaacctgtctatcgcagggggtttcctggtgttaggtttagtgggtcctggtgcgtacagtattgaccgcctgatcggcaaaaaaccacagggtgctctggcgcgctaactgacgcccgacgcctcgcgttatctgaacgcaccggttgctttcttccggtgcgtttttttatgcccttcccctgccaaattgccctcactggaccgcccgaacagataacatgctgtcttccgcgcgcagattttctggttgagcgggataacacctccgcgccctgcttaaggtaagcctaatctacccatggaaatatagcgttccgtctctcttctttttggcaacgctatgaaagtgtcttatggtcagtggcttccccatcacgatgcgcccttttttcgacggcttcatcttttggtcgccgtgctgatcctttcgcagatcattaattccaatttcaccgcacgtgaagcgctcggcgagcataacctggagacgctgataacctggctacatattctctcaggactgttgctgatcgctgcgggcgttatcatgctcatctggatgcgggttcagcggggttttcgctggtacttcgcctggctcatgctggattttcggggtattcgaaacgatgtcgtacagctgaccggcctgaaactcccccaggcacatggcggtggcatagccgcgacggtgcaaggcctgggggttatcgcgttgatcgcggtcgcctgttctggtgggctatggtttttatttaacagtacgtcgctcgccacacctgatttgacgcgtaaggtattgcactggcataaattcctgaccacctttgtagagatttatttttacagccatggcgcgatgggcgtgcttcatatcctgctatcccgctatgaaaaatagcaaaggacatgcatgcaggctgtcgccctccttgttaaacgaatcgcttatcactggaagaccggatgctacatagtgaatcacacaaaattgaacacgccggatggctgcgggccgccgtgctgggcgcgaatgatggcatcgtatccaccgccagcctgctggccggggtggtttctgccagcagtagccatcataacgtgttgctcgccgggctggctggcatcgtcggaggggcgatgtcgatggcaacgggagaatacgtctcggtgtcctcacagtccgatacagaaaaagcgtctctgctgcaggaaaaagccgaactggaggccgattttgcggctgaaaccatggagcttgcggccatttacagggcgcgcggcctgtctcctgagctggcgcatcaggtggcagagcaactgatggcccatgatgcgctggccgcgcacgccagagatgagctgggcatcacggccttcagcagcgcgaaaccgcttcaggccgccctgttttcagcaatcagtttcgcatcaggcagtattttaccgttcgccatcgcgatgctcatcaccgggcctttcgccttacccgccattgcggcctcggcgctcctggcgctggcgctgcttggcgcgacggcggcccgggccggggatgcgccagtaagaaaaagcgtcacgcgaatttgcttctggagcctgttggcgatgggcctgtctgcatcagtaggttatctttgcggacaggcgctcggataatcgcctgacgcagcatttgacgccttcagcgcgtcaaatgctgcccgacaatcagcccgagctggcctgccagcgtgctgcctgggacggattcgccccccacagactgcccctgcagaatctcaagttgcccctgcccacagccaataaccaacggattgactgaaaccacctcaccaggctgactgacattatccgcctcaataacccggctttcccagacggtaaaccgttgtgacccattaacgctgaaagcaccaggccaggggaacgccagcgcacgaatcagattatggttatcgctggcgctgtcgtgccagttgagttgtccgtcttccggtttacggcttccaaaacagctggctgcgcgttcgtcctgggggatttcagcgagttggcccgccaccagccccttgagccagcccggtagcatctccccggtggtcgcgactaatcgggtatgcagcgccagggcattgtcctgcggatgaatgtcaacggccttctgcgccagaatcggaccggcatcagggcgtttgatcatgcggtgcagcgtgacgccggtttgcgtctcccctttgataatcacccagttgaggtgggcgcggccacggtaagcaggcaataaggcagcatgcacgttataggcccctttttttaccgacgacagaatggcctcgctgagcacctgacggtaggaaaagcagaacaggtagtccgcctcaaagtcggcaatccgggcttgccattccgcggtgttgacatcctctgtgataaaaaccgggatgttataaccttcagccaggcgggcgacagaaccgtaaaactgcgtaccggcagcggggtccgcatgggtaaacaaggcactgaccgtgaaaccggcatccgttaatgccttcaggccggtacaggccatttcgtgataaccaaagagcaccgctttcattacgctttccttctttttagtgcctcttccaacgggacaggcgtgctggacggcttatcgggttcaggccgaagaggggccaatcataaggtattctgtcctcaaatacgcctctgacgcgtttgccatatagccgttattgaggctgttcagcaaaatatccggcaacgcacatggtgtgctgtcgaagttatccataaccacctatggttagagcgagagattttcttcttatcctttgtattggagacaacatgggccagttaattgacggtgtctggcatgacacctggtatgacaccaaatcaaccggtgggcgctttaagcgctcagaatccgcatggcgtaactgggtgacgcccgacggcagcgcaggcccaggtggcaaagccgggtttacggcagaacgcgatcgctatcatctttatgtctcgcttgcctgtccgtgggcacaccgcaccctgctgatgcgtcagcttaaaggcctggatagcatgattgatgtgtcagtggttcatccgctgatgctggaaaacggctggacgtttgatgacagtttcccggatgcaaccggagacaaactgcatcaaaatgaatttctctatcagctctatttacatgcagatgaggactacagcggtcgcgttaccgtgcccgtgttatgggataaacagcagaacaccatcgtcagcaatgagtctgccgatattattcgcatgtttaacagtgcattcgatgccgtgggcgcacgcgcgggggattattacccggttgagctgcgtgaaaagattgatgagcttaacggctggatctacgacaccgttaacaacggcgtctataaaaccggtttcgccacctcgcagtccgcttatgacgaagccgttagcgccctgttccattccctgtctcgtcttgagcagatcttagggcaacaccgttatctcaccggcgacaggataaccgaagctgacttacgtttatggaccacgctggtgcgcttcgatccggtttacgtcacccattttaaatgtgaccgtcaccgtattagcgactacctgaatctgagcggttttctgcgtgatatctaccaaatgcccgggattgccgacacggtaaacctgccccatattcgccatcactactactgcagccataaaaccatcaacccgcatggtgtcatctctgtagggcctgcttttaactgggatgagccgcacggtcgcggttagcagcagaacgccgcatcaggtgaagataaaccgggatgtgaaaggacctgacgtgcgctggcagactgcgcacgtcaggtcgaaccgaggaaaaatgaccctcagaaaaacttataaacaatatttaaaatagtgagtaagccgattgcggcaacaaagacgttatcaacccggcctttatattttgccagcgccgggactttgcggatagcaaacatcggtaacaggcagagcagcgaggcgataatcggcgcacccattgcctcaatcaggtcaaggatattggggttgaggtaagccaccagccaggttgatcccataataaagatcatgctcagcgtattcagtttgcggctggacacggcgtctttatcgcccttatagcggaacttaataatcagcccattcaacccttccagcgtgcccagatagtgcccaaagaacgatttgaaaatagcgactaaggcgatcaccgacgcgctgtattccagcaccgtagagaaggtggacttctcgccagacatggatgaaaagtggtttgccagataggagagcacggggatattttgcgctttagcgtcagccatgtcttgcggtgataaggtaaacagacagctaaaggcaaagaacatcaccacggccaccatcaacatgctggcgcgcgagataatctggctgcacttgttttcggtataggtccggcccatttccggctcgtactcttcacgcttggaaaccacaaaagaagaaacaatcggcgagaaattgaacgagaacaccataatggaaatgcctaaccatacggtgaccagaatgccatcgtggccggtaaaggtaatatcactcaggctgacctgatcaatcacggcggaattccagtacgggatcagcgagagcgaaatcaccaccaggctggcgataaacggaaacaccagccagctcatcacttttaccatcaggtctttgccaaaccagatgacaaaagccatcaacaacagcagaaacagcgctaccacgccgcgattcagtaccggcagctgtaactgatattgccaaaatgccataaaggtattggtgatggtgacgccatagatccagagcagcggacaaatcgcaaaaaaatagagaaaggtaatgaccaccccgccggtttttccgaaatgctcttccacagtttccgtaatattgcccgaaacgttgctgcctgacaggcacagccgggccaacgcccgatggcagtaaaacgcgatgggataggcgagtaccagcatgatcaaaataggaatcaggccaccgtaaccggcccggatggggaaaaaaagcacgccagcgccaatggccgtaccaaacagacccagtgtccatgtggtatcggacttacgccaggtcgacgctttttcctggtcgagaatattttcagaattactcataacttatcctttatgcgtcagcgaaacctgtaatctgggaaacccgggacaaatcgatattgccacctgagataatgcacacggttttccgcccctggatgtagtggtcaactttgccgctcaacagcgcggcgcaggccaacgcgccggccccttccgtaaccactttgtttcgctggatcaatgcaatcatacttttacgaatgtcgtcttcacttactaacaccatctcatcgacccattctctcacaatcgcgaaggtgagatcgcccggacgggcgacatcgcagccgtccgcaagagtcccggtaagacgatggcgcgttatggtatcagcaaaaaaggaggctgccataccgtgtacgttttcagactgcacgccgatgacggtaattgtgggattaatagacttaatggcagtggcgataccggcaatcagcccgccgccgcccacgggaacgatgacgttatcgacatcgtagagatcttcaaggatttccagaccgatggtgccctgtccggcaatgattttcacatcatcataaggaggaataaatatacggccttcgttggcgacaatttcatccaccttggtcatggtgtcattaaagttgtcaccgtagatgaccacttcagcggagtaatcccgcgtcgccgcctctttggattttggtgcacctttaggcatcacgactttaccgtcaatattcagcatggcgcacgacagtgaaacgccctgtgcatggttaccggctgagcaggcgacaacgccctgacgtttttcttcttctgtcagcgaactcattttattgaacgcgccacggattttaaatgagcccgttcgctgcatgttttcaaatttaaggaatatttccccgccgcagcgttcgctaagatagtttgaacgtggcatgccggttttatacacttttccagttagcctttctttagcggcataaatttcatccagggtgacgggaacattatcattgttattcatataaactcctttttcaggcaaaacgtatccagcacaattccccgaagagaaatgcaatcgtaaaatcaggaagtgcaacgcgcttaacgctttcgcttcacaacgtgctttatcagcaggcgtttatgcagttgatttaacaaggaatgggcagcggcaggatatgaaaaggcgggcgataacaccgcgtctgacgcagaagaacacggctgacgaacagaagaggcagaagatggttttacaaaagaagcagcattaaagcgaggattccacaacgggttggcaatactgtctggcgttgactgataaaatgttaaccaacacgttcgtggttgcgtatatctatacataatgactttcctttacatcctttttatccgctacgaatcttaatgatcaataaaaaaaaggttgtgctgtttctcacaattgtcactgagatatgagattccgcgaaaaatcatgataatgatcaatattggctgaaaggctattaaaatattaaacacggccaaactgcgcaataaaaatactatatacacaacgttttaaggtgctgcttaaaataaatacagtgcaacctaaaagcctcttttttgagtaagtctaaaccatagaaataaaaatgaatgtcgcctttcctggtggatttttcatctcataccgaaacgcatcattaagacaggctcgcgcatactattcgcacatgtcccttcctgtgatttatccgctgccgaagggatcgttgctggcagccaggagctgtcaggacagatagagtgatggcagagagacaagcagacaggcaggcagacaggcaggcaaacaggcaggcaaacaggcagacaggcaaacaggcaaacaggcaaacaggcaaacaggcaaacaggcaaacaggcaaacaggcaaacaggcaaacaggcagacaggcagacaggcagacaggcagacaggcagacagcaaaatacagtcataaatgataagggggaagcacaacgcattacagcagagtgatacgtcccctgcgctgacagatctcaaaacgtccattctcttcccaccccgttaaagctcctctccgttgtcggaggtaggttactgtgtataaaaaaggggctccgcatcggcatcaacaaggctttcataacgtcattgcttctcgcccctcgccctgtcagggcaaagtgcgcatttatcatacagagtaacgatgacaagaataaaaggaacacacgtcatcataaagagagcaaagggttatatcgcataagatgctattagattgttgcgctttcttataaatcatcgcaactcaatgtaaatgaaaagataatactgagagaaaagatgcctgacgcttagaggatgattaaaaaacaccgtcagtaaataatgtttttttccattgataaattcatattgataggtaaagcaggcataaagctgactttaacatttccaggagttttctacgaaaccaacatatattctgatcaagttagaataacatttatcagcatcaacctttattttaaaaaacaccgaacataagcaatagattatcttcaaaaatcacaaaatgacaatattatagaccagtgttcatttaaagcgcagtcatatatccgtaacgcattgtgaatataagtttttgattaaactgtaaattatttttattcaatgaaatcaatatgatgaaaataataaaaacataaagttaactaacaaaggttatttattaaataagctaatttatattcccttaaaacaaaaaacaaagacaggctaaatttcatttgttaaaaaaaaagagaaaaacctgagtgtggacaataaaaaaaaccaacttagaatgatgaaaaaaaagtgatgaggcactatttacacagttagtaaaacactcaaacaagagataatgtcatcaaggtaatgaatgaaaacgtattttatttccgatgacagctattttctcatcggcctggaaacaagcttatgtgggttacattgtgataaagcattcattaacacaaacaggtttacaacgttccatcctgataaaaacgatcttctcatcgtatcgatccaggatcatattaaacgtagaaactatctttcaaaccagaaggcgcatggacccagagttattattattgctgattttttggtttgccacgatacgcaggaaaaatatccgcgaattgtttcaaaaaagatcacaaaagaggatcttattgacgttctgcagaacgtaaaagaaagcgacgtgataaaaagatacgcctcaaagattgaataccagatcatttatatgatttgcaagggtaaaggaatgcgtgaaattgcaatgaaatataatctttctttgaaatatctttatggacttaaaaggaaaatactaaaagaacatggactagataactgcaatgtgaatggattgctcatttgcagagatattctttcgggtcactaggcatatgcttttcagcatcaactgctcccgtcatgataaaaagcagaagaatggcaataaggaaaaggaggcaattagcaatattttaaaatttcattagttagttacattctgtcaaagttcattatataaaaggaattcttaaatgaaaaacaagttacttatcagttctgttgccatgttatttatgggcgtaaataccctgggacatgccgcaacagtcaatggtggcaccgttaattttctaggtgaagtcgttaatacagcctgtgtcgtttccagtgatactgcctaccaaaccgtacaactcggtcaggtcaaagccagcacatttggtgataccgcaggaacgaaggcgcaaaatcctaaagcctttaaaattattttagagcagtgtgatggcacgtcgagcacagcagcggtgacgtttgacggcgtaaaagatgcaacccaaaatgcacttcagtcaaccggaaccgcggcaggggttggcgtctatcttgttgataataacaatgccgagatcaccctcggtacggctacgccagcagaagcactgtccggcagtaccaatatctatacctttaaagcagacatgatatcggtttcagacacggtcaccgtgggttccgtcgacagctctgccaattttactatcacttatgcctgataacactggcaggggaaaccctgccattattctcttcaagtaagggtaaacatgtacatcatcagatttgtactttatatggccttgttatgcgccagtctgagcgttaatgcaggcggtattggtgtaggcgctacccgcgttatttataatgaaaatgctaaacaagcatcgctttctgtcaccaatacggatacagccgcagtctatttaattcagtcatgggttgaagatgacgccagcaacaaaagcaatgattttgttcttacaccaccactattcattattcagcccaataaagaaaacctgttacgcatcattttttctggcgaaaagcgcccgtccgatcgtgaatccttatactggcttaatgtcaaagcgataccatcgcaaaataataacaccgaacctgatagcagcagcctacagtttgccatcgtcagtcggctaaaactattttatcgccccaacaatcttccattaagtagcagcgaagccattaaaaaactgcaaaccacccgacaagacagcctggtcacctttaataacccaacgccttattatatcaatgtcgccaatataaagagcaaaaatcaatttcttgaaacaagaagcatcacacttgcgccttttggtaagacaagcattgatattgctccggcaaaggagatgacttatcaggttattaacgattacggcggtatggagcctgtcgtgcatgtcagataaattgaaaaccggagattaagatgaaatgttatggaaaactggcattgattgttctgatacatttcccctttcaggccaccgccaactataaatttaatcctgggctgattgattcaacagtctcatctgtagccgatctggaaaactttcaaaatggcaatgttatcgcgcccggtatttatttagttgatatctatctgaacagcgattatgccacttcggcggaaataaagtttattgagaaaggtaagaacattgttccatgtttcgatgagaaaatcctggtcgctgtcgggattaatacccgtgacataactaaacccggcgcctgtattttcatagaagatgacataccaggttctcatgttaattttgtgccagagaagctaaaagttgagattagcgcgccacaatccgtgcttttcaataccgcgcgagggcacatacccaaaacgcggtgggatcacggtatcccagcgttactgcttaactatcgatacagcggctcaaccggcaaggtcaatcactatgacgcggaaaatcattttctggccctggatagcggtgccaacctcggtgcctggcgcttaagaaataattcaacctggacgtttaatgaaacccacgattcgcgtaacagcgaatggaaaaacatccgcacttacttacaacgtccgctgttagacttcgacagcatcataacaataggtgaatacagcacgtccaatgcgatctatgacaccttcaatttcagaggtctgcaaatttcgtcggatgaggcgatgctgcctgacagccgtcgaggctttgcacccgtggtcagaggcatagcgaaaaccaatgccagagtgacggtgaaacaaaataactatgttgtttatgaaacctacgttcctccagggccctttgaattaaccgatctctacgccacgggaagcagcggcgatctgacggtcaacattacagaaagtgatgggcaagttcagtcttacaccatgccttactcttctctgccggtattacaacgagaaggtagcatcaaatacagtctgacctccgggaaataccgtggtctgacaatgcaagattcaccggagttttttcaggccacgcttattgcaggtttaccctatggaatgtctttctatggcggtggtcagttaagcgataattataaagcctggtcattgggcttaggcatgaacctgggctttatgggcgcaatttcggttgatgcaacccatgcccagagtacgttagccgataaaagtcagcatgccggaaacgcctataagtttcagtatgcgaaatcgctgaacacctctggcacaacgttccaactattgagctatcgctttaccactgacggattttataattttagtgataccacatggaaaaaaattgacggtcgtggtttcaatacagatggctcgttgaatcttgatacaacttataacctacgctttgcccgtaaaggtcaacttcaggccagtttatctcaggatctgggtgaattcggttctgtctatctcaccggtttagaacaaacatactggaacatgggaaagaaaaacacgacgttacaggccggttttaataccacactttacgacattaccgcaggactggctttgagctataaccgtaatccgtggcaaatggaaacggataaacgcatatctttattattttctttgccgctggataaatttacccggaattccgcccctcacactgcacgccgggcctgggcaacggctggaacacactatgatgcgaaaggaaattatacccattcgacgggaattaacggggtggcgctggaaaacagaaacctcagttataaccttcaacaatcttacagcaataatggccaggcctacggcgggagtgccggtctgacctacaacggagcctataacgccgtcacatcaaattacagttacagtaaacactatcgtcaggcgagtattgggattgatggcggtgtcattattcaccaggagggaataacctttggtcaggcgctgggggacaccaatatacttgtcgatgcagcaggtgcctcaggattatccgttgaaaacagaacgggcgttaagaccgactggcgcggatatacctatcttccttacgccaccgcatacagaaataaccgcattgcgctcgaccagtcaacactgccgccagatatcacactggaggaagcggttaaaaatacggtgccgactcagggtgcgctgacgcgcgctaaatatgatgtcaggaaagggcttcaggcgttatttacgctgacgaaaaacggtaaagccctgccgctgggtacgcttgtgacagtaaaagaccctgcgattagcagcattgtcggcgacaacggcaacgtcttcctttcaggtataccggaaagtggaacgctcacggcaagctggggaaaccgtcaggatcaacgctgcaatctgcgcttcgatcttgccaacatcacatcaaacggcattattatcaaaaaacatctgaggtgcgaatgatcagaattttacttcttctccccttactctgttgttattcatccacacatgcctacgatattatccttcagataaatggcattatttcagaaaatggttgtgtggtggacagcaacgccagagagttgtcggttgacatgggtacggtggcaagtcgtgattttactgcgggccagttaacgtcagaactggtgcctttcagtatttatttacgtaactgctcgtcgctggcctctggcgttaaagtcactttcgagggcacgcccgatctggcagacagttcgttgctgaggctcactgaaatgaatgaatcagccagtggcatcggcattgaaattctggataaagagaaaaacccgatcccgttaaatttcgcttcagcacattattcgctgacacccaattcagacgcagagctgaagttttactctcgatataaatcaaccgcagcggttaagcccggcatggctaatgccaccgcaacttttaaccttgaatacgattaaacgtgttaataaagcaggtttctatgaataagttgatcatcctgatttttattattctggttagcgctcacccgtcggtttacgcctatgagacagacagttcctgtgagataaccgtgcccgccatttcagtcaatatgagtaatcaagcaccttcttcggcaggcgttgatttaagcggctggaatacaaacgcatgtgggcaaacacatcgggtaggcacatggcaatatggctggtatgacaccagcaatctttcccccaccggtatcagctacaatgatggctcgggtaatcattcaatatacagaacaggcatcaccggcattggggtcgtattaaaagccagaatggtacctaatacgatttctggcgcatccagtctcggcatgttacccattggctctgcggaaaccaaactcacttctacatcgcttttgggtatttccaatgtccagaccaccttgcaatacaaatttgtcacgacaggcgaaatcatttcccccaacgtttacagcatcacgtttagcgctggcagagcacaaatgagagacttactcagcggtgcttatcccgtgccggtgaatgccaatatcagctcactggccgtgaataacaaaggctgtgacattatgacgcgcagccttgtcgcgaatatgggcgccgtgggaacgcagcaactgcctaatattaacagcgtatatgctggtgaaccggtaaccattaatttgcagtgcgatgataatgttatcgttgaggctattttcagtgacttaacgaatccggcaaatacgaccaccaccctgaacttaaccggtgaatcagatgcgcaaggcgtgggggttgagcttttactcaatagcagtacgacaccggttcagctcagctatccggcaaggtatggcggtgcgccgggcagaaacctgatcaaaaccgcatcggatgccagtaatctctctttccaggtgacaccacgctatatcagaaccggggacctgacacccggcgtagccaatgccaccgcagcgttgacgtttgtttataattaattagaaaaccagcaccagggatcataacaggcagcccaacctgaggttgggctgcctttgctttatttcgtttcacacgccgttggccagggctttgccggcgagttgaacggatggtactggtagcaccaggtttccgacaccacgttgccctgtgctttcagatagagcttaagctctaccggatcaccgtcccccgccaccaaatcaaactgtgccagccagttgcctgaatcgtccggcaatttagacacgagcacgttctcaaacgtgccacgcgacgccgaaaggacggcttctggcgacacgcccgacggcagatggttgagcacatcgccacggaactcgacggcaaacttacggctgtcgtgcggacggtcggaacccggcacaccgcccctgcccagtcgggtcgcaccacaacgcgccagggtggaaggataaggctcatcggccagccagtgcagtcgataatggaagtgatgctgttcgcccgctttagccggagattctggcacccacatggccacgatgttgtcatagatttcatcgtcagtcgggatttccaccagcagcaccgagcctttgccccatttgccgatgggctccacccagagatcgggccgccgctcatagtgagccgcatcaaggtagctgtcgaacgctctgtccttctggagcaaaccaaatcctcgcggattctcgtcgttaaagctcgacgtgaccacgcgtaaaggattattgagtggtcgccagatatgttcgccgctgccggtccacatcgccaggccgtctgaatcgtgcacttccggacgccagtctgtgcccgcgcctttgaccgtttttgaaaaccagtacattgaggtcagaggggcaatcccgaaacgctgaacgtctttacgcaggaacagcgtacattcgacatcctgcaccacacctttgctgcggtgcaggataaatttataggcaccggtgatgctcggcccgttgagcagcgcatagacggtcaggtttttgctgtcatctttaggcgcttcaaaccagaaatccgtaaagtcaggaaactcttcatccatgccgggctgaacggtattcagggcgatgccacgcgcggataatccaaactggcccagttcgccgatggcgcggaaataggaagcccccataaaggatatccagtcgttttgtgggttcttttttaacgtatcctgactggccagcacccggaatcctgaaaacacgttacctttaagcggaggcagcttgacggttttgtccgtggtggtgaagtaatcaatattttgtatgatttcgcgcgcggcgttattttcaacaacgtgcattttcaccggcatacggtgtaaaccgttgaccataaaaaaggtaacaggaaaccgtccggcgtttttaaacagcgcatagtccggtttgtagaccgttttcatgtaggcgtcataggttatgttggataacaatgacgggtcgaattcagtgggcttttcgtaaggtttagccgccagcgctttggcctgggcaattaaggtttcaaagttaaatgctttgctatcacccattttgagaacacctgctgcgatagcgccaggggaaatgcctaatgcagataaggcagcaaaagccccggaataagtcagtaaagtccttcttgtaaccatgatccacctgtttttttaatactcattcaatgaattcgcgccatgtgcggcaaaatggtgagctgattgctgccggtaagccgccttcaactatagctgagagaaacctttgcctctcaaacagatgacaggctatcacgtcaacatgtgggatgagcgtatagcgcggcagcaattaattgcatgggatttgcctgagaagtgaaagcattcagcgaaagggcctttgtcttcttaacgtgatgaacaggtatttatcaggttaaggtgccacaacgcaaaacccccgcttgcgcggaatttgcattaagaacgcagaactgaccggtaagccgcgtgcttttatgaacagcgtcgtggacagtcattcatcggcttctcgtcccacaaagcaaaaaccccgcttgcgtgaggtttgcattaaaacggcggaactgaccggtaagccgcgtacttttatgaacaatgtcgtggacagtcattcatcgcctttctgcaccaccccacaaagcaaaaaccccgcctgcgtgaggtttgcattaagacggcggaactgaccggtaagccgcgtgcttttatgaacagcgtcgtggacagtcattcatcgccttctcgtcccgccccacaaagcaaaaaccccgcctgcgcgggctttgcattaaaacggcggaactgaccggtaagccgcgtgcttttatgaacagcgtcgtggacagtcattcatcgccttctgcaccgccccacaacgcaaaacccccgcctgcgtgaggtttgcattatgacggcggaactgaccggtaagccgcgtgcttttatgaacaacgtcgtggacagtcattcatcgccttctgcaccgccccacaaagcaaaaaccccgcttgcgcggggtttgcattaagaagtcgaaactgaccgataagccgggttctgtcgtggacagtcattcatctaggccagcaatcgctcactggctcaagcagcctacccgggttcagtacgggccgtaccatgtgaacccctatttggccttgctccgggtggagtttaccgtgccacggactgttaccagccgcgcggtgcgctcttaccgcaccctttcacccttacctgatcccattactgggccatcggcggtttgctctctgttgcactggtcgtgggtttcccccccaggcgttacctggcaccctgccctatggagcccggactttcctccccttcgcccgtctccttcagagaaggacgacgacgaagcggcgactgtctggtcagcttcggcgcgcattatagagggtttagctcgcgctgtcacgcccggcgcgcaggcaacgcgccaggcttatgcctgttgctccagcgcgtatttatagagcgcattctttttcaccccgtggatctccgccgtcagcgctgctgcctttttcaacggcagttcctgctgtaacagcgccagcgtgcgcagggcttccgcgggaagcgcctcttcgtcgggatgatggccttcaacaatcagcaccatctcacctttacggcgattttcatcctctttcacccaggccaggagctcacccaccggcgcaccattcaggttttcccaggttttcgtcaactcgcgcgccagcaccacatagcggtcggcacccagttccgtcaccatgtcctgcaggctgtccagcaaacggtgcgtggactcataaaaaatcagggtgcgcggctcttcagccagcgcccgcagggcatcacaacgcgccttggttttggcgggcagaaacccttcgtaacagaaacgatcagacggcaatcccgctgcgcttaatgctgttatcgctgcacaggcaccaggtaaaggaacgatgcgaatcccggcctcacggcaacggcggaccaggtgataacctggatcgttgattaacggcgtgccagcatccgaaaccagagctatgctttctccctgttgcagcctggttagcaagatttctgctttctgctgttcgttgtggtcatgaagtgcgaagagtcgcgcattgatggcgaaatgttgtagcaacagtccggtatgacgtgtatcttccgctgcgaccagatcgacgctggaaagtaccgctagcgcccgctgggtaatgtcagccaaattacctattggggttggcacgatgtagagcgtgctggcggaaatgtctgcccgatcgagttgtttcattgtttcatccgaattgccgatttaatattgagcatcttgaaaaaaacatcactggatacagtatgcttccttcaaaaatcgttcgtcataaagcaggacgctttgtgcctgtccttcttgctggtctgattttagccgcgtgtagcggccagggccccaaaagccagtccgtagatattcagggacccgttaccaataattctgcctactatctgcagcaggtgcagcaaagcagcgatgatagcaagaccgactggcaattactcgcaatccgcgccctgctgaaagaaggaaaatatcctcaggctgcgcaggccatcgatgaactgcctgctcagctttccgataaacagcagcaagaattactgctgttgaaggcccagtcgcagattggacagcaaaagattgccgatgctcaacaggtcctgagtcaggtgaaaaccagtgagctgtctcaggatcagctggcccgctacttcggtttacagattgccagcgcgcagggtaaaacatccctggccctgcttcgcgcctatattgcgcaggagccattgctgaaaggtgatgaccgccaaaagaatattgatgcaacctggcaggcgctgacccaactgtcgcagcaggatatgaattcgctggtgattaatgccgatgaaaacattctgcagggctggctggatctgctgacgacctggcatgctaatgcccaggatgccactatgctgaagtcagctatcaaagactggcagacgcgctatccggataaccctgcggcaaaaaccctaccgacccaactgagccaggcgcagaacttcaccaaagcctcgaccagcactatcgcgctgctgctgcccttgaacggtcaggcacaaatgttcgccagtgctatccagaaagggtttaacgacgcgaaaaacggtacccttgcgaccgccccacaggcgacgccgggcagtgcacaagatcctatcgcgatgaatcagcagcagcctgctgatgcgaacgcggtcgtcagcccgtcagcaaatcctgcggcaacgcagcagaccagcaacgggcagcaaccggccacgacgcaacagcagccccaaccgcagcaacagcccgctgccgaaccggccagcaatgcccaggtgaaggtttatgacaccagcagccagcctgtcgcgcaggtgatgcagcaggcccagcaggacggtgccacactggtcgtcggaccgctgctgaaaaacaatgttgaatccgtcgcgaacagccagacaccgctgaatgtactggccctgaacgagccagagcaaatccagaaccaccccaatatgtgctattttgcgctgtcgcccgaagatgaagcgcgcgatgctgcgcaccacatctgggatcagggtaaacgtcagccgctgctgttagttccgcgtaatggtctgggtgatcgtgtgacggcagcctttacaaaagagtggcagtcgctgggtggcagcaccgtgcttcagcagcgctttggttctgtttcagagctcaagcaaggcattaacagcggtgccggtatcagcatgagcggtacgccggttgtcatgccatcgtcttctcagccgcaaagcgtatccattgcagggctgaatattccggcacctcaaactactgctccggcagccagcagtggcggtgcgatagatgccgcctacatcgtctcgactcaggatgaactgcaactgattaaaccgatgatcagcatgcgtaccggtagccgtagtaacgttgcgctctatgccagttcgcgcagcgcgcaggcgggagcaggcccggatttccgactggaaatggaaggactgcagttcagtgatattcctctgctgtctggcgctaacccggcgttgatgcagcaggccgcaaaatcgtttaataacgactattcgctggtgcgcctgtacgcaatggggattgatgcctggacgctggctaaccacttcaaccagatgcgtcaggtaccgggcttctcgctcgacggcaataccggtaagctgagcgccaccactgattgtgtgatcaacaggaagttgacatggaaccagtatcgccagggcaatatcgtaccggccagctaaaccgccgccgtacgggggccgagcatgaacaactcgcccgccgctatcttgagcgggcggggttaacatgggtcgccagcaatgtttactatcgcgcaggtgaacttgacctgataatgcgagacagacaatgttgggtgtttgtcgaagtgcgttaccgacgtaacgcccgattcggcggcagtctggccagcattacccgacagaaacaacacaagctgctgcgtgccgcctctctgtggctggcgcaacgcggcggcagttttgaaacagtgaattgccgtttcgacatcattgccattaccggcacggcgcttgagtggttgccgaatgcctttaatgcagacgtttagaaccaggtggtcgtgtgcaggaaagaattaaagcgtgttttaccgaaagtattcaaactcaaatcgcagctgcagaggcgttacccgatgccatttcgcgggcagcgatgacaatggtgcagtcacttcttaacggtaacaagatactgagctgtggtaatggcgcgtcgtcagccaatgctcagcactttgccgccagcatgatcaaccgctttgaaaccgaacgccccagcctgcccgcactggcattgagtgcggacaacgtgatgctgacggcaatcagtaacgatcgcctgcatgacgagatctatgccaaacaggtgcgtgcgctgggacaaaccggcgacgtgctgctggccatctctacccgaggaaatacacgggacatcgtgaaggcggttgaagccgccgtcacgcgcgatatgactatcgttgcgcttaccggttatgatgggggcgaattagccggattgctgggaccgcaggatgtggaaattcgtattccttcacatcgcagtgctcgcattcaggagatgcatatgttaacactcaactgtttgtgcgatctgattgataacaccttgtttccccaccaggaatgacggaaggagcaccaatgaaagcattgaacgctgtagccattgttttaaccgccatgctgctgcaaggctgcgtcgcggtggttgctggtagcgccgctgttgcgaccaaaaccgccaccgatccccgctcagtcgggacgcaggttgatgatggcacgctggaattacgcgtcagcaacgcgctggcaaaagatcagcaaatcaaaaccgatgcccgcgtcattgccaccgcctatcagggcaaagtgctgttaaccggtcaggcacctagtcaggacattgccaaccgcgcgaaacagatcaccatgggcgttgacggcgcaactgaagtctataacgaaattcggattgggccgaaagtcagccttggcacctcatcgtctgacacctggatcaccaccaagatccgttcgcagctgctgggcagcgatcaggtgaaatcgtcaagtgtgaaagtcaccacggaaaacggtgaagtgttcctgttaggcctggtgacgccagacgaagccaaagccgccgcagatattgccagccgggtcagcggcgtgaaacacgtcactaccgccttcacgatggtgaaataacgctgcgttagccgctgtccagacctgctgctgccgcacacagaaaagccgcaccctttcgggttgcggctttttttatatggcaaacaaacgttaaccggctcgccgtacggctgaacaccgcgctcagccagcggtgttatccgctgccatcaccagagaagcatcagaccgggatatcaatcaccagcgcgcgggtcggcgttattgccgacagccacagctgctgctcttcctgcaaaaatgccccatcaccacagcccaactgttcatgatgcgcagcacccgctgaggcctctaacgcgccgtggatggattgcagataggcgcgcgcgccctgaagcggcaccaggtgttgttcccctgctgccagctcaagctgatgaatccagacctgctgtcgcagctgaaggctgttgtcgctgccatcgggggaagccagcaactgtgaacgcgttccgccagacagggtgattttctgcatacgcgggttttcacgttccgggcaggctgccagccagagttgcatgcgcgttaacgggcgatctttactcgggttaagttcgctatagctcacgccaggctgcgcagagaggagcagcgcctcaccttcactcacggtgatgtgattgccttcgctgtcacggtattccgcctctccctgcaaaacgatgttcagcacatccacctgtggataggtgcgcggctgaaaagccgcgccaggtgccagaacttcctgatttaaaacgcgtaaggaggcataacccatcaatttggggtcgaaatagtggccaaaagagaaactgtagcgcgcctgtaaccaaccgtaatcggcctgaccacaagcggatgcactgcgtgtcgtaatcattctttacctcctgcatccgtcggcaaggatcgacgacgggtatgattcctttatggtaaaagtctggacgccggattgttagccagttaatctgcccggcatattcaaatttcctgacagagaaccgggatggctaaagatcgtgcgttaaccctcgaagcattgcgtgtgatggatgctatcgatcgccgtggcagctttgccgccgccgccgatgagttagggcgcgtgccctcggcgctcagctacaccatgcagaaactggaagaagagctggatgtggtcctgtttgaccgctcaggccaccgtaccaagttcaccaatgtaggaagaatgctgcttgagcgcggtcgggttttgctggaagccgccgataaactcactaccgatgccgaggcactggcgcgcggctgggaaacccagttgaccatcgtcacggaagcattaatccccaccgatgcactgtttccgttagtcactaagctggctgacaaggccaacacgcagatttccatcatgacagaagtcctggcgggggcatgggaaaggctggaacaggggcgggccgatatcgtaattgcaccggatatgcattttcgcgcctctaccgagattaacacccgcaaactttacagcatcatcagcgtttacgttgccagcccggaccatccgatccacgacgaacctgagccgctttcagaagtcacgcgggtgaaatatcgcggtattgccgtggcggatacggcccgtgagcgcccggttctgaccgtgcaactgctggataagcaacagcgcctgaccgtcagtacgatggatgataaacgtcgcgcgcttctggctggtttgggcgtggcaaccatgccttataacatggtggaacaggacattgcagagggacgcttgcgggtggtcagcccggagtattcccgcgaggtcgatatcatcatggcatggcggcgtgacagcatgggggaagcaaaagcctggtgcctgcgcgaaatcccccgcctgctggcaaagaaaaattaacctgacgagaacgatcccctgatgtttacagtcgactcaggcagtccagcgcgacggttttaaaacaggcaaagtcgctgctgtcacgtaaacgcgtcatggcccgctcgcgcataaacgtcacaaacaggtcgtagatagccatcgcttcttcatactcgtttttgctgatcgccagcaggaatatcacgtaagccgtatcgtctccccagggaataccttgcggggccagaacggtatagacgaccgtttttttcgccatcaggcccagcgagtgcggtagcgcaatgccctcacccaacatggtgctgacgatggcttcacgctcctcgacggaggcataaaacgcgtcgtccaccacgccttccgcttccagctgatggcacaataaccggaacagcgcagactgggtcatcggttcgtcgataatcctgaaatgacgggcatcaaaaaatttctccaacatatagggtcgggtgcgatcgaccagcaccagcttacctatctgctccagctgaaattccgtggggaaaggtgccaccacgacaaccggtttctctttttcactcagccgcgtggtggaaattacaaaatcttcttcgatgcgctgacgggcttcatattcacgctgcgacaggcactgggtgacctgcaactgcggatagttacgcatcagcatggcttctatcatgcggagcgtggagttgccgctgtcgcacaccagcaatacctgagggcgacgctgatagcccacatcataatggcgctccagcccgacgccgatgtggagcaccagaaagccaatttcattttcgctgatggtatagggcgagtatttgccccagctggacaccgccgccagggtcacgtcataggccatcggataatgctgtttgatgttgcttaacaggggattggggatatggatctggtaacgcacccgcgtgatcatggttttaatgtgggtcagcagatcggcccggagctgtggatcgttctggagattgtaatagtaatgggtgttaataaaactgagcagataatcgaccagcgcatccgcatcgtccgcattaatggcgctgggggcaatgtcctgaatacgtcgggcggcgatatttacccgcagccagctctcttccgccggagaaatgggttttgcgatgagcggccgcagcgcatgaatcagggtttgcgccgactcgcgcacgtcatcaccgatctcttccgcctggggatcgctcaatgggtagccttcattgatacgacgtatcgccaccgcgcagtaaaagcgcaaatagcgctcgccttcatcgctaaggcggatattgtgctgggtaaagctgctttgcagcagcggctgcagagtgtccagcaggccgttttccagcgattccggcacaatcaatgggctgtccggctgctcttgctcgatctgaatcagcagatcggttaagcaagtgcggatcgccacttcactgccaaacagtttcatgccgtgatggggcttactttcgatgctcaactgataacgcccgagccagtcgcgcacgtcggccatatcattttgcagcgtggcacggctgacaaaccactcctccgccaggttttccagcttcaacgaataagcagcggtcagaaagcgcaccagcaggtagcggattcggtcgtgtgaagtacgcggcacccgcagcggtgcgcgcgtttgctgttgcagcacgttaaaacgctgcacatcgctaattttaagctggtaacccgccccgcgattcaacacaaactgcgccccatgctcctgtagcaaggcgttaagcgcggtgatatccgttcgtacggtgcgcgttgatacagcgaagcgccgcgccagttcatcctggggcagcgtttcgtttttcaacgcgtcaaacagttgcgcaaggcgctggttaggaaatctcacgttgggttacctgctgcagccattaacaaggacgaggtaaacgccagactgccaaaaacagacggcagcgttatcatgcctgtgcgccgtcatcacgtccatgaagcggcgcacaggcctggactcagtccagcagacctttacagatggccagtagctgacgcacgtcttctacgcgggtttcaccactggcgctgtcgatgatcgaactgtaaacatggggaatgactttgcttacgccagcatccagggcaatgcgcaggatcggcccgacgttttgcagatcaatcccgcccgtgggttccagccaaaaatcctgcttcgcacaggcttcggcgacagcgcggaactcctctgccgtcgccagcccgcccatcgggaagtacttcacggaactgccgcccatgtctttcaggagcgcaatcgcggtatcgactggcacaatgccgtcgctggcctgtgagctgagcggcccggtggaaatcttcactttacccggcgtcccggtgggcgaaatcagcccgttgaccaccgtttgtgactgaccgagcagcgcacgactggtgcccacgccggtgaacacctgattgacgtgctgcggctgcagcaccgctgcaatctcactcaccctctgcgacatacgaggatcgcccgcccccagaccgatggacagcgcgttatcaatcagcgcggcgtattcgcgcatatccgcaatagcggcgtcgttgctggtgtaattttttgataatacgccaaccaggacgtgcccttctgcggcctgccagatagcgcgggcattctcttttgagcctgccagcacgttaaggcacaggcggtcctgataaaaatttggggtgagcgtcatgctatttttctcctgttaacagcgcctgaatgcgggtgaaaataatatgcagttggtcagcactgacgctgcgcacgtcggcctcaataatgccttcgttggccttgtagccacggaagtaaatggcgatatcaccgtttttcagggcctgcaccaggtcgccggtttggtgcccgatcgcgcgctcatcaaagtgaatttctgcacgagcaatgtcacgtccggcggcatcccacacaacgcgggcgctcacgccgttcagcccgttgaggttgttgataaaaggcgtcattttttccaccatctgcgcgccggtggtttttggctgggtcaggtaggactcaatcgcctgcgtcagtcccagaatgccctctttaccgactttcatggtgcgaccaatgccgttgctctggcgcttcacccactcaacaagctgatgcttcccgataaccaggccgctggtagggccttcgatggctttggctccgctgtaaatgaccaggtcggcacccgcctggtaataacactgcagatcttcttctgcggcggcatccacgataagcggcacgccatgcttacgtgccacctctgccgcctgcgcgacgctcaggtggctcttttgcacgcaatgatgcgacttcacatagagaatggccgccgtctgggcggtgatcgcggcggcaagctgctgtggagagcactcattactgtagccggcctccacaacccgaccgccgcccagcgcgatcatgctgccgacgggcgcgccgtaattcacgttatggcctttcggcaccacgatgtcatgcgctacggttagcggtgccgtgtgcaggttatccagcagccagtcatcgtcttttacaatcaccgccgccacgctctgggcgatgcccgctgaggcacaggataccaccagcgcattttctacctgcagcagcctggcaatgtaagcgccggtcttatcgaccagatccttgacttcaaaatagtgctccaggccgtactcaaccgtctcaaccacgtcgcgggccggtgtggacacgccaaggatggtcatgcgcccagaggcattaatgacctgtttcaggccatatttctcatacagtgaagacattgtgttttttcccttcttccgtcatccagcactcaccagcgacgatagccgccagtggaataagttggcgatcgccctgttcggtcagcccttccgtatccacaaatgacacgggttcctgcgccacgctgaacagggtaaagtcggcgtcatagccgggttggatactgcctttgctgtgcaatctcagcccgctggccgcctgatgagttacgcaggcaataatctgcggcagcgtcatccccacattgaaaaatttcgacatcacgtgcgccagggtataaaccggcccgttcaggcgattgcggcagtagatatccgaactgatgctgtgcggcagaatgccctgcgctatcgccgcgcgtgccacctcaaagctgaagctggcactgccgtggccgacatcaaggcgcacgtcccgcgccagcgcatttttcaccgccgcacggagctgcccttcgggcgtcagaatgcggttcggcttgccgttgtaacaatgggtgatgatgtcaccggaggtcagtaacgcggcgatttcatccaggttcgggggagtgttaccaatgtgtaccatcaggggcaggtcgccattttcctgctgaatcgcctttgccagcaccagcggcgtgatgccgttttcgcccaccacactgctgctcattcgggctttgaaccccagaataaagtcaggatgacgccgcaccgcatcggctatggccgggcgatcaatctgcgtcatatccgccagttcattttgggtaacaatgccggtgcgggcgatgttcagcagggcgtaaacctgggtggtggccgcccgcgtgatctgccagaaatcatcgatgtcgtctgcccctgtactgccagcatccacaacgcaggttacaccgcacgccacaccgacgtggtcagggtgatcgtgatagatcggcgagttggcgtagcagtgcacatgcgaatcgatccagccagcgctaagataacagtccgccgccagcgttttttccactgttgccctgccgctcacctcacccacctcggcaattttaccgtcgcgtatggcgatatcgatcagactgtcatccggcaaacgtgcccgacgcagaatcagatcgtacatagaaacctcctttggctcgcccgatcggcctgaaccgatcgggcatcgccgcgatcagatcgcgaccggaaaaatcgccccaaggatcatcgcgccgaggatcgccccgccggtgatcggtttattccacagatagaacaccagcgcgcccagcagtgaaccgaggccaatcgggatcgaggcacccatggcagccagaataatcagcggccccagaaagcgtcctgatgcattgcccgcgcccatcatcacgtccgcaccataggtactgttgctttgattaatggtgaatttacgcgccagaatgatgacgtagcctatcgccacgccaataaccagaccggtgaccagcgaagccgcaaaattcgcaaccgggaagacaaaacccgcgcccagcagcagcgcgggcacgcccagcccgacgccggtctgaatcgccccgccgatatccagaatcccgaccagcgatccttcgatgatacgggcgaacaaaaagctggcaccgaaagcggcaacctcaccataaacccccgtatcaatgcccgcgcgtaacatagagacgaaagccacctcgttgaaagccccgatgccgtacaggtagtacatatgggttccggcaaacacgccggaggagagcaaaccgacaaaaatcgggaacgaccagtcggcataccagaaacctttgtttgattcttccattgcagatgctccgttatttgccgctcaggctgttatgaatactgtcgagccagccaggaatgccaagctggaaggattgcagcatcttcatatcgaaaccgcggaagaaggcgctgaggacaaacaaggcgacgatggcgctcatcatgactttggtcactttgttccagccgctctcttcaacccctttcccaatcaaaatgcccagcaccaggcccggtacggcattgcccataatcagctgtgccagaccgccaaagatagtggcccagaagcccgattttttaccggcatcaatcgctgccagccagaagatcaccggcatgacggtgttaaccagcagattggctgccggcaccaggaccttcaccgccgtgacctgcagggccgctggcacagcagaggcggtcgagttgagaaaagccaccaccaccatgccgatgatgccgcaggcgatagccatctttttaggatcgtgcagcgtttgcgcgacattgcggtttttgaccatgattgccgccgcgccccagttggggatgatgcggtgatccacatcctgggtgaacgcgccagccgccacagaggaagcccaggcattaaagaagaaccccaacccaaaagagaagtgagaggcaggatcgccttcacaggagttgagttcacccagtgtgcgaaatgcgcccataccttgtgtcgtcggcgcatggaacatgcgggcggcacctgcacccacaccgacgcccacaaggccgccgataattaacgacttgagcaaaatgatgagaaacatcctctttccttatataagttgtttgaggcgaggtttacacgcgggtgaagtcgactttgtcaccgtccaggcaggtcacattgatggtgacctccaggtcgacgctgaagtgcctgcgctcacgtgccaggaaaaagaaaaggaatttttcagttgtgacgcgttccagcgcacgcaccacctttacgtcctgcggttcaatgcgcagcagaatcttattggcgttgcgcaggacttcgtgctgtacccggctaagcgcatctgcaaaggctttcgctttggtatcgcccttaccgcttacggcaaccgaggttgtaaaggtctctttcattccttatccaccgtgttttttgcgccaggcctgaaccagacgttcgcccagctcttctttgtccataaagccaaagcccagcacgttggccccttcattaatggcggtcacgccttcgtcaacggagcgcatgccgtgtttggccttatagccatatttgttttgcgccgtaatcgcacctgcaccgccgctgccgcaaaaggagataccaaaatccgccgcctctgctttcatgacatcgcccagcttcatgtccgccgcgacaccgggcacgaccaccgcacggccacccgctttctctacgccagccgcgactttctgtcctttacctaaacgatcgccaatcactacggttaccatatgtctgttcctctcacggttgaaaaattagtcgttcttcgctacttcaaagtggacggagagcagccaggcttcttctggtggtaaattgccaaacagatccaccacctgctgcgccagcgccatcgactccctggagatttcgtcaaacaggtcagcctcaacctctggcagactttccccggtcacggatcgcaatgccatggcccgcacatgcgaagccagcatctggatctgcacggcattcggctggatggatcgctcagcaaaaagcgccccaatctgcgacatcacgcgatccgccagggcctgaatagtttgctgttcgtcttgtgacgcattcatcgctaccgctccattacacatactcatcgtctgcttaccgttacgcgtttagcgcgatcccaaactaaccagcgacgggacggctgtggagaaggactttttccgtttcaaagtggaaatcctgcacccgtgagcgatcggtagcgcaaacttcagctatcgcctggccggaatgatttttttgttaacagaaacagagagttaataataggatgtaaaacgggcaagacggcacgggagggataagcggaaatttgggttgctggtcagccgtcacaaaaccaacaaacagcaaccctgaggatcgggttaacagagaaacttatgacgccgcgttcgagggttttgttaatcgcttcacgccggggttgtcgacagcaggctggaggcgatgctttttacgtcggccaatggcggccacgatcagggcgaaacgggcttcattgagcctgtagcagaaccccatgatcagcgccgcgacaatcgccagcgtgcagggccagataaagatcaactgccttaaccccgccagcgtagcgctactttgtacggtgttcggcacgtagcctatctgcgtcagcatcaggccgggcaaaaaacccgccagcgcggcagaaattttacgaaagaaggtgtagccagtgtaacaggcaccttctgcccgaataccggttttccactcgccgtattctacggtatccggtaccagcgcccagttaaggctgttaacgaacgccgtgccgaaaaatgccacgcaggagaacatgacgaacagcagagagctgttcccccagagaaagttacacagatcgcccacggcccacaggagtaacccacccaggtagacctgttttttaccgaactgttttaccgctgtgggcaccagcagcaccccgaccaggatacagcccatactgaaaaagcccatccaggcgagcagatgcacatcattcaggacgtactgggtgtaatacacctggatggccagtttgatgttaaacgccgccagggtacacaggttcgccaggcacaggacgcgtaacggtggattgtgaaagatagcgcgaaatgccgttgctacgccgggtttatgatgggctggcgtgacctcaacatagcgctctttgacgccgcggtaacaacaggccatgcacagcattccgcaggtcacaaagagcgcggcagccacctgatagcccaacgcgcttttgccgacaaacagcgactggattggcataaagcatacggtacacaccagcaatcccaacgttgccccaccttgtcgccaggcggcaagatgagcgcgctccgtgggatttttggtgatagccggcaccatggccccatacgaacagttcatcaggctgtaaaacaggccgaacatcataaacagcgccgtcgcgatcgtggtctttaccgtcaggctaaagtcgttagcaacaaactgtgccgcagccaccagcgctaccggcagtgagaaacagagaataaacggcctgaatttgcccctggtgccaatatggcggcgtgaatccagcacaatgccggtgaacatatccgtgacggcggtgaagaatttggccaccaggaaaatcacgccgccgtaccaggctggcatgcccagctcatcggtgtagaacttgagtaaataaagcgtcccaatagtcagcatcaggttggagccaaaatcaccgaggccgtaagcaaacttctcgcgcagagggagtttcagcgtgaggggatcggagcctgtattcataagtgatccttttagcgccgcgaccggcgcagtcacagagccaaatcagcgctgacgtttacgggcatcaatctcttcaatgatacggacgtacattttttcattgaggttgtagaagcagcccattgccacaatcgtggtgaccgccagcgcgccgggataaataaacatcagctgctttaagccctcgacagtggcagctgactgaatgacgttggggacatagccgatttgcgtcagcatccagccggggaagaagccagccagcgcctgggataccttacggaagaaggtaaagccggtataaaccgtgccttcagaacggacgcccgtccgccattcgccgtactctacggtatcggacaccagcgcccagttgaggctgttcacaaaggcagagccaaaaaaagccaggcaggaccaggcgacaaaactgaccgaaccgccaccgataaaatagttgagcaggtcaccgacaacccaaatcactaatccaccgatatacacttttttcttgccaaagcgccgcaccgcgcccggcatcatgaacacgccgataaaaatgcatcccatgctgaaaaaccccatccatgacagcaaaatgggatcgttcagaacgtactgggtgtagtacacctgaatcgccagcttgacgttaaacgccccgagcgtgcagaggttggcaatgcacaagataaacaacggccggttaccggctatcgcccggaaagagagcagcaggcccggcttttgtgccggactggctggggcgttttcgacatagcgttctttaacaccggcgtagcaccaccacatgaaaaacagcccaaacgccgaaaacagcgtggcggctacgatatagcccagctgcgggcttccttccatcaggttcatcaccgggacaaaacccaccgtacagatcagcaggcccagcgttgcgccgccctgtcgccaggcggccagcgaggcccgttcgttagggtttttcgtcatggccggcaccatcgccccgtaggagcagttcatcatgctgaagaacaggccgtagagcataaagagcacggttgccactatcgttttgccggtcatgtcgaacggcgttccaacaaaattggcgatagccaacagggtcaccggaaacgcggcatacagcacaaaggggcggaacttgcctttcgggccaatcctgcgccgcgaatccagcatgatgccggtgcccatatcggtaaaggcagtaaaaaacttggcaaccagaaagatgattccgccgtaggtgcccggcagttccagcacgtcggtataaaacttcagtaggtagagcgtaccgatatctaacaaaatgtttgaacccagatcgcccatgccataggcgactttctctttaaagggcaagcgtaatgttgccggttcattgccggaaggaaggggttgctggctcatgagttatctccgcagccccactgagaaagtcagtgaggctgcttttttcaggatgggttagacgggttctgctgcgcaatgtcagcccggatagccgccacttttttgccaaacagcagctgcatcacggccagcaagccaaacgacggcaccagcacccaccattcagggatagccagcgcgcccttaatcagcatggagccggaggcaatcagcaggagaaacaccatcaggcggaaagcactgacggagatgcgttggtgcacgtactggcccactaacgatcccaggatcatggtgggaatgcagaacatcaccagcttgattgttgagattgttaacatgccgctggtggtcaggccgccaataatggcgatgttattcgcggtgaaaaacgcattgagcgtgccgcgaaaagccgccggtgccagattccttaacatgccgtagatcaccaccggtgggccgttggtggcaaaagccgatcccagcgccccggcaatcacgcccgttggcaccacaatccagtttttgtcatacacaggcagacgaggaataaacaggctgtagaacgaatacagaatcaggaaggtgcccagtccggttttcatgatgtaatccgggaaattggacagcgcgtagatccccaacgggataccggcaaacgagaacaggatcagcaccagggctgacttccagttggtttctttgcgcgacagccaggcggcatacagcgcggttgccgtgcccacgatgaccgacatcggggccgccattttgaccggcagcagtaaggttaccagcggcatggtaaccagtgcaccgccaaaccccgcacagatgccgataaaggtgtacaggaacataatggcaataatgatccagaccacatcggtggtgatttccagcccttccggtgtaaacagagtaaagaaatccataatcttttctcccgctactgtggcaacgtttagctgcctgttaaccctaatgaagcaaacaatggctgccattcgctgtcggcacgataaaacaccggcggtttgcccagcggggcggcgacggtgatatcaccgccgttaacgctttcaccggtccacatgttgacccagtggtcttcgggcaggtagagcgaccagtcgcggcggccttcttcatagaccggcgcaaccagcaggtcacgccccaacagatattggtatttcagcgcataggtgcgggcatccgcttcatagtgcagaaataacggacgcataacgggcaacccggcgcgggcgttctgcgcgacagcctgtttgagatagggttttaacgtggtgaagatcgtggacatgcgggcaaagtgggcaatggtttcttcatcgctatcaaactgccagttatcgccgggacggttcccttcatgggtacgcatcatcggggtaaaggtattgaagtcacaccagcgaagcaggagttctttactgcgttgcatcccatacagcgtggtgtagccaccgatgtcgctgtgatgcaaaccgtgaccactcatcgccagtgacaaggcggcaggcaccaccgaggccaggccatcgtccaggctccagtccacattttgatcaccggcccacatcatcacggagtacttctggctgccggtataacccgcgcgcataaagaacagaacgtcaccgagtttgccggtttcttccagcgcctcatagttgcacttcgcccatagcgccggccaggcgttatgcataatttcggcactgacgccgttgtgcaagtgggtgtccgtcggcaggtactcgccaaaatccgccatccagccgcgacagcccagggcaatcaaattgtctttgatcacgcctttgaaccactgatatgcctccggattagtgagatcgaccacgcccgcataaaactcgccaaattcaacgtggtaatcctgccctgccgcatctttggtcagataacccttgcgggcggcctcttcgcacagactgcggtcgctggccacataagggttgatatacgacaggaactgaacgccttccgctttccactgctgaatacgcgtgtccagatggggataacacgcgctgtcccactgccagttccacatcacgcgcttgccgaaggaggtcattcggatgccggaccagtcctgcgcccagataccgttcactttcacgcccgcctgccgcattctgtcgagcttctgctggcatacctcggtgccaccctgaatacccagcgtgatgccatcgtaaacccagtcaggcagttccggctgacgacccaacagggcactcattttttccagcagagcaatataagtgtcagcgcactcaaaacgtaatgtggcgttattttcccagaaagccagttcgtggtaatccgcggcactgaagtcaaaattcatgtagccgctgttatccacgtggcagtagaacttctggctgctgacaaacgtcggctgcgggaagaaggtccagtagtaatcccccccggcattctcggcacagtcagcctgccaggtcaccgcgctttttttattgcgcccgacgccctgttcgctggtccagagtgggaaaggtttaccacgcagatcaaaacaggagaattgctcgccacagccgtagatgtgatcgtctgcctgcgctgacaacctcagccagatacgattaagcccgccagaatcatttgtcagcgcaagctgtaggcggcctttttcatccgtgccaatcgtcagcgtggcactgaacacctcgccgcgtgagaagcgtaccgtccagccggtgtcctgggtggtaatcaccgcctctgtgagcgccagcttttcattcagccggtctttgatgctgaaattgccgcgaaacatatcgatatcggccttgccgttgccaatccacagacagggtttttccttgctgtggctcataatctgtcggttttgataagtcagtgaaaagccgtcaccggcggcagtaagcgttacgcctgccgtctcaggatgttgtaagtgcattctgacctctgtgttgtaggataaagaaggtaaggtttggcgttatttgagccgatcacagccaatcgtgaacgtcatgtgatggcgcgcctgcggcgcaagaaaaatcacatcaatgccagagttgaacgcatcaggtggacaactcatcggttcagcggccaggccagtgcggccaagtttttcgccgctgtaaatttgcagccagggttgatcgctgcgtaagaaaaccgaaagtgattggtgtgggcaggttaatcgcaccgcccattcgcgtccggccgtgcaggtgttcacactgcagtcgatctgcgtcgatgccagccgacgcggggtaagaaaatccccttcagcaatcgccgcgggcagcgtaagcaggcagtcatcgacctgggtcatgttgcaggtcagataaggatgcgagccaactccgtaaggcgcgggttgattgcccacattctggctgctgagggtgacctgtaggccctgcgcggcatcgagccggtaagtggcctgcgacagcaatgcaaatgggtagccgtaactgggcggcagaaataccgttaaggtcgcctcgctgtctgtctgtttggtaatctgccagtcacgccaggccagcaagccgtgaatggcggtgcccccttcgtggtcgttgattgggagctgaagcagattgccgttatgacgccaggttcccttcgcgatgcgattgggccagggaataagcactttgcccatatgcgccagtggcatgatttcaggcggatgtgggagcaccaggtggtggtcagcgtgcctcaactcagccaggccggcacccacggtaacgatttttgcctgatagtctccggcacgaagaacaagggtttgtccgctgctgtgcatagctggtactcccgtttttaggttttttagggattatttcgcgttacagtccagtaagcctgccgccacagccggtgccagacccggagccagtggaaggcgcgggatcaccaggcaatgcaacaggtgatagatatcctgtttgccgtcccacactttggtggtcaccttgttttcgcaatccagctcttgccaccatgagccgttctcgaaatccatcatgtaggtgatgcagtaatcccaccatttctggtaccaggcttcgtattgcgcttcacccgtgacggtatataaggcgtaagccgtgcccattgcctcgaccacgggccagcgcactctttcactcaccaccggcttgccgtcccagtccacggtgtaaacaaagccgtctgcgccatccggcgcccaggcatcgcgaatggtggcgtggaataagcctttcgcatcttcaataagccaggccgggggcgtttcgaagcgcgcctccagcgcagcatgcagatgcagcatcaggcgtccccactcaatccagtgtcccggcgtaccgccgtaagcccggaagcggtgagccggattctctttgttgtaatcgcgcaggggattccagtcagtatcgaagtgctcattgacccggtactcaccgttgcgcgcgacgtcgtgaataatcaccgaggtgacacgcagggcgcggtccagccatttcttatcgtgcgtgacgtcatagacaatcaggaaggcttccacggcgtgcatattggcgttgccgccacggtagtcttctgttttgctgaaggcttcatcccaggactccaggcacatctgctcgtcttcactccagaagtaccgctcgatcacgtcgatagcgtcattcagcaactgacgggcagcaggatgccccgtcgtgaccgcgctggccgcgcccagtagcacgaaaaagtgctgataaccctgcttggaggcatcgacaacaccttcatcgtttacgcaggcgtaccagccgccgtactttttatcgcgcagcgcgccattcagggcgttaataccgtgttcgaccagtgagtaagcccccgggcggcccattgaggcggccacggcatagacatgcagcatgcgtgcggtaatccacaggtgcgtacccatatcaggttttacctggccggtatttcccagccagccaaatccagtgggtaccgctgcgtttttaccaaaatcgagaattcggtccgtttcctgttcgagccagcggttgtggctcaatgtgttaaaccatttcatgtgcttttgccctcttaacgtttagccatcatttcatctacgatctcgcccagccgttgcagcctggggacggagacatcccgtaacatcaggtcggtgtcaggtaatccgatgacggaagaccagacggcacgcccggccaggaagcccgatgcgcccgcctgcatggccacccggacggcgcgcgggaacaatttttcatcaatgcccgacgagaggatgacccacggcatggcgatccgatcgttgagcttttgcgctgccgccagcagatcagactgtgtgcctttgccaaacagcggcatttccaccttgtagagatccgctccgctgttgcctaattctgtggcggcatcgaggatcgcctgctcgcgatcaaagcgatcgccacgacgcggcggtctcaccaccggttcgataatgctgagcagtccatggctgtggcagcgcgcgttgaaggccttaaccatgtcaagacgctgctgcggatcttcatcactgcgccacagcaccagcagcttgagcgccttcgcgccgtcacgctttaccgccgccggatcgacgtttttatcgatcaccacgctgtctaccgggatgccattgcctggaataaattcatctgccgcgacgatcaggccgcagccgggggcaaccgcttgctgctcgacgatttgctgaaaacaaaactgttgatcgaccaggatcgccgaggcatagggcgataaaacagtggcggcattgactttaaactcggtcagcacgcgatcgctgaccggaagtgacgcgccagcggcggcgaacatcaaacgcatcgcctcacgctgatcgactgcgagcatggcgaaaccacctgaaggtcgggtgatatcgttaagggtgtaatgagtcatgcttctttcctctgagtaagcgtcacaatgtgttggaagtggtaaggcccgcgctggcgcgaacatgttcgagaatggcggtccagtcctcgcgtccgcgtccggcagcgcgggcctggttgtaaacttcacgtgaggccgcgccaagcggcatcggtacatgcagctggttggcgacatccagcgcaatccctaagtccttgtgggccagatcgatcataaaggccggtgaacaatcccctttcaggaccttgttgggccaggtcgtggtgaaatgccctttgcccgcaggcgtgccgttcatcacctgcagcgcgacgtcaaacgacagtcctaacccttcacacagcaccgccgcttccgcagaaagcgcattcagcgcgatgctcatgtagttgttgatcagcttgacgcgaatccccatgccaggcccgccggcagggatcagcgcatcacccatcgccattaacaccggccttgcccgctcaatctgttgtggcgtgccgcccgccagcagcagcagcgttccggctattgcgtggtcagatgtgcgccccacgggcacgtccatcatgctgaaaccgcgagcggtcatttcgccgatcagctgatcggtttgcagcggatggatcgtcgacatatcaatcaccagcgcattgggtgacagcgtggtgcaaatcccctggtcgccaaacagcacatcacgcactaagtcgccgttgggcagcatggtgatcgcaaactcggcccctgttgccgcctcggctgcggagacggccgcccgggcacccttgtcggccagccgcgcgaccgcctgacgatccacatcaaagacgttgagctgatggccttgcttaagcagattgcttgccatcggcccgcccatttgccccaacccaataaaagcaattaccgacatagcgctctcccaaaccctgtgattgtcatattttgtcatcatggatgatatttactgtctgctttcgatcatatttgtaatttatggtcaaaaaattgacaggtgtcacttttaaaacatttgatgaaattaaaatgacagcactgaaaaaaagggaggaagggtcatgacacgtattgcttgtgtagggatcgccgtattagatcgcatttggtatctggatacgttgccgcatcagggcggaaaatatgtggcaaacaactatcgggaagtgggcggtggtccggcggccaccgcggcggttgctgccgcaaagctgggcgcagaggtggattttattggtcgcgtgggtgacgacgacaccggtaaaaggctgctgtctgaattaaatcagtacggcgtaaacacccgctatacaaagatttatgaagccgcccgctcttcgcaatccgcgattcttgtggatgccgaaggggaacgcatgattgccaactaccctagcccggacttaccggaatgcgcagactggttaacaaaaatcgacttttctcaatgggatgcagtgctggcagatgttcgctggcatcagggcgcaaagcgcgcatttatcctggcacgtcaacagggcgtcccaacgattctggatggggatgtcaccccgcaggacattggtgagctggtggcgttaagcgatcatgcggcattttcagctcctggtctgcaacgtcttaccggtctggagggagaaacggcggcgttgaaaaaagcacaactgctcacaaatggtcatgtctatgtgacgcagggcgtacagggctgtgtctggctggaagctggcacgctgcagcatcagccggctttcgaggtgaaggtggtcgataccaccggcgcgggtgatgtctttcatggcgcgctggccttcaggctggcacagaacggcgcagtcgccgaggcggtacgttttgccagcgcggtggccgcactaaaatgtacccggccgggtggacgcgcggggattccggattatgatcagacctgttcttttatgtcagttaatgtataaactgtgagccatggtggtatttagagaacaacccatgatccttacggacgtaaccggtaatccccgccacgatcgtttactcaggctgatcgccgaacgtggctacatgaatattgatgaacttgccttgctgctcgacgtttccacacaaacggtacgccgtgatattcgcaagcttagcgatcagggattaatcacgcgccatcacggtggcgcagggcgtgcatccagcgtagtgaataccgcttttgaacagcgggaagtctcgcagacggaagaaaaacgcgccattgctgacgcaattgcggactatattcctgatggctcaacggtatttatcaccattggcaccacggttgaacacgtcgcccgggcgctgttgaaccacaagcatctgcgcatcattaccaacagcctgcgggttgcccatattctgtataaatgcccgcagtttgaagtgatggtgccgggcggcacgctgcgcccgcacaacggtggcattatcggcccggtcaccaccgcttttgtcgccggttttcgcgcggattatctggtcaccagcatgggcgcgattgaaagtgatggtgcgctactggaatttgatgtcaatgaagcctgtgtggcgcaaaccatgatgacgcacgcgcgtcatattttgttagcggcagaccacaccaaatttcaggcctcggcagcggtagaaatgggcagtataaagcaggcgaccgcgctgtttacggataaactgcccgcagcggccctgcaaaatttactgaaagcccatcaggtagaaattatccaggctacgccaggcggcgatgaggatgcctgaataactaaccccggccgcgccggggttatcaacatcgttagcggaacttcttgtggttttcgttacggatcgcagccagtttttgcgcttctgctttggcttcatccagcttgccctgcttcgccagtgcatcggctttatcaatctgggcaatcaggtcatccatgcctttatggaagtctttcatttccgggctgtcaggtgctttgccttccagtttatccggggtgccttttttggcatcctcggctttggcacgcaaatcactcaacattttgtgcagctgatcggcgcttttcgccccgtccagtgacttgtagatacccgacatatctttcatatcgtgctcaagagaggcagcaccggcggtaacgctaacggataagacggctacagcgaacaacgacataagctctttacgcatgctcagcttcctttttattgtgggaatgctttttataaaaaaacggagggtcgatgccctccgcttgctatcgcataaacaacttaaaagagattttactgtccggcaatatacatttcggggagtaagaccgagccgcactgaatattgctgcgggtttcgatgtcatcgcccacggtgacgatgtttcgccacatgtcgcctaagttgccagcaatggtaatttcgcttaccggatactggatttcaccgttttcaacccagaagcccgccgcgccgcgtgaatagtcaccggtgatcgcgctgacgccctgtcccatcaactcggtcaccaccaggccggttcccatctgcttcagcagatcgttgaagctgtgtccctgaccggcgatgcgccagttgtgaataccgcccgcgtggccggtgctggttaagcccagcttgcgcgctgaatagctggtcatcaaccaggtctgcagcacgccatctttgatgatgtcgcgagcctcagtacgcacgccttcgctgtcaaacggcgtcgatgctaatccttttaacaggtgcggctgctcctggatggtaagccattccggcagaatctgtttgcccatggcatccagcaaaaaggtggatttgcgataaacgctgctgccgctgatggcaccgaccagatgcccaaacaggccggtcgccacttcgggtgcaaagatcacaggcgctttcatggtgtcgagcttacgtggcgcaaggcgcgacagcgtccgacgcgcgcattccgcaccaacccagtcagggctttttaaatcttcgatggcacgcccaatggtgtaagcgtagtcacgctccatattgccgttctgctcagcaatcacgcagctggacagcgaatggcggctggagcagtagctctgtaacatgccatggctgttgccgaacactttgataccgacgtgactgttaaagctgccgccttcggtattggtgatgcgcttgtctgcctgcaacgccgcctgctctgcctgcgccgccagtttgatggcataatcggcatcgatctcccacggatgatagaggtcaagatccggagcctgataggccagcaactcggcatccgccggtccggcaaagggatcgggtgacgtgtaacgtgcgatatcaatcgccgcctgcacggtccgtttaatcgcatccgggctaagatcggtcgatgaagcactgcctttgcggttttgatgataaacggtgatgcccagtgcgccgtcactgttgaattcgacgttttctacttcgccgtagcgggtgctcacaccgataccggtggtcttgctcaccgcgacttccgcgccatctgtacttgcttttgccagttcaagcgcctgtgcaattgcctgttccagtgcttttcgctgttctgcaacttgagttgatacgttcatcgacctgccgtctaatcttatggttgaataatttgagtctatcagagtcagagaacaatttcgcagtcacccgataaactggtaggattagcctcttttttttggagccagatatgacaaagcagcctgatgagtggctcgacgatgtacccgataatcacgaagaagacgaagaagagattatttgggttagtaagagcgaaataaaacgcgatgcggaagagctaaaacgcctgggtgccgaactggtcgacctgggtaaaaactcgctggataaaatcccgctggatgagcgtttacgtaacgagattgaactggcacagcgcattaagaaagaaggccgccgccgtcagttacagctcatcggtaagctgttgcgcagtatagatgttgagccaatccgcattgcgctcgacaaactcaagaaccgccataatcagcaggtcgccctgtttcacaaactggaaatgctgcgcgatcgcctgattgatgaaggtgatgaggcgatgacagacgtgattgccctttatccgcaggcggaccgccagcagctacgtagtatgattcgtaatgcgcagaaggaaaaagcgggcaacaagccgccgaaatccgcccgtcagatttttcagtacctgcgtgagttagcagaaaccgtctgacctttcctggtatttgcggctgagcaacgcccagccgcagggttttcttctcccatcagagggagaggaaatgatccgctaccgattagcgatccagacgatccagcagcttttgatgaatcccaccaaagcccccgttgctcatgaccagcacagaatcccccggctgagccgtttttgcgatcatctcaaccagcgtatcaatatccgcgctacagtgagcaggctgcatgcaggcatctgcaacatccgccacctgccacggaatatgtcccggctggaacaggaacacttcgtcggcgcgtgccagtgatggcgcaagctcgtttttattcacgcccattttcatggtgtttgaacgtggttccagtaccgccagaatacgcgcggttccgcccactttactgcgcagtgcgctgagcgtggcaagaatcgcggtaggatggtgggcaaagtcatcataaattttgatgccgtttacctcaccgcgcagttcaaggcgacgacgggcattgataaagctgcccagcgcctggctggcgtcttccggcttcacgccgacgtggcgcgctgccgcaatggccatcaggccattgtgcatgttgtgctcgcccaccagcgcccagttcacttcgccaacgttctcgccatcaagcagaacttcccagcgtgatgcatccggggtcagttttttcgcctgccagtgaccgccatcgccgacgtgttcctgttcactccagcagcccattgccatcacctgtttcagattaggatcgtgctctggcagcaggatcttgccctggcctggtacaatgcgcaccagatgatggaactgtttctggatcgcccgcagatcgtcaaaaatatcggcatgatcgaattccaggttattcaggatcagcgtgcgggggcagtaatggacgaatttggaacgcttatcaaaaaacgcgcagtcgtattcatccgcctcaattacaaagaatgggctttttcctaattttgcagaaacatcgaagttgccgggcacaccaccaataataaagccaggttccaggccacaggcctcaagaatccacgctgccatgcctgccgtggtggttttaccgtgggtacccgccacggccagcacccaacggtcgcgcagcacaaaatcgtgcagccactgtgggcctgagaggtaaggaatattacgttccagcaccgcttccacacagggattcccgcgcgtcatggcgttgccgataatgaccaggtccggtacaggatcaagctgacttgcgtcgtaaccctctgttaatgctataccttgctgctcaagtaaggtgctcatcggtggatagacgttggcatctgagcctgtcacctgatggccaagcgagcgggccagcatggccagtccgcccataaaagtgccacatatcccaaggatgtgaatgcgcataacgaagtccataactcaaaagttcggcgcacagtgtaaccttgcttgcacacggaagaaacggattaggactatggtttttaaagttcaatcggctaaactgcgtacgcatccacgggcagttaagtatgccgctgccactccatcgatgattcagggaatgtgttatgaaaacgttgggcgaatttatcgtcgagaagcaacacgactttccgcacgccacaggtgaactgacggcacttatctcagccattaagctgggcgctaaaattattcaccgtgatattaacaaagccggtctggtcgatattcttggtgccagcggcgttgagaatattcagggtgagcagcagatgaaactggatctgttcgccaatgaaaaactcaaagcagcactgaaagcacgtggcatcgttgccggtatcgcctctgaagaagaagatgagtttgtgatctttgaaggcgaagaaaacggtaaatacgtcgtcttgatggacccgcttgatgggtcgtcgaacatcgatgttaacgtctccgtcggcaccattttctctatctatcgtcgcgttagcgaaccgggtacgccggttgtcgaagccgactttatgcagccgggcaataagcaggttgccgccggttacgtggtttacggctcatccaccatgatggtgtacaccaccggttgtggcgtacatgcgtttacttacgatccgtctttgggtgtgttctgcctgagccatgaacgtatgacctatccggacgtgggttacacctactccattaacgaaggtaactacattcgtttcccgcagggcgtgaaaaaatacctgaaattctgtcaggaagaggacgtggcgactcatcgtccttacacctcacgttatatcggttctctggtggcggattttcaccgcaacctgctgaagggcggcatctatctctatccaagcactgccagccatcctaagggtaaactgcgcctgctgtatgagtgcaacccaatggcattcctggctgagcaggctggcggtaaagccagcgatggtcaaaaccgtattctggatattccaccggtcacattgcaccagcgttgtccgttctactgtggcaacaccgccatggtagaggacgtggagcgtttcctgggtgagttccccgattgccgtcagggctaaaaacgaagggcgcgatattcgcgccctttttggtttacgactgctgtagcctgaattgtgccatcgcagcctgtaactgctctgactgcgactccagtgaatgggtcgcggcggttgcctgttccaccagcgccgcgttctgctgcgctgcttcatccatttgcgtcactgcaagattgacctgatcgataccacgactctgttcttctgaggccatggaaatctctttcatcagcgccgtaacccgcatgacttcaccggcgatctcatccatcgtttcgcccgcgcgcgtcgccatttcactgccctctttgacccgcgtttgtgagtcgctgatcagcgtacgaatctctttggccgcactggcactgcgctgcgccagcgtacggacttcgttggcgacgacggcaaaaccgcgcccctgttctccggcgcgtgccgcttcaaccgccgcgttcagggcaaggatgttggtctggaaagcaatgccgtcaatcacgctcaggatatcgccgatgcggttagcgctgtcggtgatttcatgcattttttccatcacgtaattcaccacttccgcaccgcgatcggcactttcagacacggcgttagccagctgatgtgcctgttgggcgttgctggcgttgagacggacggtggccgtcaactgctccatgctggcagccgtttgctccagcgatgcagcggactcttccgtacgttgagaaagatgcacgttgcctgccgccagttcacggctgccgatatcgatcttcaggccggcttcacggacctgattaaccgattcacgcagtgcgtgctgcatgcctgccagcgcattattcagtcggcctagttcattattgcccgccagcggtaagacctgagacaaatcgcccgccgcaatctgctccaggtgagtaatcgcgttgtttaacggcgtcagcagcatacggcgtaacagtacccaggccagcaccagaagcagcagtgacagcagcacggcgatggcaatcagcaccttcatcatgatttcgttacgctgggcttcagccaactgcgcatgcgtaatttcatcggcttttttaccgaaggtttctaccgcattgctgtatttcactgacagcggctccagtttgccttccagcaactggtagtattcatcgttatactgtttatccagcgccttcatcatcggcaggatgccctgatcaaggtagtccttatagcttgatgcaatcgcatcggccataatcttcccttcggcagtcaccgtaccggcatcaacaaaacgcttaagattctgttgagatgccaccacatccgcctgcgcggttttggtgatgcttgctccctcatccagtaaaccaatctcaattttacgcactgccagcgcagcactggcacgtgcgcgcattaaatcggcattactttgatacaagctgtttaactcaatcccctgaatgcggttaaccacatccagcgaacgattccccttattaattgccacaatgcccatcacactcaccgccaacagcagcagtgtcatgaacgccagcaacgccagcaaccccgtgcgcagtgataactgtttcatcttgatcgtttccgtatgagtagtaaaaggcgaaataatttcgacaacccttaaacggaaaaagtatcggcaatgacctggctaaactttaacgtcaatagatgattaacatctctattaccgttaacctgttaatgaaactgaccggttatgtgggtaagccaaagaggaaaagcatgaagagagggttaatactggcgctggtggttaactgcggaggcgcattcgcgcagcagtccgatatcgatcttcagctaaatcagtgccttaataaagccagcaccacgcttgcaatggtgcagtgtaatgacagcgccatgaaaggctgggataaggaaatgaacacccagtacggtttactgatgaaaaaattaagcggtgaacctaaggataaattgcgtgcggcacagcgggcctggctcagctaccgtgatgcctggctggccgccagccgcagccagctcagcacccagggcacactggggtccgttgcgctcggcacacagggcattgcgctggtgcgcgatcaaacgctgatgctgcaatctttaaacaaaggcagttgcgctaaccccgacgattgttgattaatgtcagttcgttactggctattcgccgacgttttcatttacctgcaggaaaaaatcatggctgcttatgcctccacgcttattttaatcggccttgccgtgctgagttactttgttcacaacaccgccgtaaccctttctatattgattctgctggccattaaactgactccgctggcgcagttctttccttacgtggaaaaacagggcattacgttaggcattatcattcttacggtggcagtcatggcaccgctggcgagcggttcgctgcctgcgtcatcactgctgaagtcctttgccagctggcagtcgattgtggcgattctggtaggcatttttgtcgcctggctgggcggacgtggcgtgagttttatgagcgtacagccttccgttattggcggattgttaatggggacggtgattggtgtggcgtttttccgtggcgtcccggtagggccactgattgctgcgggcattgtttccttgtttatcaccgccaaatagcgttgaggagcattctgaaacgccaaaaagggggcggactttcacagtcagttggctataataaccgacactcaacatacgacgactaaaggaatacccgatgagtttgaaccaggtgccagcaggtaaagacctgccagaagatatctacgtaattattgagatcccggccaatgccgatccgatcaaatatgaagttgataaagagtctggtgccctgtttgtggatcgcttcatgtccactgcgatgttctatccgtgcaactatggttacatcaaccataccctgtcgctggatggtgatccggtcgacgtgctggtaccaacccagtacccactggagccaggctcagtcatccgttgccgcccagttggcgtgttgaaaatgaccgacgagtcaggtgaagatgccaaactggttgccgttccgcacaccaagctcaccaaagagtacgatcacattaaagatgtgaacgacctgccagaactgctgcgtgcgcagatcacccacttctttgagcactacaaagatctggaaaaaggcaaatgggttaaggttgacggctgggataacgctgaagcggcaaaagccgaaatcatctcttctttcgagcgtgcggctaagaagtaattctgtatcctggctgcgtgattcatctcagctgaacagataaaaacaccgtccaactggacggtgtttttattcaggctttcgactcctcatcacgcttcagccagtcaccactcataatacgctggcgtcctgagactgaacgttgatagacataaagccatgcgctaccgaacggcgtctgaatcagatgacgtttgtattctccacctttagtacgaagcgcatctaactcggcgaggatggaggcatcaatccggtatacttcgcaatatacctttccttcgccattaaccacgccgggatagtgaccaagactgtagagttcatagccctcaatctgatggtcacccaaccattgcgcgtgtgtcatccagtgactgtttccctgtttgcgccgtaaactgccatagacaattattcgcattgctaaaactcaaactgataaagcaaatcaagagcctgatccacaccggacacggcttccaaatagagtttaggcatcaggcggtaacgtaaggttaacgttgccagtgaatcaaagatgcccactccgtattttacttgtagacccggcagtacatagccactgacctgcacctgctgactgtcgccaacgccggtggtatcaagagcaaggttactgacgccgaatgtctcgccgattttacccacaacctgaccactttgtgcaacccctaaccccactaacgccgaagttagtgcattaccgtcaccgtcactcttcagtccctgaccccgtaacaggtaagaaagggcttcctgctgtgacattgccgggtccgagaacacttcaactttcggctcgtccgccagtccggtaacgcgcaggcctgccgtcacgctgtcctctgtcgcatccggattacgaatcgcctccagattgatgtaaggctgatccggtggcccggcgaattgcagttcacctttgcgtacgatcaaatcctggccataggcatggaaacggccggaaggaatgttgatctgtccgttcagtccaagacctgatttatcctgtaccattttcaggtcgccattcagtcgcgctttcaggccaaatgcggacaggcgcacgtcgttgccgacatggataatcaggttactgttaatcggtattgaagcggtttgaggctcaatcggtttaaggtttttatccagcatgacctcgtcagaggaaacgcccaccgcgctctctggcacctcttgtaccgtaatgcgtgcccagggaatatccacccggccgtcaaggttaaaggcggctggcgtggcttcaaagaccacatccggcgagacatccatccgcaccattggcggcaccgtaacccgtacccgacttcctttggcagcgacacgtgcacgccagttgtccagttggctccagtccgcatcacccgtgaggttgatattgccctgcgcggtctgcagcagaccattcagggttgagctcatgccgttaaacaccatattgaggctggcgcgggttaaatccaccggcatgaagttgcctttcacattcacatctttcaggccgagttgaccaaagacctggggctgctgtgccgttccgccgaggcgtaggttactgttcaggttgcctttaatgctttcgccctgcatcaacgccggattgattatcgccagggagatattgcggatattcacattaccgcccagcgtacggcgctgttgcggatcggtgatctgcacattgccatccagttgaccgttgttgacgatacgaatcagccagtcgagctgcgcccgtccatcgcgcagtgcggcattgatattgagcgtgttaaaggcgacaggcagcgtattgccctgcacatcctgcgcgactttaacgccgttgcccttcagcgccaggctgccggtcggcagtttgccgtccgccgtccagtttactcgggcatccccgctaaacacgccgctcagctgtgtctggttagtgaggaaaggttttaacatcgcaaggtcaaaacggtttaacaccacatgagcatggccatctggcccggcttctatgggttcaggcacacagagttgcgcattggggttttgccagcagtgcgggccaatggtggcggtctgtttctgattgacatagttgatcgccatggcgcgcgtcagtcgccattcccccaccggcgtatcaaaacgcgtattgttcagattgcccttccactgctcggtctgacggtcgaagctgcctgtcagcgcgagctggcctgacaccggcttgccctgcacgttgagtttgagctggtgctgcttttcatcgccatcggcattgagcgtcagcaggctgatattaagtgcatcctgcgtcaactgctcaacccgcaactgcagcttaccggcgatttgatcgctggagcgcacatcactcttcagggtgatgcggcggacaagcagttgctgccagcgtaaaccggtggcggtaagatcggccagcagttgtggcgctttcagcgtaccccgtgccttgatatcccctttaaccaccccgcccagccccggcagcgcattatcgagatgcggagcatcaacgctggcatccaggttgagtgtatcggccaggctgccttttacatccagatgattacgtcccagcgctatcttgatgccggggatatcccactggttgtagctgttgccccgcaaggtgccgtcagcgcttaccgcgttctgtttaacgttaccttttagcatcagctgcggtacgctcacctgccagctgccaccatacaggctgccacgggtggtgatcttaccgtccagcttagccggccagtcaggatactggcgcgcggtattgatgccgtccagcgtcaactcactgcgccagctgatggctttgctccagtccaccagcgcggtgaggtcgatgttgccctgcaacgccgccacacgcagcttatccagactgaactgttgcacgttgcctttgccatccagcgcgaccgtagcaggcggcaccgattcccctttgaccgaggtgcggagagacatgacatagtctgtcgccttgcctttgaactgatagttaaggttatcggcctgatactgaatcgccccggtcagcggccagcgcaactgcggactggtcaggtttaacgccagcggtagaccagccacggcgggttgagcgctggcatcaagctgtgcgcgtaccgggccggaaaggttcagcgccagtttcaactcgtcacgcatcgccccctttaaggtcaaactgagtttttcccctttgacagggttaacgttcacctcaccgttcagggcaaaatcaacgggccagttgtcagccagcgtagcctgaccaccgccgttcagcttgcccagatttgagtcaacctccagcgtttgcagctgcatatggcggtccagcgttttcgccttcacccgcagtcgactaaccgagatatcagtatcaccggtgatgcgtagctgctcgcccagaatttcctgtacgtcaatatccagcggtagctgaaagtcgggcagcgcgggcaacagcggttttgcaaacagcgcctgcaaggtttcgcccagcggcttctcatccggctgaggctgttgtactttgggttgcaccacctgctctttagccacctgcgccgctttaggcagcgcgatcagcaaactttggatatgggtgggattcagcgtcagggcacgatcctgccactgcaagccggtcgtaaaatccgccagcgaaatagcgctctcatcgactttcacgctgatgttgtgcaagcccacatgacgcaggctgatcggataaggcgtgctgagattgctggtgccgctctcttcttccggaggtgccgtcgatggcgtcatctttttgctgtcgaccaccacgctgatatctttcagcgtcagatcattaacacagaccgacgagtgcagcaggcagttgagatccacagcaagatggatagtgcccgcattaacgctgacgccaggcatctcatagcgcaatccactaagggtaagattacgccagccgccgtccactttgttgatcgacaagcccggcacccagcgcgacgcgccgtttaacaccagatgtaatcccggcgtcgtaccaattaaaaatgccaaacccgcaaacagcaagaccaaaaaaatcagaaagccaatcaggacctttttccagcgcttcatagttctggccccaaccctacgtaaaattgcacaccatgctcctcgctatccccaatggggcgggcaatatcaaacttaatgggccccaccggtgatgaccagcgcaccccaatacctgcgccggtttttacattgctttgcttaatgtcattgaccgcctcgcctgagtcgacaaacaccgcgccccaccatttgccgctgacgttgtactgatattccagcgagccggtaaccattttggatgcgccggtcagcttgccgtcactgtcacgtggagaaacgtttttatatttataaccgcgaatactgcggtcaccaccggcgaaaaagcgcagatccggcggcactttgtcaaagtcgttagtttcaatccagcccaccgtaccgcgggcgataaaacggttcttttcacccagcgtgcgaatccagacgttttgcgcctgcaggattaagaaatcgacatccgaaccccatgtggtatcggacacatctgcggaataacgctgcgaatcgccccaggttggcattaagccgccgcgtgaacgggtgcggttcagactgacgccgggatagagcagcatcgtggtattggtgacgttaccctgcgtaaagtgatccaggctccagcgcaggttaagggctctttgccagccgctgctgctgtcccagttgcgcgataccgccagcgtactggtatctgctttggtgtcgttaagatcggtgcgtttcaggccgccggaaaaggtgtagtactgctccagtgggcttttcagcaacgggactttgtaactgagatcgacctgttgctcgggggcggaaacataggcactggcggccatactgtggccccgatcgttaacccagggttttctccacgttcctttcagacgcggtccaacatccgtcgaataaccgacaccggcttcaatggtatttttagcgcggggtgacaccacggcatttaagggcagaactttggttttacggccctgcttaaactcgggcgcaaccaccactgactggaaccagccggtcgcggaaagacggcggttaagttcagccagatcgcgggaactgtagtaatccccctctttgaagggcactaaattttgcaaataggcttcgcggatctgcgagccttcaaaggtgacatcgccaaagcgataacgcggaccgctgttgtagtccagatcccaaaaggcttcatggcggtcaacagacacacctaactggcttttttcaaactcaccatcgaaatagccgttacgcagggcaaggttggtaaagccgcttttgaatttatcgtactggccgtggttaagcaccgtcccgactttgggccgtccctgtgcaatccagtttttataatccgcatcgtttttcgcctgaccggtgacgacaatcgtactgcccgcaatttttatcggctgaccgggcgtaacacgggcgattaacaccggacggccgccctgaggaggcgcggggcgcgattcgaagtcgatatccggctcataatagccaagcgcgcgcagtccctctttgatcgccgaagagacgcgagagcgaaagcggccgtcgttggtgacttcgtcgctgctaatggtcgacaggcgtgccctgacgtttttttgcagttctccggttagcccttccagctgtagtcgaaccggtgccgccccaaaggcgggcgcgacgagcagcaaacccgtcatgcaataaacataaaatcgtggcacttgtactcctgtctgtcatgcctgccccattccacagggcgcgtgttaatcctcgttaccgatacaatcgcgacggcaactcactcatcatagccgcactttttgccaactggcagtgtacaacgagatctaagccaaattgagcattattgtcggcaaaacccacttaggttacaacggcgttgtaacgtcctgggcgcttcgcggtttgcctgcttatcgacgcgggggaggacaagacaataaatactcacgcagagagccatcgtttgccctctggcggcggcatcgtcgctgctgctataatcacccaccgcaggcatcccgcctgtcttcatttctgcccctgcacctcactgatattgttgaatgggcgcagacatttttggcacggatagctccccttaagtcgccactacagggaatgagcgcataaatcgcacgctgcccaggccaaaaatgacaagtgaataactctttggatctcatatgcttgatagcctacttgtcattctgctactgattgtaatcagtgcttttttctctctgtcggaaatctcgttggccgccgcccgcaagattaagctgaaacttcttgctgaccagggcaacatcaacgcccagcgcgttttgaaaatgcaggaaacccctggcatgttcttcaccgtggtgcaaatcggtctgaatgccgtggctatcctcggtggtatcgtgggtgatgcagcgttttcgccggccttttccagcctgttcaaccgttttgtgtcacatgaccttgccgaacaactcagctttatctgctcgttcaccatcgtaaccagcctgtttattctgtttgccgacttaacgccgaaacgggtcggcatgatcgcgcccgaaaccattgctctgcggattatcaatcccatgcgcttctgtttgctggtgatgcgcccgctggtgtggttgtttaacggtctggccaacgtgttctttcgcgtctttaaactgccgatggtgcgcaaagacgatatcacctcagatgatatctatgcggttgtggaagcaggcgcgctggctggtgtactgcgcaaacaggaacatgagctgatcgaaaacgtattcgaactggaatcccgcaccgtaccttcatccatgacctcacgtgaaaacatcgtctggttcgatctgcatgaagatgaagtcagcctgaaaaccaaaatcgctcaacatcctcactccaaattcctggtctgtaatggcgatattgaccacattgtcggctacgttgactccaaagaattattgctgcgcgtgctgggtaatcagagcatggcgctgaacagcggcgttcaaatccgctcggcgcttatcgtaccggataccctgacgttgtctgaagcgctggaaagctttaaaacggcaggcgatgacttcgcggtcatcatgaacgagtatgcgctggtggtcggcatcatcacacttaacgatgtcatgacgacgctgatgggcgacctggtaggccagggcatggaagagcagattgtcgcgcgtgacgagaattcctggctggtggaaggcgggacgccaattgatgatgttatgcgcgtgctggatatcgatgattttccgcagtcgggtaactacgaaacgattggcggctttatgatgtatatgctgcgcaagatcccgaaacggacggactttgtgaagtttgctggctacaagtttgaagtggtggatatcgacagctaccgaattgaccagctgctggtaacgcggattgatgaacgaccgccaatgctgaatgtggcaaaaaccgaagaatagaaagactaagggcgccatcggcgccctgttttttagttgaactctagcttgagacgaacgacctggcggttaatttctgacatcacgctcaggtgctgtttgtctttgacccgtgggatcaggactttacctttatcaaactcgaatgcgccaacatccttgatgtataaccttcctttaaacagcgtcttaacatattttgctatctgtagtggattatagcgctggaagattttcatactgattaactccttcatttttaagcacgcttcaccgttgccaaattcggtacgggtccatgaagcgcgaattcgagataaactatagaacactctgtttacttcgcacgataagaaataagtttttttaccgttctgacagaacattacagaatactctgttatttacttttcactattcagtataaaccttcattcgttacggaattgtgtagttgataacaaagctgacagctttttgagacaggcgcatcatccctgcttactattacagttgaatgactaactggtctgatcactggagaggatgatgatgcgtgtaactctggcagcactggctttatcactgctgattcccgtcagcgcgctggctcacgatattgagctgggaaaacgtgtgccggcggtaggcgttaatgataaaggcgagctgattttacagcaggaaaaattcagttataaaaactggaacagcgcccagctaagtggaaaagtgcgggtggtacaacatattgccggacgctcatcagcgaaagagatgaacgctgcgttggttgaagcaattaaggcagccaggttgcctcacgatcgctatcagaccaccacgattgttaacaccgatgatgctattcccggcaccagcatgtttgtccgcagcagtattcacagtaataagcagcagtatccgtggtcgcagtttattgtcgacagccagggtaacgtgcagcacgcctggcaattgcagcagggcggctcggctattgtggtgttggataaaacaggccaggttaaatacgttaaagatggtgccctgtctcagcaggaggttgagcaggtgatgaccttattaaggtcgctgttgcaagagtagataaagatgaaggcgggaggctgatgcctcccgcactgcatcaaaacagtgaaacgcgaaagcccgggttaaggaaagactcacgcggcgcgtagtccagcgttcttccctgccagtcatgtacgtgcgcacccgcagcagcggctacggcatggcctgcaccggtatcccagatgttggttggcccaaaacgcggatagagttgggctttcccttcagccaccaggcaaaacttcaaggaagaaccggtcgcaaccgtctggtgttcacccagttgcttcaggtattcctgcatctcttcatcgtcattatgtgaacgactcaccaccactaacggcggacgcgcatcaagcacatgaatttgctgtcgctctccgttctcttctttccaggccttgccctctgcggcggaatacatcacgcccagtgcgggcgcgtaaaccacgcccatgaccggcttaccctgctcaatcaatgcgatgttcacggtaaactcaccgttacgtttgataaattctttggtgccatccagcgggtcgaccagccagtagcgctgccagtgctggcggacatcccagccaggcggatcttcttctgacaggaccgggatatccggcgtcagccgctttaagcccgatacaatcacatcatgagcggccaggtctgccgccgtgacaggagaatcatccgctttgtgggaaatctctgccggaacagaaccgttgtagacctgcataatcgcgtcgcctgcttcacgcgccagttggcttatttgctctaacatttttcacctcatgtatgcgaatgctacgcgttaactgtcatacccgttggagtacagtctagcagcttcatgcttaccgctgatttcaggcaaacattctgaatcatttttcagctatatcaacacaatagacagaaatagcaacgatcttattcggcttaagcgatgagatcgacggcccgagcgcgacggatggcaggctcaaaacgttacatccatcacgatttaatctgccctttcatcagacttttacattatttttgtagccttgatcttttagctttgggagagagcatgtttaaggcgggaatgatgttactggcgttgagcgtttcagttgcagtacagggagccaccgtggatttgcgcgtgctggaaacaaccgatctgcacagtaatatgatggacttcgactattacaaagatacgcccacagaaaaatacggtctggtgcgcacggcgtcgctgatccatgcagcacgtcaggaagtcaccaacagcgtattagtggacaatggcgaccttattcagggcagtcccttgggcgactatatggcagccaaaggacttaaacagggcgatgttcatccggtctataaagccatgaacacactggactatagcgtgggtacgctgggcaaccatgaattcaactacggcctgccctatctgcacaaggcactggcgggcgcgcgtttcccctatgtcaatgcaaacgtcatcgatcttaaaagcggcaagccgctttttaccccttatctgattaaacccactcgcgtgaccgatcgtgacgggaaaacgcatactttgcaggtaggctatatcggctttgttcccccgcagattatggtgtgggataaaactaacctgcagaacaacgttcgggtagatgacatcactgaaaccgcacgccgctacgtgccagaaatgcgagcgaaaggcgcggatgtggttatcgccctagcccactcgggcctgagcagcgaaccctatcaggcgatggccgaaaactctgtctactacctcagcgaggttgcgggcattgatgccattatgtttggtcatgcgcatgccgtattcccgggcaaggagtttgccgggatcaaaggtgcggatatcgagaaaggcacactaaacggtattcctgcggtgatgccaggcatgtggggcgatcatttgggtgtggtagatctggtgctaaacaacggtgatggtcgctggcaggtcactggcggtacagcacaggcgcgccccatctatgacaccgcccataaaaaatcgctggccgctgaagatcccgcactggttaaggttctgaaagacgatcatcatgctacccgcgcatttgtagctcagcccatcggcaaatcggctgatgtgatgtacagctatctgtcactggttcaggacgatccgaccgtacagattgtgaataatgcgcagcgtgcctatgttgaacattttattcagggcgatcccgacctggcgaagctgccggtgctgtcagcggcggccccctttaaagccggcgggcgcaagaacgatcctgccagctatgtggaggtcgagaaaggcaacctgacgttccgtaatgcggccgacctctatttgtatcccaacaccctggtggtaatgaaagtcagcggcgaacaggtgaaagagtggctggaatgctctgcgggccagtttaatcagatcgatcctgccagcagccggacgcagccgttgatcaactgggattttcgcacctataacttcgacgttatcgacggtgtcagctatcaaattgatgtgacacaaccggcccgttacgacgaagagtgcaaactgatccatcctgatgcttcacgcattaaagatctgcgctggcaggggaaacctgtcgatcctaaagcgaccttcctggtggcgaccaataactaccgggcctacagcggaaaatttgccggaacaggcgataagtacattgcttttgcctcgccggatgaaaatcgcgcaatactggcggcttatatcagtgcagaaaccaaaaagaatggcgaggtccgtccgcaggccgatcataactggcgactggccgcgatacatagcgcacagcctcttgatattcgctttgagaccgcgcctggcgataaagcaactcgctttattcagcagtatgcgcaatatccgatgaaggcaacagggaatgacgagacgggatttgctatctggaaggtaaatctacaacagtaaaataactaagggcggcacggtgccgcccttatcctttacaggatttccagcagttcaacttcaaaaatcagggtgctgaacggcggaatggaagcaccggcaccgcgctcaccgtaagcgaggtcgtgcgggatcaccagttcccacttagagccaacaggcatcagcgtcagcgcttcgatccagcctgcaatcacgccagtcaccgggaattcagcgggttcgccacgggcaacggagctgtcgaatacggtgccgtcaatcagtttgccggtatagtgcacacgtacgcggtcctgacgggaaggaatcgcgccttcgccctgggtaatcacgctgaactgtaaacctgactcggtgctgctgacgccttcacgctgggcatgctgctgcaggaaagcctggccttctgcggccatcgcttccacgcgctcacgacgcacgctttcagcacgctcatgaacttcacgcagcgcgcggtgaaccacatcaacaggcaccgcgggtgagttcccttccagcgcgtcgcgcaggcccgcgagcagtgcttctggctgcagcccctgcagaccagactccagcagctgctggccaacctgtaaaccaataccgtaacttgcttgtgcttcgacgctgtcgaaagaaggggtagtcatcttcgttcctttcactctcggatatagtaagacgggcagcatagcagcgcaggccgctggcgtaaaatccgcagcgtcgtagatgacttttgctggcgaaagagaaacaatacgcaggtcaaatttatcaatgctggcaggcacttcgcgtccacattgcccatactgtataagtgacacgtttccccttatcagtggcacaataagaaagagagaaaatatgggccagattgcccctcgtcgccgcaggatgctcgcacggcgtatgttaacccggttacaagctcgactgccgcaacgaaagcagccgcaaggtgccggagcggaggaacccgatatgacttcagacgtcccgtctcgcctgccaaactggctgtatcgcctctggcattttacagacgatattcgctggatggacccgctgccggcgttgcaccgccgtggaattgtgattgccgtattcatcctgttgctggccttcctctggccgtccagcacaccgcagtatccggtagagcgtcccgttaccccctcggctgaaaaagaggtaccgatgcaggcggacatttatgataacaaacccgctaaatccacctcccagccggaggcaaaagccgattcgcagggcgactggcgcagctaccaaatcgcctccggacagacgctggcgcagttgttccgcgacaataacctcccggttaatgacgtgtttgcgatggcgcgcgtggagggcaacggtcagccgctcagtacgctgaaagaaggtcaacaggtgaaagtacgtcgggatgcgaaaggtgtggtaacaggattaacgctggatggtacgaacggtccggtgctgtttacccgccagccagacggcagctttctgcgcgtggaataagcgacaaccggtggcggaacgccactggatgggcgctaacacggttgtttgatgttctttaccagcatgattcccgcgcagacccgcagcgcaagtagagacaggatgatttcagcctcggcaggaaagcgcgccgggcgcagcattccggctacaggaacagaggcagaggcagaggcagaggcagaggcagagatttggcacccggttggccaacaatgaaatagcgctgcattctgtgttgaacatgtcgatgcttgtgcggtgcggcaagcgggcaaaaggaaggttattcagggcttaaaacaaaaacgccgacacaagtgtcggcgttcaggtgcggcagattaataaaattaacctgctactacgttcacgatcagtttcgcgaatacttcgctgtgaacctggaagtccacttcgtgctcaccggtggtgcgcagaacgccgttcggtaaacgaacttcgctcttagccacgtcaacgccagctgcagttacagcgtcagcgatgtcgcgagtaccgatggaaccgaacagtttaccttcatcgcctgctttagacgtgatggtaacagtgcccagtgcgttgattttttctgcgcgcgcatttgatgctgccagaacgtcagccagtttggcttccagttctgcacggcgtgcttcgaagaattcaacgtttttcttggtagcaggaacagctttaccctgtggaaccaggaagttacgagcgtagcccgctttaacgttaacctgatcacccaggctgcccaggtttgctactttatcaagcagaataacttgcattaccttatcctcttaaagtcgttaatggacagttgccgattactgatgacgatcagtgtacggcagcagagacaggtaacgcgcgcgcttgatagcacgagccagctgacgctggtattttgcgcgagtaccagtgatacggcttggtacaatcttgccgctttcagtgatgtagtttttcagcgttgcgatatctttataatcgatctcttgaacgccttccgcggtgaaacggcagaacttgcgacgacggaaataacgtgccatttggctagtctccagaatctatcaattcaatctgctcggcatgtaacaccattttactctgaccatttcgcgcctgatggcagctgataaagccttcgagaatgagttgcgtgccgaccgttatatgttgagtaatcacctgatgggcgctgccgctaataataacaggcattcgacaccaggcttgccggtgaaatccggcctcctcctgcaccgagttgtgctcaagcacgaactgacagtgcggaattcctgacgggctaattttccgaactggcgtcttacacacagtgccagacaagcacagccgattaaccgtcacgatggattactcttcagaatccccagcatctgagtcatcagcggattcgttagcaaaatcttcgcggcgctcacgacgctcgtctttcgctttaaccatcggtgatgcttcagttaccgcgtttttaacgcgcataaccatgctacggataacggcgtcgttgaagcggaagttcgtttccagctcatcgatcgcttcctgcggcgcttctacgttcagcagaacgtagtgtgctttgtgcagtttgttgatcgggtaagccagctgacgacggccccagtcttccagacggtggatcgtgccctctgcaccagtgatagcaccagtgtaacgctcgatcatgcccggaacctgttcgctctggtcaggatgaaccataaatacgatttcgtaatgacgcatcgaaattgctccttacggattattcagcctcctgtcagggtcagctgcggcccacggaagcaaggaacgttataggttgtgaatcatcgaaatgacacacacctctgaatgcagctgaaaaattgacgcgtaatcatactggcgacgccggacaaactcaagcagggatttcatgtaaatggtcggaaaccgccctgtttcccgcccttttgtgcggaaagcgggaacagggcgataaaccgtggcagacgcaggaggtgatggcgttgagggctacagctgacgcttaaaaaagctgaccagcgcggtcaggcccgacggcgtgattttgtggccgatatgcttttcagacaaggtgatcagatgagcatcaagcccctgttcgcgcagagcgcgatccagccgctgggcttccgcgaaaggcaccacttcgtcagcctcgccgtgccataacaggagcggccggttcgcaagattcggcagacggcttgaaggatcatactccgccagcggagccatgcgtttcgtgaacagggctttctgctcttcgctcgtcaccgtaacgggagggaaaagcgtctggctgagctgcataaaatagccggaacccatcatacaggcgacgctgtgaatatgcggatagcgcgccataatccccagcgccgtcatgccgcccatggacgcgcccgccacggcaagacgttcaccggcaatcagatcgtcggcacgcaacgccgtttctatcaacgggaattcatcgatgttctgtttaagaatgtcccaaaaatgcgtaaaccgcgtgtcggcatcgccattgtagcgcgcgccgtgcatatcggcgtcgggcatcagcgcacgaaatcccgcctgtgccagtgccacagcaaagtaggcgtacacctctttcgacgaggtaaagccatgataaaacactaccgttggcagtcgctgctggcgctggcccgcaggtgccgcatgcagacattcaatacctgcaaacctttccgtggtgagttctatcattttttctcctgaaacaggggctgattaggacgcctcgccagcaaacataagctgggtgagggttttcaacattacaatagtaataatttcttaactaaacatttccgctgcgctgccgttgttaatgcatatttgacaagaaaacaaaggtattctatgaaacgtttctctcttagccgcactagcctcggagtgaagctgtgcgtcataacgtccttcagtgtaggcgttttgttgttggctttgacacttattcaaagccagaatgcttcacgccagctggaaagtcttgccgtagatgacatggtcaatcaggtgcagggcatcactgaaatgacgtccatgtttaatgcgacgctgacccaggaagtgggcaactacactcagctcttcgtcagctttttacctaagcgcttcagccgtgatgaaagctcacgtattcaggttggtgagttttccaccccgacgctgcgcgccggacttaaaacccttaaccttgatcagactgccgttgatgattttacagatcgcaccgcggcagtcgccaccatctttgtccgtgatggtgataatttcatccggatttcaacctcactgaaaaagcaggatggtagccgggcgatcggtacccaactggaccgcgccagtgccgcctggaaaagcgtgacgaagggggaaacctaccgcggactggccaccttatttgaccaccgctacatcacccagtaccaaccgataaaagacgacagcggcaccgtcatcgcgattttatttgtcggcgtacagatcgacaaacagtatggcctgattcgcgaaaaagtgctggctcgccgtcttggcgatagcggacatttttatgtgctaaacggctcgccgggcgcagcgcaaggtcagtatctgtttgataaacagaacgaaggcaaacgtccagactggcaggatagcgtcatgaagcagctgctgacccagcccgagggcgtgcagcaagccgagatcgacggtgaagccaggatgctggcctggcaacagttgcccggctggaactggattgtggtcggtgaagttaaccgtgacagcctgctggcaccggttattcacagccgaaatatgtttcttatcacaggactgattctggtgttgctgtttgccccctgctttgtctggtacagccgccgcgccatcacgcgcccattgcaacaggttattcacttagccgagcagtatgccgccggtaatttgctggagcacctggacaccaggcgccatgacgaagttggccagttgattaacgcgatcaacggtattggcgaaggtctggagaaaattgtcgctcaggttcgcagcgccgcgcaggagatcagcgacggcacggatacgattgcggccagcagccacaacattagtgcgcagattggacgccaggccagcagtgtcgaagagacatcggccagcatggagcagtttggtgcaaccgttgagcacaccgccgatagcctgtgtcaggcgatgtctctggtcgccgaagccagcggtatcgtgaataacggcaaccagacggtgacgcgctcggtcagtaccatgtcggcgattaacgtatcgtcgcagagcattgctgacattactcatgtcattgagtccattgcgttccagaccaatattctggccctgaatgccgccgttgaagccgcgcgtgcaggtgaacacggtcgcggatttgccgtggtggccgccgaggtgcgcgcgctggcacagcgttcggctcaggcagcaaaagaaatcgatacgctgattgcgacctcaatacgtcacgtcgcggaaggtcatacgttatccgagcaaacccgggatgcgatgagtaatatcgtgacgcatattgagcaggtacaggcattgatgggtgaaattaacgtggccgcgcaacaacagtcggcgggcattggtcaggttaacctggcgatgaaccagattagccaggcgacgcatcaaaatagcgagttggtggcacaggcagaacagacggcgcagagcctgagtgacaaaggtcatcatttgacacagttagtcagcgtgttctcaatcaagtcgtgatgattgcgagccagtggcttacacttgtcctgttaacatgactgccaggaatctgctatgcgttacgctctgttactgacgttaagtctgtttttaagtggctgctcgctgttccaggatacgccaaaagccccgcccgcgccgactggcgaggcgcagtccattacccgtgcccaaagttacggtttaccgaagctgggtaccattagcgccagcgtacgcggctcgcccgatgacgcggagcgcgccattgccgcgcgcgccaaccaggccggtgccgtttactatcagattctgatggttgatgagacgatcacgccaggcatctggtacacgaccgctatcctgtatggcgcctcacctgccgctggcgcgcgccagtaaccggtcagtcagtgggccctcgagtaagcgcataccgcgcctgtcgagccactgactgcaccacgcatccgccagcaagggctcggcatgcttcaacagctgcgttgccgttgccagatgcagcagattttcgctgagttcgcgggcctgaacctcatcaattttcctcaggcccagggctaactgtcgccaactgctatcgaaatggcgattacatcctttcactgcgtcaaattcctgtttgagcatgtccagcatgccgccctgtttggtcaaaacccgcaggacgtccaggcacatcacgttgcccgatccttcccagatgctgtttaccgggatatcacgatagaggcgaggcagttcactctcttcgcagtagcctgcaccgcccagcatctccatcgactcggcaataaagggcgatcccgctttgcaaatcacgtattttgccgccggggtaaataaccgggcaaacgccgcctcatgtgcatcgcccggcgaggaccacgcgcgtgccagccgcatcagcagtgccgtttgcccttctaactgcaaagcctgacgtgccagcacttgccgcatcagcggctgatccaccagatttttccccataacctgacgctgatgcgtgtgataaagcgcgacggaaaaggcacggcgcatttggccgtggctgcccagcgcgcagtcaaaacgcgtcatgcccgccatcttgaggatcaggcgcacgccgtctccctcgtcgcccagcagccagccggtcgcctctttgaactcaacctcgctgctggcgttggatcggttaccgagcttgtcttttagccgctcaatgaaaatggcgttacgagatccatccggcagtaagcggggtaaaaagaaggcgcttagcccctgctgggtttgcgcaagaatcacatgcgcatcactttgtggcacagagaaaaaccatttgtggccgacgattcgatacgcttcgccacttccgcgcccattaagaggctccgcacgcgtcgtattggtcagcacatcgctgccgccctgcttttcggtcatgcccatgccaatcagcagtccacgcttttgatcgcccggaaccgcatgcgtatcataatgatcgctgagtaaaggatcgatccaggattcaaaatgggcaggcagatagcgctgtagcaagggaatcgccgcgtgggtcatggttagcgggcagagcgtcccggcctcgacctgggcatgtagaataaaccgggccgcacgggccacactggcattgggtagtacgtcgggctgccagctaaggttatgcaggcggctggcgcaaaggccctgcatcagtaaatgccaggccggatgaaagcggacgtcatccagcctgacaccgcgagcgtcgtaacgatggagttccggcggacaggcattggcgagcctgcccagctccagggattcggcgctgcccagttgcctgcccaccgacgccagccattcactgtcccatccgccgccttcacgtaacagtgcgtcacagaggggaacatcggacagaaacaggttgctgttactgaggggaaaaggttgattgaaaacggtgtgcgttgtccaggtcataacggctcctcgcggatgtcacccacttagtatgtaaggtgcgttaccattatgacctgacagagaaacgaatttgcggcagcgatcacgcgttgcgctgacgtaccgcttcaaacagacacacgccagtggcgactgagacattgagggatgaaacgcttccggccatcggaatgctgatcaactcatcacaatgctcacgtgtcaggcggcgcataccttcaccttctgcgcccatcaccagcgccatcgggccggtcatcttgctttggtaaacggtatgatcggcttcgccggcggtgccaacaacccagatgttatattcctgcaacaggcgtaaggtgcgcgccaggttcgtcaccctgatcaggggaacgttttcggcagcaccactggcgacttttttcgcggtcgcgttcagcggtgcggagcgatctttgggaacaatcacggcatgggcaccggctgcatcggcgctacgtaagcaggcaccgaggttgtgcggatcggtaacgccgtccagcaccagcaggaatggcttctccaggctctgtaacaggtcgggcagatccccttcctgatactggcggccgggcttcacccgcgccacaatcccctgatgcacgccgccttctacctggctgtccagccatttacggtcggccagctgaatcacgatcccttgagcttctaacgcggtcaccagcggttgcaggcgacgatcgtcgcggcctttgagaataaagacgtcctggaaacgctgaggatcgcgttccagcagtgcctgcacggcatggataccaaaaataatttcgctcatcaatctgctcagtggttggaaatgaatggataacagcccctgcgcgcttgcaggggctgatgtgcgcatcaggcaggcttcgccttcttcgcggcacgcttggccttagtggcggcggcgattttacgggttttctctgaaacttttttactttttttctcagtccgggcctcggcaggcttactgctgctgttgcggaaggctgaatccggctcgaaattggttttacggctggcctggcgacgatgttttgtcggcgctttgccatcacgcttcgccttatcccgttcggttttgccttcaccacgaacctggcgcttactggacaccagcgcaaagtcgattttacgctcgtccatatggaccgcttcgacccgcacttcaacggtatcaccgagacgataggtacgaccgccggattcaccaatcagtcgctgtcctacgggatcgaaacgatagtaatcgttgtccagcgtcgagacgtgaaccagcccgtcgataaacagatcgctaaggcgcacaaagaagccgaacccggttacgctggagatcacgccattgaagacgttgcccacctgatcctgcataaagtcgcacttcagccagtccgcaacgtcgcgggtcgcttcatcggcacggcgctcggtcagggaacagtgctggcccagctgcagcatttgctgcatgtcgtagtggtaaccgccggtttccgtggtcagccctttcacttcgccctgctcttttgccagcagatacttgatggcgcggtgcagcaataaatccggatagcggcggattggcgaggtgaagtgggcataagaggacagcgccagaccaaagtggccgcggttttctggatcgtacaccgcctgtttcatggagcgcagcagcatagtttgcagcatttccgcatccggacgatcggcaacctgcttcagcagcgcggcataatcgatcggttgtggtttattaccgcccggtaagctcaggcccagctcattcaacacggtgcggaagctcttgatgctgtcatcgcttggacgatcgtgatcgcggaacagcgccggctcctggtgcttctcaacgaaacgcgcggaggcgatgttcgccagaatcatgcactcttcaatcagcttgtgagcatcattacgcgaggtacgctcgacgcgttcgatgcgacgttccgcgttaaaaataaatttcgcttcttcggtttcaaatgagattccgccgcgctcttcacgcgcggtttccaacacctgatacatgttgtgcagttcctgcagatctttcaccagcggcgcgtattgctcgcgcagttccgggttgccctgcaggatattccagactttgttataggtcagacgtgcgtgggaattcatcaccgcttcgtaatgtttaaagccggtaagcttaccttttgacgacacggtcatttcgcacaccatacacaggcgatcgacctgtggattcagtgaacacaaaccgttcgacagcacttctggcagcatcggaacgacctgcgaagggaaatacaccgaggtaccgcgctgctgcgcttcgttatccagcggtgtaccggggcgcacgtagtaactcacatccgcaatggcaacccacagccgccagccgccaccgcgttttttctcgcagtagaccgcatcatcaaagtcacgcgcatcttcgccatcaatggtcactaacggcaggtcgcgcaggtcaacgcggccttttttcgccgactctggtacttcttcattcagtttgccaacctgcgcctcaacttctggcggccagttgtgtggaatctcatgggtgcgcagtgccatatcgaccgcgaggctggtgcccatgtcatcgcccagaatctcggcgattttgccaatcgccttcgaacgacgcgtgggacgctgcaacagctcgaccaccaccacggagcccatacgggcattcatggtttcttcagggccaatcaggatgtcgaagctgagacgactgtcgtctggcaccacaaaaccgacacctgcgtccgtaaaatagcggccgacgatctgattgttacgcggttcctgcacccgcaccacgcgtgcttcacggcgacctttgcgatcggcacccagtggctgagcgagaattacatcgccatgcatacagaatttcatctgttcagccgacaggtagaggtcatccttttgtccttccgcacggagaaagccatagccatcacggtgaccaatgacttttccacggagcagatcgagacgctctggcagggcataacactggcggcgggtaaaaactaactgaccgtcacgttccatcgcacgtaggcgacggcgcaaggcttcgaggtgctcttcttcctgcaggttcatctcttgtgccagctcttcacggctggcgggtttttctcgtttttctaacagagccagaataaattcacggctcggaatagggttttcgtacttttcagcttctctgtccagaaaaggatcttttgacattagggttcctccgatgtcatttaatattcattgccaccggcggttcggacaatataatttcatataaaggtgtattaccttccactaaatctgccagcgtatagccatccagctcctgtaaaaacagctgcacggcatcatgtaaggcctttttgaggcggcaggcaggcgcgatggaacaggtcgtgcaatcgactaactgtagtggctccattttgcgtaccacttcaccaatcacgatgtcgctggcgcgcattcccagccgaataccaccgtttttgccccggatggccgagacaaatcctgcgcgactaagctgattgataattttgaccatatgattacgcgatacgccatacgtatcggtgacttcagaaatattggtcagcctgccttcaggcaaggtggccatatagatcagcgcccgcaggccgtaatcggtaaaacttgttagctgcacagtgacctcagtcaatcatccggtggcacgtctatgctcgcccgtcctgctttttatttcaatattgaactggctcttacgtatcgagctacgatgataaaccagactgatgacggctgtgtatttttttcagccagtgaaaggtttgacaagcgaaggggcatttagtggcattaaataacataaaaaacaaaggccggacaatgtccggccacaggatgattaggcgttgaaaggatcgcgcagaatcatcgtttcgctgcgatcgggacctgttgaaataatatcaatcggtacacccgtcacgtcttctacacgtttaatgtagttacgcgcggcctgaggcaggccttccagcgttttgacaccaaaagtggtttcgctccagcccggcatggtttcatagatcggctcaatgccttcccagttttccgctgccagcggcgtggtggtcacttcgctgccgtcaggcatgcggtaagccacacaaattttcacttctttcagaccgtccagtacgtccagcttggtcatacagaagccggagagcgagttgatctgcacggcacggcgtaccgcgaccgcatccagccagcctgtgcgacgacggcggccagttgtggcaccaaattcgttaccctgcttgcaaaggaactcaccggtttcatcgaataactcggtcgggaacggacctgcccccacacgcgttgaatacgctttaacgatacccagcacgtaatccacatagcgtggaccaatacctgagccggtcgcaacgccacctgcagttgtattagaggacgtgacatagggataagtaccgtggtcaatatccagcagtgtcccttgcgcgccttcgaacataatcagatcgccacgcttgcgcgccacgtccaacagttcagaaacgtcaacgaccataccggtgagaatgtcggcaaccgccatcacatcactcagcactttgtcgtagtcaacggcttcttctttgtagtaatgcaccagctggaagttatagagatccatgacttctttcagcttggcggcgaaggtttctttattaaacaggtcgctgacgcgcagtgcacgacgggcaactttgtcttcataagccggtccaataccgcggcctgttgtaccaatggctttcgcaccgcgcgctttttcacgcgccatatccatggccacatggtattgcaggattaacggacaggcttcagaaatcagcagacgttcgcgtaccggaatcccacgcgcttccaggcctttcatctctttcatcagagcttcaggtgaaagcaccacaccgttaccaataatgctggtcacgttgtcgcgcagaatgccagaagggattaagtggagtacggttttttcaccgttgatgacaagcgtatggcccgcattgtggccgccttgataacgcacaacgtaattagcgcgctcagtcagaaggtctacaatcttacctttaccttcgtcaccccattgggtgcccagtacgacgacgttcttacccatttctcaaaatcaccgattgcttaaaaaaggattctaccatctgattttgcggttttcagcacttttagcatacgattgcgcccttttttgcctgggttttgatcactacaacatccaggggtaaaaacaaggctgagataccattcagacggcgatactgacccattacagctcgccatgcagtcgcaacatacaatagatcaccatacctgccactactaagccaccgccaaaccgatgtaacaggcgatcgggtaactgcgtcatgctcaaaatcacccgtcgccacagccgtggcataaacatcggccccaagccctcaagcaccagcactaacgccagtgccatccagatattcacgttcatactgcatccaaaaaaaaggccgacaacattgtcggcctgttagttatatcagttcttaacgcgtggcgttagaaggtgccttcatgtagcggaagaagtcgctatccgggctcagtaccatcacgtcctgattgtcattgaagctgttttcatacgcgcgcaggctgcggataaacgcatagaaatccgggtcctgactgaatgcgttggcaaacagcttcgcggcttctgcatcaccatcaccgcgggtaatcaatgcctcacgctgtgcttctgcaagcgtacgggtaacctggtaatcggcctgagcacgtagtttttcggcctcttcctgaccctgcgaacgctggcttcgtgcaacggcttcacgttctgcacgcatacggttaaagatcgcatctgacacttctgttggcagattgatctgtttaatccgtacatcaaccacctgaatgcctagcgccgccatactgtttggatttggcgcaggctcactgctgttggtttcacgctcgacacgcgcggccgcactggcgatagcattatccgctgcaggcgtggccacttcatcgtcgccccccgccgtgccggtattcaacgcatcacggacatcggtggttaaacgcccacgggaatcggtcacgatgtctttgacatcaagacgtcccatctctgaacgtaaacggtcactgaatttgcgtttcagcagcacttcggcctgagaaacatcaccaccgccggtcgccaggtagtaacgactgaaatcgctgatgcgccacttaatgtaagagtccacgatcaggtctttcttctctttggtcacaaagcgatcggcctggttgtccatggtctggatacgcgcatcaagcgttttcaccgtttcgataaacggaatcttgaaatgcagacccggcgcaaacacctgcggtttgttttcgccgtcgcgcaacactttaccaaagcgcagaacaatgcctcgctcaccttcctgtaccacgaacagcgacgcataaagtgccaccaacgcgataatgattagtacaattactggcttacgcattgattactctctcccttcgcgctgggtatcgttgcgctgagcattagcccgacgctgatccatgatgctgtctggactgtatgacgaggtgtcactgcggctggcactgcgatcgccaagtgatggcaatgttgagctgcttttctgtccacttttcgcggatgaagactgaccgccacgcatcagttgatcaagaggcaggaccatgaggttattaccacgatcgcttaccagcactttccgtgtatggctcagtacgcgctccatggtctcaatgtacaggcgctctttagtgatttctggcgcagctttgtattcaggtaaaatcttggcaaaacgcgccacttcaccctgagcttccagaaccgtacgctctttataagcgcgcgcttcttccagaacacgttgtgcccgaccgttcgcacgcggttgaacttcgttggcataggcttcggcttcacgtacgtattgctcacggttttcacgtgcggcaatcgcatcgtcaaaggcagacttcacttcttccggtggacgagccgcctggaagttgacgtcaagcaccgtgatgcccatatcgtacggacgaatggtttcgtcgatttcacgttgcgtttcgctacgcacgaccgtacgaccttcagtcaaaatacgatccatggtagaacggccaatcacgccgcgcagggcgctgtcggtggcctggcgcaggctgtcatcagcactggtcacagcaaacagatagcgttcaggatcggttacgcgatactgcacgttcatttcaacgcgcacgacattttcatccgaggtcagcatcacgccagacgcggccagttcgcgaacggcctcgacgttgacggcacgaacctgatcgataaaggtcggtttccagttcaggccgggctcgaccaggtggctgaacttaccaaagcgagtaacgacgccgcgctccgcttctttaatggtgtaaaatccgctcgcggcccagataacgatggccgccacggcgacgatgccaaaaattttgccgctaccgccggaactgagctgaccgttatcaccttttttgccaccaccgaatccgccgagctttttgctcagtttacggaagatatcatccagatcaggaggcccagattccttacctcccttattccccccagagttgccgccttgattattgctgcttccccacgggtcgcggtcctgtccgttatttccgggctgattccacgccatgtcattactccatttatagttttagcggcttacccgtcgtatttgatattgtcacagcgcgggttgtgcgccttgcctgaccgtaagcaaaatcgcagtcagagatgaatcaacccacaccgcacgacaacataaaatcctcagagtaagttcgatttggcaatatcaaacaatataactggtcagcgacggctcctgcttgcataagcggcgccagtcaataatcggcattcgcacatgcaaacctacactgccgtcttcttcgttccactctttttcaatcgcctgcaactgatagaagcggctgcgtaagcgacccgcatccggtggcagacgtaaatcatactgcgcaatctcacctgacagtcgctcggaaagcgcctgccataataagggaataccgacactggactgcgcggacagccacacgcgaaccggcatattgtcttcatcacggtcaatgcgtggctcgaaaccgtccagcacatcgatcttattcatgatcaatagcgtggggatttcatcagcttcgatttcttccagcacctcattaaccgcatcgatgttttcgttaacccgcacatcggcagcatcaatgacgtgcatcagcagtgtggcctgacgcgtctcttgcagagtggctttaaaggcggcaaccaggtcgtgcggaagatggcgaataaaaccgacggtatcggccaacaccacttcgcccacatcggcaacgttcagccgacgtagcgttgggtccagcgtcgcaaagagttgatccgcggcatagacattggcagacgtgatggcattgaagagggtagatttaccggcgttggtgtagcccaccagtgaaacggtcggcacatcggctttggcacgcgcctgtcgtccctgctcgcgctgtttctcaacacgttcaagacgcgacaaaatttggctaatgcgcccacgcagcaaacggcggtcagtttctaactgggtttcacccgggccacgcaggccgataccgcccttctggcgttcaaggtgagtccagccacgtaccagacgtgttgcaaggtgacgcaactgcgccagctcaacctgcaatttaccttcatgggtacgcgcgcgctgggcaaaaatatcaagaataaggccagtgcggtcgataacacggcactcgcacaggcgctcaagattacgttcctgagcgggcgttaaggcatgatcgaaaaggacgaccgatgctccacttgtttttaccgcatcggcaatttcaacggcctttccttcaccgacaaaatacttgggatgtggcgctttacgactgccggtaataacctgcagtgcttcaacgccagcagaagacaccagggtttcgaattcctgtaaatcttccagctctttgtcttgggagaaccagatgtgtaccagtacggcctgctcaccggcatcataacggtcaaacaagctataacctcgcttatataaaaagaccaggacggaaagcatgacgctttccgatcctggtgaaacggtgccgctttactctgcgttatcaccgtcttgttgtggctgcgactgagcagaagtgctgctgccgccatgatggtaattattgctgctgccaccgccaggattattgctatggtgagaaaccgggcgtgaaggcacaacggtagaaatggcatgtttataaaccatctgacttaccgtgtttttcaacaaaattacgaactgatcaaaggattcaatctgaccttgcagcttaataccgttgaccaaataaatcgaaaccggaacacgttcacgacgcagtgcgttcagaaacgggtcttgtaatgattgccccttagccattctatcttttccttatatgcttgttgtttgttgcttgtagaacacagtggttctgaaaaaaactgcgtaaaaatttgcgcacgtaacttgccaattgtacacaatcacccatgcttcgcactaacaaccttcagtactgtatcacgcgctaagtgaggttcatcactgtctagccagtgaatattctcccaaccacgtaaccaggtcatctggcgtttagcgagttgccgggttgcgcaaactccccgataaaccatttcgtcgtaatcgatctcgccagctaaataagaccacatctggcgatagccaacacaacgaatggaaggcatatccgtatgcaaatcacctcgtgcaaacagggcccgagactccgcttcaaatcctgacgccaacatctgctcaaaacgcaatgcgatgcgctgatgcaacagctcgcgactcgcgggggcgatagcaaactgatggacatcgtagggtaacgcttcaccagaaatttttgtcagttccgttaaagttttacccgaaataaaaaaaacttccagtgctcgcgaaagtctctgcggatcattcggatgaatacgactgcctgcgaccggatcaatttcgcaaagttgacgatgtaaagcttcccagcctctttcattcgccatttgctctattttttgacgaacctccggatcggccgagggcagcggcgacaatccttcaagtaacgccttgaagtagagcatagttccaccaacaagcaacggaattcgtccatgctgaacgatatccgccatttctgctaacgcatcacgtcgaaactctgccgccgaataggcttcagccggatcgcgaatgtccagcaaacgatgaggcgcctgtgccagctcttcagcagaaggttttgccgtaccgacatccatctgacgataaatcaaagccgaatcaacgctgataagctctacaggcaactgtttgcgcagttcaatcgcaagtgcggttttacctgacgctgtaggccccatcaaaaatattgccttaggccggccagcctggttcagttcactcatgcttcaacgcgtttaccgcgctctcaatctcgatggcttgtactaagccagaaggtggcgatttaagtaactgcggacaaagcctttcaagctcagccaacagggtaatcgcctgggagtgattccagttttgaggctctgcatcttcacgtcgcgccagccactgggccagttgcgtagcagagttctcttgctgccgggcgagatagcctaacagttcaggaatcaagatttgtaaattttgtgttcgtaacggtaaaggcaccgcccgcaaaataatgtggtcaccctcagggtgtaaatcaatgcccatctgattaagcaggctcagattttcctgggctgctttgcgttcggcaggggcgatttttaagcgcaccggaatcaacagcggctgtgatttcagcccactttcgcggggttctagctgtgcctgctttaaccagcgggtcgccacaggcagcgccatcagcagtaaactctggtcctgttcaagcagggcatattgcccgtcaagcacggttaacacacggccaaagctatgggaatgggccgccaaaggcggtgcggcactgactggcgcacgtgccgcaggctctgcactttttgctgcaggtgcactggcaggcgttttcagcagttgctggtaaacccggccttcgcgctgactgtatcccggctctttgctttgccaggcgggagctgccgatgccgatggcccggcagccttcgccgtgacagccggctggctaaaatggttgccgcccgccgcctgacggttttcttgctgccagcgcggagccggttcttccgcctgcaacgtcggcaggacgggcgaggcactttcctgcaacacactcatcacgccctgatagatgaagtcgtgcaccagacgcgactgatgaaagcgcacttcgtgttttgccggatgcacattcacatccacctgatgaggatctatctctaaatacaacacgtaggcaggttgttggtcatcctgcagctggctctgaaacgcctggcgaatggcatgattaatcagcttgtcacgcatcatgcgaccattcacataacagtactgtatatcgctcacctgacgcgacccggccggatcggcaacccagccgcgtaacgccagatcatcatgctgccactcaatgcgaagcgcatgctgcataaatgtcgtgccgcaaatcgcccccagccgacgctcacgttgcccttcatcgttgacagcccggtactgacgcatcagtttgccgttatggctcaatgagatagcaacatcaaagcgcgccagcgcgatgcgtcggatcacttcatcaatatgaccaaattcggttttttcggtgcgcataaatttgcgacgagccggcgtgttgtaaaacaggtcgagcacttccagcgtagagccacaaggatgggcggcgggtttaacggtaaccgccatatcacgcccttcggcgtaggcctgccaggcttcggtttgttcggccgtgcgcgatgtcagggtcaggcgagaaaccgaactgatactggctaaggcttcaccgcgaaagcccagactcatgatggcttcaagatcgtccagcgaagcaattttactggtggcatggcgagccagcgccatggccagttcgttctttgcaatcccacagccgttatcgcggatacgaatcagttttgcgccgcccttctcaatatccacatcaatgcgcgttgcacctgcatcaaggctgttttccaccagctctttgacaaccgatgcgggacgctcaaccacttctccggcggcaatctggttagcaagttgcggcggcaaaatttgtattggcatgctggatatccttgtggctggcaacccggcgcagaggccgggctaacaatcaggatgcagggattttcagattctgacccaacatcacgttggtggatttcaggttattcgcctggagaatcgattttgggctgacgccataatgggcggcgatactgctcagcgagtcaccgcgcaccactttgtgccgcaccggacggcgcgccactggcgaagcgggcgcagtgcgacttgccacggcactggcaggcactttcaaccgctgaccgacccagaccacatcccgcttcagggtattcatttgccgcaaggtggccatgctgacgccatatttcgctgcaatccctgagagcgtttcgccgcgcgtcacggtatgacgctgaatagcccccgtatactgcgtctcgccggtcgccggattactggctacgctgaccgctggcggcgtatccagcggccggttttcctcctttgggaccgattgtagcgggtgcgccaggaaataagcgcgcagtcctttatatatcgactgagcaatcttatcctggtgtgcgctactgccgagcagtcgctcctccgaggcattactgataaaaccggtttccaccagaagcgaaggaatatccggcgaacgtagcacgccaaggctggcatgctcaggtaaacgcttgtgtaaggacgtcacgccacgcagttgctgtatgacctttgtggcgatgtcgtagccgacgcgctgcgagtgaccaaactgcaaatccagtacggcctggctgaggtaaggatcggcctggctgttcgccagcaaatcaccggctccacctaagagctcagactgtttctctttctgttccagccagttggccatttcactgttcgcacgacggttggataatacccagaccgaggctcccgttgctgcatgactcggtgccgcatcggcgtgaatcgacaccagtacgttagcatttgctttacgcgcaacatccgagcggcccatcacggagataaagtagtcgccatcacgggttaaaacgcctttaaacatcgggtcgtcgtttaacagcactttcagtttgcgcgcgatggcgatggtgacgtttttctctttaagcccatgctgacctatcgccccagggtcctgaccgccgtgaccggcatcaatcgccacgatcaccgtatcatcccggttggccacaccacccggacgggcggtgctgttagtgttggttaccgtggtcaccggattagcgttaaatggattgctggcggcggtttcccgcgcacgcgatggctgtgcttccgtcgtgactacaggcgcactgcgtgtgacggcaggacgtttgccctgaatggtgaaaaccacgctgtagttattaccattacgttgcgtgacggcacgggtttttcccgactgagtcagctcaaagaccaaccgtatgctttgtttatctttcggggtactggtacgaatgcgcttaacgatgttatcgccactaaacgtcagcggtaagcctttaatgacaccgctttgacgaatatccagcaccacgcgatcgggattgtgcaacggaaaataggcgtaaatcggctgaccggaaaaactcagcgtcaccgtggcctgatttccaccgtttgatacctgaatatcagacagattcgccgcaaacagaggcctggcgataagtagcaatcctgccagtacaagcattttcatccatgacatcatgcctgcgccctgccttgttcaatctgttcaacccagcgctgccccggcgcggaatgcgctaccagctcggcttcacgtgcctcattgacgtaacgcagcgtcagcgcgacatccggcggtggcaaaatgcctgcgccctgctgaggccattcgaccagacaaatagcgtcattcgtgaagtagtcacgaatgcccatgaattccagctcttctggatcggcaaggcgatagagatcgaaatgatagacggaacgcccctccagagcataaggctcaaccagggtataggtcgggcttttcacattgcccgcgtgaccggatgcctgcaagaaaccgcggctgaatgtggtcttccccgcgccgaggtcgccataaagatagatcaccgccgcattgccgcaggcatgcgccagttgagcacccagttcgagtgttgccgcctcattgggcaaaggtataacacagctcttcatgcttcttgattcatctctggattaacaaactgccacagcagatcaaataagtctgatgccagcatgccgcgcgtgccccgctgctcagccaacgtatcagcggcagcaccgtgaacaacgcaacctgcacaggcagcatcaaacagcgccaatttttgtcccattaacgaggcaataataccggtgagcacatcacccataccacccgatgccatcccggcattacccacatcggcaaaagccatttgcccgctttcactggcgataatcgtgcccgcaccttttaagacagccacaccaccatagcgtttcgccagatcccgagcagcttgtaagcggtcactttcaatttcgctggttttgacgcccagtaagcgagcagcctcaccaggatgcggcgttataatgcgattctgacgtttctccgcgcttattgccagcaagttaagtgcatctgcatcccaaagcatgggcttttcagtgcttttaaccttttcgagtgcctttttgccccattcccgctgtcccagccccggcccaattgcgataacgtcagcccacgcgagtgcttcatccagtcgcgcatcggttaacgcatccaccatgatctcagggcgcgcagtcaggatggggagaatattatctttgtgagtaagtactcgcactaatccacttcccgtgcgcagtgcggcttctgccgacatccgaatagcacctgccgtcccgctgtcgccgccaatcaccagcaaacggccctgatcgcctttatgggatgtcgccttacgcggtgtcagccagtgagacaggaaacgcgcatcgtagcgggccatgggcggctgctgtgccgccagaaaaccctgtaatcccaggtcggcaaggtaaagcgatccaatacagtcacgggctttgccggtaagttgcccgggtttcagcgcaataacgcttaacgtgtgcgtggcattcatgacgcttcccggcgtatttcccgttgctgcagacaggccggaaggaatgtccaccgccatcaccggcgcggcatgcacgtttgcctggtctatcagagtggaaaaagggtcgccaggcgcacggctgattcccgtccccagtaacgcatcgacgataatatcgaccttttcgggccagaccgcatgaggcgcatggatctcaccgcccgcttcaagccagctgcttctggcggtttctgcttcttcgggcaaggatttgctgccttcacaggccagcagcgttacctgtttgcctgcggcctgtgccagcctcgcaacgacgtaaccgtcgcccccgttattgccgggtccacacaaaaccagccagtgctctgcatccggccagtgcgcacgaatatgctcatagaccgcctggcccgcacgtaacatcagttcatacaaggtgatgccgagtgcatctgccccctcacgctcaagttgcgccagtgcctgcgcaggccagacagagtgtggtaaactgtcggcgtttctcttcgaattctggttagtcatgtcataccctctcgatcttgatcaactcgctcaacacattaaacagtggggacgcgatctgggctttcagcaggtcggcatcgccgacaccgatctcagcgctgaagagccgcgcctgcaggcctggctggacaagcagtaccatggcgagatggaatggatggcacgccacggaatgatgcgtgcccgtccgcatgaactgctacccggtacgcttcgggttatcagcgttcgtatgaactatctgcctgccaaagccgctttcgccagcacactgaaaaatccccggttaggttatgtcagccgctatgcgctgggccgtgattaccacaaagtattgcgcaatcgactgaaaaagcttggagaaatgattcaggcccactgcggcgaaagccattttcggccgtttgttgattctgcccccctgcttgaacgccctctggcggtgaaggcgggattaggctggactggcaagcactcgctcattctgaaccgggaagcgggctcatggtttttcctgggtgaactgctgattgacctgccccttcccgtcgacacacctcaggaagaacagtgtggacgctgcgtggcctgcatgaccatttgcccgacaggggccattgtcgcgccctatacggtcgacgcccgacgctgcatctcctatctgacgattgagcttgaaggtgccatccccgaagcgttgcgaccactaatggggaatcggatttatggttgtgatgactgccagctcatctgtccctggaaccgttatggacagttgacagatgaagaggatttttcacctcgtgaagcactgcatgcgccagagctaacggcgctgtttcagtgggatgaagccaaattcctgcggattactgaaggctctcccatccgccgtatcggctatcagcgctggtcacgcaatattgcggtggcgctgggcaatgcgccctggagcactgagatcctcaccgtacttgaacagcgacgaggtgaaagtgatttgctggatgagcatattcaatgggctattactcaacaacaggttaagcggaaacgcgatgagattgacgttcaacccgcgcagcagaaaaggctggtcagggctgttgagaagggattaccccgtgatgcttgattgcgcaacgttcgcaagctatagatttccacatcctgtgaataaaaataaaaataccttgtcattcaatcgtaataacacaagtgacagaatcaaataacataatgaaatattattaattctttatatatcataaagttaaataaaatttgtgatattttgcaaataaggctagcgtctggcttaatccataaagctgtggataactctgtttaaaaaagttttacggaatggcaaaagtggcgtggacagtaacctgcctgctgtggataactctgattgtcgtgctgaagatcttcattcagcctgtaacactgagacgaagtaagtgacaaaaaaactggagcgggaaacgagactcgaactcgcgaccccgaccttggcaaggtcgtgctctaccaactgagctattcccgcatagaagggcactactaaacacattttggagcgggaaacgagactcgaactcgcgaccccgaccttggcaaggtcgtgctctaccaactgagctattcccgcatagagggtactgctaaacataatttggagcgggaaacgagactcgaactcgcgaccccgaccttggcaaggtcgtgctctaccaactgagctattcccgcgccttgtaccgtaataaattcttcaccggtacggggtgcgcattatacgagaaatcgctgctgctgcaagatgcttacagcaaaattttgcgcttttgatgcgtttgctgataattgcagcaacctggcgatttcctgcgcaccctttgcggtttaaagctgcaaaaagtgttggcggtagtacgccagctcggcaacagactcgcgaatatcatctaaagcctggtgcgatccgctctttttgaaacccggaagaatgtctggcttccagcgacgagccagttctttcagcgtgctgacatccagataacggtaatggaaataggcttccagctccggcatgtacttaaacaggaaacggcgatcctgcccaatgctgttgccgcaaatcggggacgtattggctggcacccactgctgcaggaattcgatggtcgccttttctgctgcgcgatcgtcaatcttgctggccttcacacgttccactaaaccgctatgagtatgtgtacggacgttccattcgtccatcaagcccagctgcgcatctgactgatgaaccgccatgaccggaccttctgccagaatgttaaggtcggcgtcggtaacgatagtggcaatctcaataatgcgatcgcgttccggatcgagtccggtcatttcaaggtcaatccaaattagattattttcgtttccagttgccatgctgttacctgtggttgctgagtcgtcattcatcgtgaataaggtgtatcatagacgttttgccccccagggcgaaatccagctaaaccagtgagggtgagtgagtaaaaataaactgtcgaaaggtcaacaacgtcgcgtcagcgctaaccacgatcgccgtttaaaccagcgcaaaatgcgcccggaagcggacgataatatgttcggtcaggacgcagaaggcgtggtggtcagccgatttggcatgcatgccgatgtcgaggacagtgcaggcctgacgcaccgttgtaatattcgccgcacgatccgctcactggtcacaggcgatcgcgtggtgtggcgtcccgcgttaaacggcggcaaaggtattgttgaggctgtgcatgagcgtaccagcgttctgacgcgtcccgacttctatgacggcgtgaaacccattgccgcgaacatcgatcaaattattatcgtgtcagccattctgccagagctgtcattgaacattatcgatcgctacctggtggccagcgaaacgctggatattgagcccctgctggtgttgaacaaaatcgatctgctggatgacaacgcgcgtgcattggttgatgagcagatggagatttaccgcaagattggttatcgcgtcttgatggtttccagccatgccaaagatggcctgaatgcgctgcagaatgcgttgactgaccggataagcatctttgcgggtcagtctggcgtaggcaaatccagtctgctgaatgccctgctcggcttcgaccaacagaaagagacggccattctgactaacgacgtttctgacgtatccgggctgggtcaacacacgaccaccgcatcccggctttatcattttccagaaggcggggacgttattgattctcccggcgtacgtgagtttggtttgtggcatcttgagccggaacaaatcacgcgtggatttgtcgaattccgtgcattcttaggtgattgtaagtttcgtgactgcaaacatgacaccgatccgggctgtgcgattcgtgaagccgttgaaaacggaaaaatcgatcaatcccgcttctataactaccaccgtattctggaaagcatggcacaaatgaaaagccggaaaaacttcgctgagagtgaagattaaggcccgtaacgacgtattcgccatctgactggggcgctgttacaatccgctccctttttgtcaatgttatgaaagatagccaggaggctagggtgtttgatcgttttaaactcggcttgaatcacattctcccaaaaaaatggctgactgaacttgcaggttggggagcaagccgtcgcggcggctggctgacaaaactggtcattgatggttttgtctggtactacaacgtcgatatggcggaagcgcgtaaacctgatacagccagttaccgcacctttaacgatttttttgtgcgcccgttgaaagacgatgcacgcccgatcgataccgatgccagcctgatcgtcctgcctgctgatggcgcaataagccagctcggacgtattgaaggcgaccagattttccaggcgaaaggccactattacacgattgatgccctgctggccggtaatgagcaaatggccgcccagtttcatgatggcgcattcgccaccacctatctggcaccgcgcgattatcaccgcgtacacatgccatgtaacggtatcctgcgggaaatgatctacgtgcccggcgatctttactccgttaatccactgaccgcacgcaatatccctaatctctttgcccgtaacgagcgcgtaatttgttactttgagaccgatatgggacctatggtgcaaattctggtgggtgccaccattgtcggcagcattgaaacggtttgggcgggcacagtgacgccgccacgcgaagggattatcaaacgctggcattacccggcagccgatcatgacggtgccgtcgtattacttaaaggtcaggaaatgggccgcttcaaactgggttcaaccgttatcaatctgtttgcgcctggcaggatcaaactggcagaaagccttgaggccgaaactaaagttcggttgggccagcctatggcgatcgcccttccactgacgactaccgcgcctgacgctgtcgagtagaacctatgttcgtgcgttcgatcttttgtctgctgctgagcctctggctcagcaccgccacgctagccgccactctgcctgatgccagccaactcaaacagcagttggaggaggtcaaagcagcgaaaaattccgccgcgcaaaccgagcaaatccagtcgctggaagccgctctggcctcgctttctgaacgcgatgatgctatcgaacgcgcgcaacagtaccagcaggttattgatgatttcccgcgccttgcccgtgagctgaggcagcagatcgccacgcttaacgacaacgctaagagcgtgcgcagcaccatgagcagcgcggagctggaacaagagatcctgcaaatcagtagtcagttgatcgaagaaggacgccaggcgcagcaggagcaggatcgcgccagggagattagtgactccttgtcgcagctgccgcagcagcaaacagaagcgcgccgtgcgttaaccgagagtgagcggcgcttacaaagcgcgggcagcgctgccacaccggccggtcaggcccagctaatggcacgccaggcagaaaatgccgcgaacaaagccaaagtggatgagtatgagctggcgcagctgtcagcaaataatcgtcaggagctggctcgcatgcgcgccgaagtgcatcagcgcaaagtgacccagctcgataattatctgcaggctttgcgtaatcagttgaacgagcaacgtcagcgcgaggcggaaaccgcgctggcacggacggaacagctggcggaaaacagcggcgatttaccgcccgcgattagcgagcagtttcgtgttaaccgcgatttatctggtgcgctgaaccagcaggcgcagcgcatggatctggtcgcgtcgcaacagcgcctcgcgacgaatcaaattatccaggtacgtcaggcgctgtcgacgttacgggagcagtctcaatggctgggcgcctctaacttacttggtgatgcgcttcgcgcgcaggttgcgcgtttacctgatatgccgaagtcgcagcagatcgacaatgaaatggcacagctgcgcgtccagcgcctgcattatgaagatctgcttgaacgtcagaacgcactgcgtaaagcccatcaggcagacgggcaaccttttaccagtgaccaaaagcgtattctggatgcacagttaaaaacgcaacgagaactgctgaattccctgatttctggctgcgatacgctgattctggaaatcaccaaactcaaggttgccaatactcagcttcaggatgcgttaaccgaagttaaagatgccacgcatcgctatctgttctggacggctgatgttagccccatttcattaagctatcctctggacgtggcgaaaggcctgtcccatttgctgaccctggatacgctggggcagcttggcaaagccctggcgatgatgtttaccagccgcagcaccgtcttacccattctgggtgcagtgctgctggtcggttttagccttagcacacgtcgtcacttcaatgcttttcttgagcgctcagccagcaaggtcggcaaggtcactcaggatcgcttccgcctgaccatccgaaccgtgttctggtcgattctggtggcgcttccgcttcccgtgctttgggcaaccctgggatacggcctgcaaaatgcctggccctatcctgtcgctgtggccattggcgatggcatcacagctaccctgcctctgctgtggatattcatggtcagcgcccagtttgcccgttctaacggcctgtttatcgtgcacttccgctggccgcaggtgcgcgtggcacgcgcgatgcgctactactcattgagtattggcctgatcgtgcccttgatcatgctgctgataacttttgacaaccttgacgatcgcctgttttcagcaacgcttggccggctgtgttttattttaatctgcggtgccctgagtattgtcacggtgagcctgaagcgagcgggtattccgctttaccttgataaagaaggtaacggcgaaaatatgattaaccgcctgctgtggaatatcatgatcgccattccgttgctggcggcgctggcctcaatgattggctatcttgaaacggctcaggcgctgctggcgcgtctggaaacctccgtggcaatctggtttttcctgctggttatttaccatatcatccgtcgctggatgctgattcaacgacgcaggttgggtttcgatcgcgcacgtcagcgtcgggccgacatgctggccaaccgcgcacgtaatgaagaagaaaaagatcaggcgcaaaacactgacgtcattgaaattgaagagcccgtgatcgatttagatgcaatcagcgcccagtcactgcgtctggtgcgttcgattctgacgctgattgcactggtctcatttattgtcctgtggtcagaaatccattctgcgtttggtttccttgagaatatccgcttatgggatgtgaacacctccgtacagggcgtggagagcattcaacctattacgttgggtgccgtcctgatcgccattctggtgttcgtgattactacgcagttggtgcgtaatatgcccgccctgcttgagctggcgctgttgcagcatcttgatttgtcgccaggcacaggttatgccatcaccacactgactaaatatctgttgttgctgattggtggcttgctgggcttctcattgattgggattgaatggtcgaagctacaatggctggtgaccggcctgggcgttggcctgggatttggcctgcaggagatttttgcgaattttatctccggtctgattatcctgtttgaaaaacccattcgtatcggcgataccgtcactattcgcgatctgaccggcagtattacgcgcattaacacccgcgccaccacaattaccgactgggatcgcaaagagattattgtgcccaataaggcctttatcacagaacagttcgttaactggtcgctgtcagactccgtcacccgcgtggtgctgaccatccctgcgcccgcgcaggtaagtagcgaggaggtgactaccttgctgaaactggcggctgaccgttgcagctatgtcctggatacaccaccgccggaagtcttcctggtggatttgcaacagggcatacagttgtttgaactgcgtgtgcatgcggccgagatgggccatcgcatgccgcttcgccatgaattacatcagcttatcctgcatggctttgccgaaaatggcattgaaatgccgttcccaccgttccagatgcgtgtcgaaacgttaagcagaaaaagcgctgccgggacgggggcgccaacaacacggaccttcaaatcaggcggactgtaaaataaaaaacgcccggtcagaccgggcgttttcctgtttgggcggtgatattattgcttcacaaacgcttcgccctgggcgatatcttttttcagggtttccaacatgctttccagcgcctgctgctcaaacggactcagcgcaccgacagctttatgctccgcgataccgttcttacccaacagcagcggttgcgagaagaaacgggcatgctcaccctcgccttcaacgtaggcacactccacaacattcgcttcgccgtttaaagcacggaccagtgacagaccaaaacgtgcggcggcctgccccatggataacgttgcagaacccccgccggccttcgcttccaccacttctgtaccggcattctggatacgtttggtgagatctgcgacttcctgctcgctgaaggtgacgccaggaacctgagacagtaacggcagaatagtgacaccagagtgcccaccgatcaccgggacttctacttcgccaggttttttacctttgagttcagccacaaaggtattggcgcgaataatgtccagcgtcgttacgccaaacagacgattcttgtcataaacaccgtgtttcttcaacacctcagccgcaatcgccactgtggtgttaacagggttggtgatcaccccaatcaacgctttaggtgccgtagtggcaacctgctcaatgagattacgcacaatgccagcattgacgttaaacaaatcggcgcgatccataccgggtttgcgtgcaaccccggcggagataagcacgacatcagcaccttttaaagcgggggtggcatcttctccactgaaacccttgaccttaaccgcggtaggaatgtggctaagatcgaccgcaacgcccggtgtaacgggagcaatatcgtagagagaaagttctgaacctgcgggaagctgggttttgagtagaagtgctagcgcctggcctatgccaccagcggcaccgagtacggcaactttcattcataactccttattaagatggggcagagaaaagcagaaattccatctgtgtcagacctaaatcaactgctcaggcgatgacgcgcatccgcgactattttacgtgcttacgcacttaatctccggattaaaaacgcacgtaatcatctcactatcttcctcacgccggattgcagtcagatggcagacctgttcgtcccgtcagcattaccttgggtaagtgacattcacaaatgcagcctttccacccggtaaccctccagagtgtgatcgatataacctgagaccgacaatcttgacgtcggcagacagagaacggcagtgtacatttttattttcttacctcatcaataatataacacctttgcaacctttgccttttcaggctgtgagctgggttttggtctgagtaaattctttgctattatcgccgcccgcgatggataccgcttcgtacaattaacaaccgattgcataaaaattcatttatatgcataataatgactttactgcggcccgaaccgcggtttttcttacgtttactggtaacttatgcgaaacccatcgaaacaagacgatctgatcaaagccttcaaagctttattaaaagaagaaaaattcagttctcagggcgaaattgttcaggcgctgcaggaagacggctttgagaacatcaaccagtcaaaagtttctcggatgctgacaaagtttggcgcggtgcgcacccgcaatgccaaaatggaaatggtgtactgtttacccgccgaactcggggtgcctaccacgaccagccctctgaagaatctggttctggacattgactacaatgacgcgctggtggtgatccataccagtcctggtgccgcacagttgattgctcgcctgctggattctctgggtaagtccgaaggtatccttggcaccattgctggtgatgacactatctttattaccccagcccgcgcctttaccgtcaaacaacttcacgacgcgatccttgtgctgtttgaacaagagttgtagtcgttacgcctgaccggcagcacactgccggtttaccctgccctttctctatcatcccttctccagaccatcgctcgccaaatacattatttttcaataatttaacattaagccgtaatgctttcagaacaagaaatattggtcataccttttatgctacttaccattacgcgctattttacactgctttacattcaaatagtggcgctatcacccagaccaaaatagttaagcagccagatcgaccatgatttttcgcactaaaagttaaagtcacgcatcttactgtttttatgcgtaattacctgcctgagataggtttttcaccaattttaataacttttggttataaaaaaatcccataaggttaaattgagtcaacaaaacattattaggcaggtattaatttctgccgttattagtcctatacttactttcgtgatgtgaatcacactaataaaaaagaagaacaaccacgacgaggacatcttttatgaaaattaaaactaccatcgctgccttaagcattttatctgccctgtcattcggcgcttcagcagcagattatatctctgcttcgcaagcacagaatctgcaatctgtcggcacagtcagtgtcagtggtgtggccggtgcgccatccgatatcagacagcaactgagcgataaagccgatcagcaaggtgcaaaagccttccgtgttattgaggcctacaacgatggcaactatcacgcgaccgctgagctgtacaaataaaatcgttggtactgacaggtaaccagcttctatccacgcgttcgctggttaaacattattaccggagaatgaatcatgaaaacccaattaacgattgccgcgctgagcctggcttcactgctctcttttggtgctaacgccgccagcatggtaacgaatcaacaggcgcaggatatgaacctgcagccgctgaatcaaacaattagcgtgagtggtatcaacggcgaccagaccaatattcgccaggtactgtcgcagaaagccgatgcacaaggtgcaggccactaccgcgtcattgagaacaaccgtgacgataccttccacgtcaccgctgaactgtacaaataagctatccgcggccaggcggccgcccctgacaagatcgacgacccgctctatgttattcattccgcaggttgttgatataaatgaggaaaaatcatgaaaatcaaagcaaccatcgcaactgttagcctgctctccgtaatgacttttggcgcttccgcagcgcaactcgtgacagcagaccaaacgcagaacttgcaacctgtgggaaccgtaagcatcagtggcgttgcaggtgcccctgtcgactaccgttcacagctgtctcagaaggcagatgaacaaggtgccagcgcttataaaattatcgaagcgaacaccggtgacagctatcacatcaccgcgcagctgtataaatagttcctcgtcttaagtatgacgaaccctttagccccgctcgccggggctttttttatgtccgtcaaacagagaaagtccggcatttgtcacgatccatgccggggacccgaagccgttctggcagcataaaagggggttatcgcggtgttcagggatgtcagtaggcagatatcgcgaagcggtggcggaaagccgttcatgaccgccgatacgatcaacacgccagcggctaacagagagaaacgttagtgagaaagctgtgtcagatcctcgtcggacagccctgtcattgtgataacggtgctgcgatcgagtccacttttcagcatggtgtgagcgattttaagtgcggcggcacgttcaccctcactgcggcctttctcaagaccacgctgttcaccgagctgaatacctttctcgagacctttctgctcaagttgctgggcaatggtcattagtgcgtccccgtgttgcggcactcgctgtgccaaattacgtaaaaaagcgtcggcatcagacgcttcacccgcctgcacgatatagtgtaccaacgatataacctgtgatgaagaaagatatccggtgagtaaaacaggggccagtttatcaatcagctcagccagatcgcgttgatggatatgcttctgcagtaatgtcagcgcggccatgctgcgatgaccgacaatatcatcatccggtatgacggtaacatccaccagcggaaaggcgctaccgtacagcttagcggcgagcgcaggcgttgtgaattcgtccagccatcgggtactgaaagggtaaggactacgtttaccactgtagaataaaaccggtatcacgagtgggatcgttttatatcccgcatcaaggtggcgctgcatggccgctattgcatagcgcatcatcctgaatgccatatgcctgtccggagaagactgatgttcaatcagcacatggatatatccctcatcgcggcgcgtggtttttaagctgtaaagcacatcactaaaatactgacgtagatcctcttcaacaaaagatcctgactccagcttcagcgtgctcagatcgcaaatagcgagaaactctgctggaagatgcagttccataaaatcacgcgcgatggcgggctgagacagaaactgccggaatgtcgcatcgtggggcgtgagtgagcttttttttcttttcatttaacctgaccagaccataacgggcgcaggttatcacgctcaaaaaatttgaagagaaaccaaacaagaggttgcgagggctgtcgagaaatgtcgattttctgccgtagctgcacgcttccggcgaccggttaacccaccgaacgctgaggatgtcttaacgtggtgacatgctatcgagcgataggttatacgacgttaaactggagccgtccttccagctcttcttcagcctcgtcgaacaacagaattaaagcgccatagcggcgtttttgcccctggccaagattcacaaattcaatttttaacggcatgggtagcccctggctgacaatgacgtcccagagcccatcgagatcgcagataaaccgcgctttcagggcgaagcgatcgcagaactggcgtaagaaatgggcctgatcgacaatctcattaaaatcaaaacgctcgactctcatactgacgactcccgttatccggctctgggcgacctgaggccgcccggatattcatctagcttaaaccgccgaggtgcagcgctttgacctccaggtactcatccatccccagcaccgatccttcacgtcccaggcccgattctttcacgccgccaaagggtgccagctctgtcgagacagcacattcattaatgccaatcattccgctctccagcgccgaagatacccggaatacacgctgcaggttttgcgtataaaaataggccgccaggccatattcagtctggttggcgcgacggatcacctcttcttcatcatcaaagcggaagcaggctgccactgggccaaacgtttcttcctgggccagcttcatcccttcatgtgcatcgccgatgacggtgggttgccagaagtttcctcccaacgcatgtcgcttaccgccagccagcaccttgccgccctgagccaccgcatccttgacatgctcttcaactttttccagtgctgaggtttcaatcaacggaccgacaatcacgccgtcctccatcccgtttccgaccttgagcttgtccacttctgctgcaagctgagtggtaaaacgttcgtagaccgcactgtggatgaaaaaacggttaacgctgacgcaaacctgaccggcattacggaatttgttagcaatggcgccctgcacggccgcatcaatatccgcatcctcaaacacgatatagggtgcgttgccgcccagctccatcgagacttttttcatcgtctctgcagcgttacgcatgagcgttttccctaccgccgttgaaccggtaaaggaaattttccggacggctttgctggccataatggcatcgctaatggcatgtgtgtcgccagccaccccattaagcacgccatcagggataccggctttttttgccagcgccagtaaggcaaatgcggaaagcggcgtgttattcgcaggtttaataatgcctgtgcatcctgctgccagcgcggggcctaacttacgtgtcagcatcgccatcgggaaattccatggcgtgatagcggcgactacgccgaccggctcacgggttgccagaatacgcgaccccgctttggcgggcgggatgatttcaccattggcgcgtttagcctgctcggcaaaccattgaataaagctcgcggcgtattccacttcgccctctgcttccttgagcggcttaccttgctccgttgtcatcagctcagccagccagcgtttattttcaatgatcaacctgtaccagcggtaaagcagttctgaacgcgccttcgcggtctgtgcacgccatgccggaaaggcctcttgtgccgccttaatcgctgcttccgtttcggttttacccgctttggctacctgagccacgcgctcaccggtggcagggttggtcacgtcaaaggtggaagccgtttgcagccactgaccgtttaccagatagcccgtctggaacagttcgctgtcttgcagtggagaatgcattgggttactcctgtcagttttgtcttctgtcaggaaagtatagatggcaaaaatgacaggtcaggtaacagggggcagcatcatggccgccagcacctgtggcagccataattcagatttggacgagcgtgttttgatattttgtcagcatctcagccagccgcttcaccggctcggtcacgctgtccggcgcgtcatagtgcgccagcttatgctgatagacatccaactctttgagtaaccgttcaaaataataacgtcgcttttcatcactgcgcaccgagataacccgatcggcagtgtgccgtaactggcggtgataggcggataaatcggcgttaaccggcacatctgcagcgcgcaggcgttgatgaccaataattaaggtcagcgcaatgcgatatttatcaatatccccagggaacaggttaagcagcaaaaagagctgctgatagagcgccggaagatgattttcacggcggcgagcctggtttgtcgtcatcgccgaaaccgccgcatacatgaagcggttaagcagtttacgtcccgtgcgcgctttggatttatcccgaattaacaggatgaccatcagcgcaacaaagctgcctatccactgtcccagtgcactgtcgatgaacaccgtgaagttgaactgcatcggattatccagcaccaggacgttaattgtgccgaccatggcaccgagtgttccgatctgtcggcgctgaattaacatgcctgaaataaaccctaacaggccaatggcaatgcacagcagcgtggcgctttgttgggtattgggcaaaatatacataaaatagagcgcacccagcggcacagccaccgtcataccgtaaacaaagtctttggccatcatcagcggattgggcatccgcatcgccagtgccgtaatcacacccagcatgaccatgcagccgcttcctgaggtccagccggtatacagccagaacaacgaacccagggcggtggccacgaaggtgcgaataccgttaatcatcgcatgatgggtttccgcagaacgcgcctggattaccacctcgcgctgaagaatacgctcttccaggtcggtaatacggccattgcttttgatgccgttaatcagcagctgatattccgttgcggcctcaacccagctttccagcgtctccggtgccgttttactgccggcggcgattaaccgtcgcagcgttttcatacgcttgtgtacagcttctgccgtggcggcttcttttccggtcagcacgcgatactgcgtaggaatgtagtcaggccgtgagttttggattaagaacgtttcggcggcctgagtaatcagcgttaatgacagagtattcagcatttgcagccggcggctggtattctgccagcgcgaagactccatcattaactgactgcgcatgctactgagcgccgtggtacgccgcaccaacgccccccaggctttatcgacttcttctttgtcctcatgcgcgacacacagttgtagcaacctgtaatgcgccaccagcagcgactcgacttcggcatcaatcactttcttaatcgaacgtggcgagaaaatcatatcggccagaatggcgcacagaatccccaatatgatttcgctacagcgttccacggcatattgcgggaccagcgtcagtccactattggcatttgccgtgacgacaatgattaatgcggtgtagcctgccagcccgagcgcataggaattctctaccttaatcagtgaagacagccatacgcacaaacccgcccagatacaacatagcagcagcataacgaccggcgcgcgtacggtcgcaatcatgatgaccagcgcggcgatacaaccgataaacgtcccgatgatacgaagaataccgcgatagcgtaatgcccccgaatagggatcgccgcctgccgcaaacgccgttccgcccgccacaatccccgcagtcatgaccgcccagcggggggtttcaaggttaagatgaaagccgatcatcagcgcggcaaccagcgcaaaagtcagctttatcgggaaacgcaggaactcaatcatatcgccctcttaaccaaactcacgcagacggttaaggaaggacatgatgggcgaggtctcagtatgctgacgatcgtgtgctccggtgatgaccacggtggccgtcgtccctgcgggataaagattgcccggctcctgatcgagacggatgcgtaccggcacgcgctgcgccaggcgcacccactccagattcgactgcaccgttgccattcctttactgtcaacgctgctactgctgttggtcacgcctgccgcgatgctgtcaaccgtaccgcgcaacgtcacgttgctgcccagcggggtaatttcagcccggaagccgggttgtacgccgtgcagtttggtctcttccagataggccagcacgtaaaatgagcgctgctgaaccagcgcgacggcaactgagccacgcgtaataaattcgccctggtagacattcaggttagttacccatccatctgcaggggccttgatggtggtgcgctccaggtcgatcttcgccagatcgcgggtagcaatagattttgccagttggtgttcgctggtttgcaaatcgttgttggattgctcaattgcttcacgtgacatcgcagacgtgccgagtcggtttcgacgtccggcctctcggcgtttttcattaaccagcgcctggtaatattccacgtcggcctgtgcttcatctaaggctttttgatagcgtgggcgatcgaccacaaacagcgtgtcgcctttttttaccagttggttgtcgcgaacggggacctcggtaatcaacccggtgacatcaggtgaaatcgcgacgacatcggccgcaaatcgtgcatcgcgcgtccagggcgattcggtgtagaacacccaggcacggaatatgataatgacagcgatgatgaccagcaaaagggtgatggcgtaacgcgcgatttttcttataagcgtgttcacgtaaacctcaaacaaataaacgggataccagataaaatacacagcagtaaagggctgtattgaagagtgccgggtgccagacaagatcgtagataccgctgggcgtcagcacgcgtttcaccaaccagaacagcatgagtgaaacaatgagttcgatgaaaatgggcggaaaagagagcccaaacatgacaaataccggaagtacactcattaaaaatccttagttcgatacggccgggataattcaccgcctgaaggacgcaaacgccagtgcgccataagccacatctgaactacggctggcttaataatagcgtatcatcgggtgttttcaggtaatgaagcgtcgccaggtcataccccggtaggcttatagtaacgcgcttaactatacgttttctactgaatgtgatctaaatcactttttagccagagtaaacaatggaacgacttaaaggtatgtcgatattcgcgaaggtggtagaactgggttctttcaccgcggccgcacggcagcttcatcttagcgtgtcatcgatcagccagatcgtcgccaaactcgaggatgcgctccaggttaagttacttaaccgcagtacacgcagcatcggacttactgaggccggtaaaatctattatcagggctgccgccgcatgctggcagaggctaaccaggttcatgaacagctgtatgcctttaataacacgccgatcggtatattacgtattggcagctcttccaccatggcgcagaacgtgctggccggtatgaccagcgatatgctgcgtgattatcccggtttgagtgttaacctggtgaccggcattcccgcgccagatttgattgcggacgggctggacgtggtgatccgggtgggagcattaaaggattccagcctgttctcgcgccgacttggggcgatgccgatggtggtctgtgccgctaaacactatctgacgcagcacgggacgccggaaaaacctggcgatatcgcgaaatttgcctggctggaatacagcgtcagacctgataacaattttgagctgattgcccccgaaggcatcgtcacccgtctgtcgccacaggggcgtttcgttaccaatgattctcagacgctgatccgctggcttaaggccggcaatggcatcgcctatgtaccgatgatgtgggtggcggatgaaatcaagaagggcgagattgatattttgttcccgcagtaccaatccgatccacggccggtttatgcgctctataccgaaaaagacaaactgccgctgaaagtacaggtctgtatcgactatttgacccactattttgagcaggttgccgagcagtacaaacagcaccgtaaaagctaaaaacccgccagctggcgggttttctgtctctgtcaggcggtgccaccgatagtgagcttatccagcttcagcgtcggctggcccacgccaaccggcaggctctgtccctctttaccacacacgccaacgcctttatccagcgccagatcgttaccgaccatagagatttgctgcatcgcttcgataccggagccgatcaaggtcgctcctttcactggtttagtcactttgcctttctcaatcagataggcttctgacgttgagaacacaaacttaccagaggtgatatcgacctgaccaccgccaaagttaggcgcatacaaaccgtactctacgctttcgataatatcctgtggcgtggatttaccggccagcatataggtgttcgtcatgcgcggcatcggcaggtgcgcataggattcgcgacgaccgttaccggtaggatttacccccatcagtcgtgcattcagcttatcctgcatatagcctttcaatacgccattttcgatcagcacattgtactgtccaggaacgccttcatcgtcgatagccagcgacccacgtaatccctcaatggtcccgtcatcaaccacggtacacagatccgaggcaaccagttggcccatcttgccgctaaacactgacgtgccacggcgattaaagtcaccttccagaccgtgacctacggcttcgtgcaacagtacgcccggccagcctgcgcccagcacaaccggcaaggcgcctgccggcgcagccacagcagacagattgaccagcgccatgcgtacggcctcacgtgcccaggcatcggcccgcacgtcgccattctcatcggccaggaaaaatgcatagccggtacgcgcgccgccgccgcttgaaccgcgctcacgcttgccctggtcttcaacctggacactgatagacagacgaaccagcggacgcacatcggcagctaaagtaccgtcggttgcggctaccagcacctgctcatatacgccggtcaggctggcattcacttcctgaacgcggggatcggcagcacgtgcaacctggtcaacacgatgtagcaacgcaattttgtcctcacggctcaggctgccgagcggatcgactggcgcatacagagaacggctaaccacggcagacagcgtctgagccttgccgttgccctgttcacgcacgatgcttcgtgccgcttcggaggataagcgtaaggcattcagcgtgatttggtcggcatacgcaaaacccgttttctcaccgctgacggcacgcacgcccacgccctgatcgatatgataggacccgtctttaatgattttatcttccagaacccaggattcatggaagctggactggaagtaaagatcggcatagtccagacgacgttctgaaagctgccctaacagggaaaaaaggtcctgctgattaatgttgttagcagttagcaactgctcacttaccagattcagagtcatcgtgtctcacttaatatgtgctcggataatcatagcctgcggcaattatgttacgccgtcaaatatcacttgttataggtttcgcgtggcttacgcattacttcatctatttcaggcttatccagcggtccgctgatgtgataacgcaggactgaaattttactccagagcggtcccagcaccttgctggcggcaaataccgccgcccccaccaccggattaatggcaaaagcagccgccacgcccactgacgcagaaatttctggcgtgactatcgcttccatatcaatgcggcgtttcaccaggtccatattgccctgcatggcgatatccgcttccaggccgtcaaccaacaggttgtcagttctcacgaccccattttcaatccaggcggtgccgttgatggagtcgaaatagaaccccttgttaaaggtatcgctgaaatcaaaacgcagtttgcgtaacagggcatcgaagctcaacaggcgcagaatctgtccggcggcgccggtatccacatcgcttatttgtcctttaccaaagtgcgttttcagcgtgccgctcagcgtttctgccgcgggctgccacggtgccgagcgccagtgcaggtcataatcaatcttgaagggcgcatctcgcagcggcgtattcacgccaaaccagttggtcgcgttattgatgttgctgccctgcagcgtgccttttaaagaggtgcgctggtcgtttggtcggttaacccattcgccctgaatgttcagccgcgagctgccggtatccactaaaccgttagtaagtgccaacgtacttcctttaggctgaagccgggcagtgacccgtccatacttctgccccatcagccagcattcagcgcattgcagttgtaaagcaggccactggctaaagtcgatctgatcgcttttttgccccagaggtgaggcggacgcacttttcttatcgccagtgccctcccagtctggattgtaataaaggtaatccagagcgatctgccacggcgctgaaggtgaggtgattaactgccctcttagctcgtcagcattgacgttaatccggttttttccacccatgtcctgggttaatgaggtatcaacgttatgccagcgctggcctgccagactcacagaagggctacgcaggataatattgcccggaagcgttgcaccgcccacctgatgctcaccggttgaacgggtcgcaccaccttcgccagccgtcatcagtgccgcccacgcctcaccatccagcgcaggtaagttgagtaccatgcctgaatgatctggcagcgtcggtattgtctttgtatcgttgagccagataccacggtcaacgcgcagggccggctccagcagccagcggctgttaaatttgtgccgttcatctacgctaccgctgagatcaaagtgcgttaaatcgcctttagcgttgatggccacaggcaggctttcgcccgcttttttatccagtggcgaaggtaagcgactacttacttccttcccgtcacctttcagcgcgatgtcgtaatgcgcaccgcccttatgcggtaaggcgacgttaacctcgccctgccagggaagatgcccaaccagttggctgcccacctggggcggaataccggtgatttttgccagttgccagtcagccagtaacttaacgttaatgccaaaatcatcaggattttcttttgtgctaaagctgacattaaggggctgaccaaaccagtccgcctgcatctgatcgctttcaagattgccgttgttataacggaactgcccagtcagatgggtcatggtggtattcagcggcttgatatgcaggctattgttattcatcaccacatcaccactggcgtgaacgtccttgccattcagaggaatatcaagcttaaggtggcctttggtcagacctttaatctgtaactgttcaagggccgcccccagggaggacttgagtggcgtgtgctggaagtaatcgccaatttgctgaccatctccgctgatatcaccgttgataatcagcttttccttcatgtaatcaggaatggtggcgctgacattacgcgcctccacttcacccagtttagccaggggcgcatgcatccacaggccatcattcaggaagttaagatcgatatcgaggttgctgatatccggccagccgggctggaaaccataggttgcgtggcgtaaaggcacccagacctgaaacatgccgtcgttatgctgaaaaggaaaaagcgccggattgccgttgaacagcagcgtggcattctccaccttgccgcctttaaccgcgccgctcaggtagcgcgtgagcgaatgccccatcagcggtgtggggaaatagcgccaggcatcgcccgcatcgctgacgttaataccggccaggatatcaagttgaggctgcgtatcggtgttctgctgataacggaagtcgccatgtgcccaaagtgaacgcgcctggatatcaagattatgacctgccagggtcaggccgtgcgggtcacgcaaccagctcatactgccggtcacctgcttgatctccagcggtgcctggaacatatcaccatagggcaccgtggcctggcccatcgcaatcgtggcctgcccattattcaggctgcctgtcgcttcgccatttaaatggctgatgccgggaaccagtttccagaactgccagctgaagtcgcgccacttaacctgaaagcgcgtctgctcaggctgatcgacaggaatatccagcgccagcccgtcaatggtgccgcgcggtcgtaatgcgcgccagttatcaaacaatgccggtgataagggcgcaaacagcggcaccaacggtgcgatgtggtccagcgccaactgtgttgcacgtacccgaatctcaggctcgctgttgctgcccagcatctgcgggtcctgaggttgccagaggagtgagaaatgaccggcaggccaggcattaccgtctgtgctgagcctggtttgcggcacattgaccacccagccatttttgtaacgcgacagatgggcagtgaggttatcaacgttcagcgtgtggggaccgctctcgccctgccagcttgcgccgcccttacttaacagcagatcgccggcatagacgtcgccatcacgcagattaacccaggccgccaggctgaaccgggcactatcaagccgggtgttatccctcacccagcggcccagccatggacgcatatcaacatcatcggcctgcatccagatacgaccatcgttgagtaagccattactgtctttcagatcaagacgaacctgcactacgccgtgttgtccagtaaagctcgacaggctgacttcaccttctgctcgatgtcgggtgttttcgttcaaccaggtgaggttaggaatcgccagttcagcatgctgaccggatggggtgataaagcgaatggtgctgtcacgcagagtaaagtgatcgaactgacgcaaaaacagatcgttgacctgagtgagcttaaagctgtgcttgtcgctgtcactggtcagcagaggctgagtgctgtcgagatgtaattgccagaaggtcagatcgcggaactgccagcgccagtggagcagtgactgccagacatccagcgcaacggtgatacgtgcgatggagagcgagccggtctccttcatatcgacatttaagtcgcggatttgtagcgtggggccgaaattctcccactttccacggagttggctggcgttaaccttgacaccgctggtgtcggagacgaactgaagaacctgactacgataggcgtcaagatgcggcatcgccagacgcagcgcgctgacaagcagcgccacaatcacaatgactgtcgcgagcagcagtaacataattcttggcaactgcctcactcacacctctccttgtctaccgttaacgacggatggttgctgctcatacccggcgtcttatgacatagcggtatgggttcacattttaccccaaaatgtgcagtcaggcatggtgagcctgaccagccagtattacatcatcaccacgtcaaactgttcctgagtgtagagcgcttctacgtgcaccttcacctgtttacccacgaaaagttcgacttcggccagcgcatgggactcatctgttttcaaggcctcaccgacggttggcgaaacgtacaccaggaatcgatccgagtcataagcatgatgcacgcggacaatttcgcgcatgatttcgtagcacaccgtttcaactgttttcagcgtgccgcgccctttacaaaccggacagtcctcacacagcacgtgctcaatactttcgcgcgtgcgcttgcgggtcatttccaccagccctaacgctgaaaagccgctgataccggtcttaacccgatctttattcagtgccgtttccagcgaatgcagcacgcgacggcggtggtcctcattactcatatcgataaagtcgatgataatgatgccccccagattacggagtcttagctgacgtgcaatcgcctgagtggcttccacattggtattaaagatagtctcatcaaggtttcggtgcccgacaaatgcccccgtattgatgtctatcgtcgtcatcgcttcagtttgatcgatgattaagtatccgccagatttgagttcaacttttcgttccagcgagcgctgaatctcattttcaacatcaaacagatcgaagataggctgcttaccattgtaaagctcaagcttgctggacatctcgggaatgtattcactggtgaactcgttgagcaaatcgcaggtgaggcgcgaatcgacacgaatgcggtccagcgctgcgccagcaaaatcacgcagaatacgttgtgccagcgccagttcaccataaagcagacaacgcgtttgattacgtttttttcgttcgctgactttggtccacaggcgcttcagaaaggccgcatcctgtgccagttcttcttcaccaatgccttcggctgcggtgcggataataaagccgcccaaatcgtcacagtaatcggctaccacggctttcagccgctctcgctctttttcactggcgatacgttgagaaacgccaacatgcgctgccccaggcatgaacaccaggtagcgcgaaggcaatgtgatatccgtcgtcagtcgcgcgcctttggtgcccagcgggtctttcaccacctgaaccaccagatcctgtccctggcgaaccagttctgcgatatcccgtacgacaaaatttttcttttcatcgcccgcaacacattcggtgtgcggcatgatgtcagaagcgtgcaggaacgcggctttatccagtccgatatccacaaatgccgcctgcatgccaggcagcacccggctgacgcgtcctttgtaaatattgccgacaatgccgcgtcgggcttcacgctcgatatggatttcctgcaggattccgccatcaatataggcgactcgcgtttcagcaggcgtaacgttaaccagtagctcagccgtcatgttaaccccttacggcacgcagtgactgaaaatggtcgatcagctctgctgtctcaaccaagggcaatccgaccaccgcgtgataacttccattgattttacgcacaaagtttccgcccttcccctgaataccgtaagcgccggctttatccataggttcacctgtcgcgatgtaatcagtaatgtcgctcagggttaagttacgaaaagtcacctcggtgaccaccagacagtccagtacctgctgacggtcagccagagcaatcgccgtcatgacctgatgggtttttcctgagagtttactgagcatcgcgctggcatgggcggcatcgcgcggtttttccagcacctcaccgttgagcacgacgatggtatccgcgcccaatacaggcaggtcatgcggggcaatcagcgtaccggcttttgctttgtcatgcgccaggcgacggacatacacctcggccgattcatgcgactgacgttgttcttcaacgtcagtgatgatgcgctcaaagttcagaccaagttgagtcagcagttcgcgtcgacggggagacgcggatgccagataaagggttaccataaatttccttattgaacagcgaactgacggcggatctttctcattaataagaatagccacggccagagaatcccgtcgacaacactgctccagaaaatttcagggcggaatgagacgttgatcaccagaaactccgcccagaagacgatcacatccattgctaatgacagcaccataaccattaacgcctgctgccacaacgctaagttacggaataactggaatttaaacgccaccagataggcgatgatgctaagcgccaacgcgcgaacgccaagcgtggaacccgcgattaaatccataatcgcgcccagcagaaacccacttcccacattaacacggtgcggaagcgccagtacccagtagaccaggatcagcaataaccatgaaggccggaacatatagatttgttccggccatggcatgatttgcagaataaaggccataagaaaggacagccagataacccatcgtccctggctgcgatatcgactcaattctggcctccgcgtgagcgggaagcggacccttgtgggttgctttcgctactgccagaagcaggcgtggtggtctgggtagcaggtgcaggcgggcccatttcacccgcgggaggcagaacctgcggcatcatctgcatcaggcgttcattagcgacccggtggacttcatcaggtgccatcggcatatcaccgttgtgatccgcgccccacagtagcaacaggtaacgcagacgttgcagacctgcggttggatgtgcctggatgaccgtgtacgcgcgttgcgtatcgaccttaaccgatgaaaccacccctaccggatagccctcagggaaacgcccacctaagcccgacgtcaccagtacgtcaccgacacgaatatcggtattgcctggcaagtgttccagttgcagatcttccgtacacccgttgcctgccgcgatcacgcgaatatcattacgcagtacctggataggcagcgcatgtgatgcgtcacaaatcagcagtacacgactggtaaactggccgacggcgatgacctggcccacgacacctttatcactgataaccggctggccttcgtaaacaccgttagcactgcctttatcgataaccacttgatcggtgtagggatcggtaccggtggagataacctgagtcaccatcttgtgctcgtcctgacgcagcggggaacccagcagctcgcgcaggcgcgcgttctcctgcttgtattgccccagcataagcaggtcgctgttcttcagaaaaagctctcgacgtaacgctttattttccagttcgagctgctggcgagaagccagcgtgtctgacacgccatcaagaagctggcgcggcccattggccaggaagtaaaacggactgaccgacgtgtccagatagttgcgtatttgagtaaatgaactcacgcgactatcagcaatgataatggcaatcgccacaatcaccgccaaaaatagacgcaattgcagagaaggccctctgctaaaaatcggcttcatataatctgcgtgttcctcgactacaaggtaagaaagtacgggcgagccgcactttcctgggctggtcacatcataccgatgcgtgcagcgccggtttacacgctactccctgcgcactgttacaacgattccagccggttgaggcaattattcttcgctgaataaatcgccgccatgcatgtcgatcatttccaacgcttttccgccaccgcgcgcaacgcaggtcagtggatcttcagcgacgacaacaggaatacctgtttcttccatcagcaggcgatccaggttacgcagtaacgcgccgccaccggtcaggaccatgccgcgctcagaaatatcagacgccagttccggtgggcactgttccagcgcaaccattaccgcacttacgataccggtcagtggctcttgcagggcttcgagaatttcattggagttgagtgtaaagccgcgtggtacaccttccgccaggttacgaccacgcacttcaatttcacgcacttcatcacccggataagccgagccgatttcatgcttgatacgttctgctgtcgcttcaccaatcaatgaaccgtagttacggcgcacataattaataatggcttcgtcaaaacggtcaccgccgatacgaacggatgaagagtacacaacgccattcagggaaatcacggcaacttcagtggtaccaccaccgatatccacgaccattgagcccgtggcttcagaaaccggtaaacctgcaccaatcgcggccgccattggctcttcaatcaggaaaacttcacgcgcgcccgcgccttgggccgattcacgaatcgcgcggcgttcaacctgggttgcgcctacaggcacacagaccagcacacgcggacttgggcgcatgaagctgttgctgtgaacctgtttgatgaagtgctgcaacattttttccgtcacaaagaaatcggcaataacgccgtctttcattggacgaatagctgcgatattgcctggcgtacggccaagcatctgtttggcgtcatgacccacagccgccacgcttttcggtgaacctgcacgatcctggcggatagcaaccacggaaggctcgttcagcacgatgccttgtccttttacataaatcagggtgttcgcggtacccaggtcaatggacaagtcatttgaaaacatgccacgaaattttttaaacatactaaaggataatcctgcaagctggaggcggaaaataaaatccgcttactttaccaaccacacgaagctgccacaaggcgcaaaaacgttctgcttcggtgaaaaaatagacggcattcgttttacatcatttaagcctgttacgcatacgagcggaacagcgatatcacggcatcagagcagcatgttaaagaattttcttaactttactccgacataaaatctaacatttcaggcgacgtattctgcacgtttatcgttccatattcatcaaaagctgaggcgaagaacgtaaaaccggtcaaacggttaaaaacggtaacgctgggagtacttttttacgttactgttaaccggctgtgaaggtgaaaaaaagtcaccctgtccaccttctacccctaatcctaccagggtttgccactctgcattggtgcgcacgcccgcggcatacagctgcgtcccggtgggcttacagacgtccagcaagcttcgcacaaacagctggttttccgtacgccgctcaatgttgcgcaccagtcctgcatccagcttgattaattcaaccggtaactgccggatgtaagcactgctgactaccgtcagaccggcctgattaaccgcgatacgacagccgaatgcctgcaatgagtggaagatcggaatcaaatcgctgatgtgttgacagacatccccttccgcaagttcaaataaaaatcgctttctttgagattttgggcactgcagcaacatattgtacaaccagacaataaacggacgtttcagcagcgagtcgatattgatggggatgaccaatgtctcttctggccacagttcagataaggcggcaacgcgtaataccatctggcggtcccagctttcggccatgccgagctgctgcaccaatggcatatattcagccgacagtacctctttgtccccatcataaatgcgcgtgagcagtacgcgatgccgcaccttaccctctttgtccaccgcaggcttctgatataaacgtggtccgccgcgacttaaggtattttccagcaaggtccgccaacgaacactaccgcgtcctgcatccagagggtttcctgcgccattagaccagttattgccgcctgacaacgtcgcgcggcgcgtggccatttcgacattttccatgacctgcggcaccgtctgtccgctgtgccaggcactgatgccgatgtgaataaaatcgtcgcggttaaccttgcgcataggcggcaacgcgtcaaccgcattgatgaggtgatcagcgatactgtttgcctctttcaggctacgatgcggcagtaataccgcgaaatcactgcgaaaatagcgcgccagaagtgcgccaggataacgcatgacaaacgtggacagcatgttgacgacgttaaacaggtactcttcgaccagcactggccccagtgaatcatcgtgggtgtcgagctcaggaaaacgtatcatcatgaccacgccatgcgtcccgacatcttcctgatcctcaagcagcgttgccagctgactatcgaagaaaaggcggttattcagccccgtccggccatcctgagccgcaaaggttcgaatcagcgtatcgatgcggacgcgctgctcgccggcttcctgtagatcggacagtaacaggtcgatcgcacggctggctctgggcggccactcatcagcatgcttttgccgacaatgccgacgttctccaccaagtattaatgctgagcggctttccagttgctccatcccgcgccattgacgtaccagccaacgatgagtaatggacagcataacggccatgatcagtacgaccaacagcagcgcgacaagcgtatatgtcgcgggaatagagtgcagccaggtttgtgcgggatcgagtatcgtcagttgcaatcgcatacccggctggtgcatcagcgcaatgtcaaaatggatatagcgatttttttgatgctgcagcatttggttttcatggcgggaaagcgtgaaaacagtctgccgaccattatataaggacagctgttcggcgttaatcacgggtaataccggcgtaagccaggcttccagcgcttcgggaggctgtttcagcaggactttatccacttcggttgccaaaacctgtacccgattttctacacgctgatgggtgagccagaaaacactaaaagcacagcccaccagcattaaaaccattgccagtacgctaataaatgtaataaatgcagaaagtttggtagttaatcgcatccctgtgcctgtttcactacggttgccgccggatcacgccgcctctctgcacgttagccggaagaattttgagcaaaataacacaaattgtttccggcaacagcgaggtcatacgcgaagccgcagtataacgttgagaaaggcccagaacgcttaattatccttttttcagcgcattctcattggaagcttcagccaggaaatttcacatttttgcagcaaaattcgccagcttaagcaatagtcatcatgctgattgtgaaaatcgagctggagaagagacgatgaagcagacaaaacgcctgaccgaagcagatgtaacgccagaaagcatctttaatatgaatcgtcgtcgggtgcttcagaccctgggactgggggctgctgcaatcagcgtcccgggcatggccaacgccgatattctgagttggttcaaaggtaatgaccgcccgcccgcgccggcgggtcgggcgctggactttaccaagcccgcacaatatcaggccaacctgccgttaacgcctgcggataaggtttccggctataacaatttctacgaatttggcctggataaagccgatccggcagcgaacgcgggaacgttaaaaaccgatccctggaagctgacgatagaaggcgaagtggcaaagcccgtgacgttagacatggatgatatttttaaacgctttgccatggagcaacgtatctaccggatgcgttgcgttgaagcctggtcgatggtggtgccgtggataggttttgaactcaataaactcctgaagctggcggaacccaccagcaaagcgcgctttgttgcttttcagacactttatgcccccgatcagatgccgggtcaaaaggaccgctttatcgggggtgggctaaattatccttatgtagaaggcttacggctggatgaagccatgcatcccctgaccattctgacgacgggcgtttacggtaaagccctgccgccacagaacggtgcgccaattcggcttaccgtaccctggaaatatggctttaagggcattaagtctattgtgaaaattacgctgacgcacgaccagccgcctaccacatggaaccagattgcggataatgagtacggcttctatgccaacgtgaacccgcatgtgaatcatccgcgctggtcgcaggccaccgaacgttttattggtccgggtagtgcttttaatgttgatcgtcagcccacattactgttcaacggttatgccgatcaggttgcatcactctatcgcggtatggatttgcgggagaattattgagtgcgcctgtcaataaagcagatcggctggcttaaagtgctactgcatctggcggctttcttaccgctggtttacttgattatggccgcgatgcagggaggactcagcgccgatcctgccaaagatatccagcattttaccggccgtatggcgctgaaactgctgttagcaaccttgcttgtctcgccgttaacacgcgtggccaggcaaccgctgctcattcggacccgtcgcctgttgggtatctggacttttttctgggccagcctgcatctaaccagttactacctgttggagctgggcgtgaataacctcggcctgctcggaagcgaattgatttcacgtccttatctgacactgggcattatttgctggtttattctgctggcgctggcgatcacctcttttcaacgcatgcagcgcaaactgggcaggcgctggcaaaccttgcataactttatctatctggtcgctattttggcgccgattcactatatgtggtcggtaaaaatcctgtctccccaaccgatcatttatgcgcttttagccctgatattgttagcctggcgctataaaaagttcattaaatggtggccgcgctagtctcttcttattgccgatcgtctgcgaaaaatgcggcctgcgagccgcatccgatcaacttcgcagataagaccagtattttgctgcgaaatgccacgaaacggatataatgcccggctttattgcgatgtgacgcttctttttcactgtgacgggtgacaaatggaaagcggcaaggtattttacgcgatgcctcaatgattgcgggagatggcagcaagatggccgataaattacatattctgcttttgaacggtcccaaccttaacctgttagggacgcgtgagcctgataaatacggggatgttaccctggatcagattgtttccagtctgagccatcaggcagaccagttgaatgtaaggttaagccatttgcaatccaatgctgagtatcaactcattgatcgcattcatgaggcaaaaggcaatgtggattatatcattatcaatcctgccgcgtttacgcataccagcgtagcaatgcgtgatgctctgttagcggtgaacattccatttattgaagttcacctgtcaaatgtgcacagccgcgagccttttcgccatcactcctatttttctgatgtctctgctggcgtcatttgtgggcttggcgctgacggttactcgtgggcattacaaacggcagtgaagcgcctgtctcatactaattaatcaaactgagtacggaaccccattcatggatattcgtaaaattaaaaaactgatcgaactggttgaagaatctggcatttctgagctggagatctccgaaggcgaagagtctgttcgtatcagtcgtgcacctgcaaatactggttatccgatgatgcaacaggcttatgctgtgcccatcgctcagcagcctgctctggcgaatgccgtcgcacctgttgccgccgtcgcagaagccgcgcctgctgaaatcagtggtcacatcgtacgttcacctatggtagggaccttctatcgcacaccaagcccggatgcgaaagcatttgtggaagtgggccagaaagtcaatgcaggtgacacgctgtgcattgttgaagccatgaaaatgatgaaccagattgaagccgataaatctggcgtagttaaagccattctggtggaaagtggtcagccggtagaatttgacgagccacttgttgtcatcgaataacggggcgaaccatgctggataaaattgttattgctaaccgcggtgagattgcgctgcgcattctgcgtgcctgtaaagaactgggcattaagactgttgcggttcactcaagcgcggatcgtgaccttaagcacgtgctgctggcagacgaaacggtttgcatcggcccggcgcagtcggtcaaaagttaccttaatatcccggcgctgatttctgccgccgagatcaccggcgcggtggcgattcaccccggttacggcttcctttctgagaatgccgatttcgccgagcaggttgaacgctctggctttatctttgttggtccaaaagccgacaccattcgcctgatgggcgataaagtgtccgcgattacggcgatgaagaaagccggtgtgcctaccgttcccggctccgatggctcactgaccgatgacatggaaaagaaccgtgccttcgccaagcgcatcggctatccggtcatcatcaaagcctctggcggcggcggtggtcgcggcatgcgcgttgtgcgcagcgataaagatctggaacagtccatcaacatgacgaaagcggaagccaaagcggctttcaacaacgacatggtttacatggaaaagtatctggagaatcctcgccacattgagattcaggtactggcagacggtcagggcaatgccatctatctgggcgaacgtgactgttcgatgcagcgtcgtcaccagaaagtggtggaagaagcgccagcaccgggcatcacgccagaattacgtgaatttatcggtgagcgttgtacccgcgcctgtattgatatcggctatcgcggtgcaggtacctttgagttcctgtacgaaaacggcgagttctatttcattgaaatgaacacccgtattcaggttgagcatccggttaccgagatgatcacgggcgttgacctgatcaaagagcagttgcgcattgctgcgggtcaaccgctgtcgattaaacaggaagacgtggtcattcgtggtcatgcggtcgagtgccgtatcaacgcagaagatccggtgagcttcctgccaagtcctggtaaaattacccgctttcatgcgccgggtggttttggcgtacgttgggagtcccatatttatgccggctacagcgtgccgccttattatgactccatgatcggcaagttaatcacctacggtgaaacccgtgatatcgccattgcacgtatgaaaaatgccctggcggagctgattatcgacgggattaaaaccaacatcgaactgcagatgcgaatcatgtccgatgaaaacttccagcagggtggaaccaatatccactatctggagaaaaagctcggcctgcacgagaagtaatcgcaacgctgagtcagtttgaggccggatattccggcctttttcttttcccgcaggcgttaaggtcacactatggacgcgcgttatttacaggctcacaaagaagctcgctggtcactctatctgacactggcatggttagccgtctggggcggttcggcctggttagggggaaatgcgatgggcataacgggcttgccgcgctggtttgagctctcctgtatttttgctcctctgctgttcatttttttatgctggatgatggtgcgtaaggtcttccggaatatgtcgctggaggatgacaatgaacactgaaatcattcttccgctactggcttatttggccgtcattgctggcttgtccgtgtttgcgatgcgcaaacaacgcaaaggcaactttctgaccgagtatttcctgggcagccgctcaatgggcggatttgtcctggcaatgaccatcacgaccacctatatcagcgccagctcgtttataggcggcccgggtgcggcctataaatacggtttgggctgggtgttgctggcaatggtgcaggttcccgctgtctggctgtcgttgggcgtactgggtaaaaagtttgccattctggcgcgcaagcacaatgcggtaacactcaacgatatgctatacgcacgctatggcagcacactgctggtctggttagccagcctgagcctactgattgcctttgtgggcgcgatggccgtgcagtttattggtggcgcacgtctgctggaaaccgctgccggcatcccttacgacaccggactgcttatttttggtggcactatcgcactctataccgcctttggcggcttccgtgccagtgtcctcaatgatgcgatgcagggcattgtgatgctgataggcaccttcttactgctgtttgccgtcattcatcacgctggcggtattcattcggccgtagacaagctgcacgcgatcgaccccaaactgctgtctcctgagggcccgggcgatattattacgccgaccttcctgagctcgtttattgtgctggtctgctttggcgtcatcggcctgccccatacggcggtgcgctgtatctcttataaggacagtaaagcgctgcatcgggccattattcttggcaccattgttgttgtgctcctgatgctggggatgcacctggctggcgcactcggtcgggcgatattaccgaatctgaccgtgccggacagcgtcatccccacactgatgatcaccgtgttaccgcctctggctgcagggctgtttttagcggcaccgatggcggcgattatgtccaccatcaacgcccagctgttgcaggcctccgctacgctggtcaaagacctgtatctgcgcatcgccccgcagcaaagtgataatgagccacgcctgcggattttatcgggaacggtgacctttttgctcgggatcatactgcttttcgtcgcctggcatccgccagacatgattatctggctcaacctgctggcttttggcggtctggaagcggttttcctctggccactggttctgggtttatattgggcgcgcgccaatgcggtcggtgcgctcagcggcatggtggtgggcggaggctgctatgccgttctggcgaccctgggtctgcaactgtggggttttcatcccattgtgccttcattattgttaagtctgctggcgttcctggtcggcaacctgtttgggcgtttaccgcatgcggtcagcgcaccacaacactgaattaagagagacgttatgccgtggattcaaatcaaaattaacagttctggcgcaaacgctgaagaactaagcgatgcgttaatggaaacaggtgccgtatctgtcaccttccaggatacgcacgatacaccggtctatgaacctatgccgggcgaaacccgcctgtggggcgataccgacgttatcgggttattcgacgcggaaagcgacatggagggcgtaattgctgaactttctcagcatcctcttcttggtgagaatttccgtcacaagatcgaacagatcgaggacaaagactgggaacgtgagtggatggcaaacttccatcctatgcgttttggtgagcgcctgtggatctgcccgagctggcgcgatgtgcccgatccggatgccgtcaatgtgatgctcgatcccggacttgctttcggtaccggtactcaccctaccacctcgctttgcctgacctggctcgatggtctggatctggccggtaaaaccgtgatcgattttggctgcggttcaggaatacttgcgatcgcggcgcttaagctcggcgcggcgcaggcgatcggtattgatatcgatcctcaggcgatccaggccagccgtgacaatgcagagcgtaatggcgttgccgatcgtttaacgctgttcctgccgcaccagcagccggaaaaccttcaggccgatgttgtggtggctaatattcttgccggcccgctacgtgaattggcaccgcttatcagcgtgctgcctaaatcgggcgggcatcttggtttatccggcgtgctggagagccaggccgagagcgtctgtgaagcctacgtggcgcactttgcactcgatcctgttgcggtcaaagaagagtggtgtcgtattacgggcgtcaaaaccgcctagtctttaagacgttgcccgtcacagaagcagtcctgccagttcgacaggactgcctgaatgcctgtgccgtcggttccgcgtttcgcttacaaccgttaccgacagcaccgaaggctgtaacactcagcagcacagcttttgccgtcgcttaagccgttgcttgtatcgttaatcacggtatgtgacgttttttatctggcaaatgccgaatcttcgtcggaaaaacctttgttcacaaaataaacacaaatgtttaagctactgatttatatataaattaattcatatgtccgcgataagatgagggcgaaagccgttttcttatgaattgttcaaagtttggcctttcatcttcctaaaaaaatgcgtaatatacgccgccttgcagatacagtatggcattacgacttcatgcgcattggaaacctccaactgagaaatcgactgattgcagcgccgatggccggtattactgacaggcctttcagaacgctttgtcacgagatgggtgcaggaatggcggtttctgagatgttgtcatcgaatcccgaagtctgggccagtgacaaatctcgtttacgcatggtgcacagtgatgaacccggcattcgtgccgtccagattgcagggtgcgatcccagtgagatggcccaggctgcgcgtattaatgtcgatgctggtgcacaggttattgatattaatatgggttgcccggcaaaaaaggtgaaccgcaaaatggcgggttccgccttattgcagtatcccacagtagtggagtctattctctctgccgtggtgaatgccgttgatgttccggtaacattaaaaattcgtaccggatgggatccagaaaacagaaactgtgtcgcgattgcccaattggctgaacgctgtggcattcaggctttgacgatacatggccgcactcgtgcctgcctgttcaacggagacgctgaatacgacagtattcggacagttaagcagagtgtttctattccgattatcgcgaatggagacataactgacccgcataaagccagagcagtgctcgactacaccggagccgatgctctgatgataggacgcgctgctcagggaagaccgtggatcttccgggaaatccagcattatctggacactggggagctgcttgccccgctgccactggcagaggtcaagcgtttgcttgtttcgcatatacgtgagctgcacgacttttacggttcaggcaagggataccgtatagcgcgaaagcacgtctcctggtatctccaggaacatgccccaaatgaccagtttcggcgcacattcaacgccattgaggatgccagcgaacagctggaggcgttggaggcatacttcgaaaatcttgcgtaacgaaataaagagctgaaagaactatgttcgaacaacgcgtaaattctgacgtactgaccgtttctaccgttaactcacaggatcaggtaactcaaaaacctttgcgtgattcggttaaacaggcactgaagaactattttgctcaactgaatggtcaggatgtgagtgacctgtatgagctggttttggctgaagtcgagcagcctctgttggacatggtgatgcagtatacccgtggcaaccagacccgtgctgccctgatgatgggtatcaaccgcggtacgctgcgtaagaaactgaaaaaatacggcatgaactgattcagttcagaccgttaatctcgccagcctcagggctggcgtttttatttgtgcgctaacgcgcaaatttttttaaatcctgtgaaacagttgcgtcaaatatggtaactgtagttgcagtcgccagcgtgatttttacaggccgtcctttttaaaccgtctcccgctacacgctcatctttttctgatcgcctgcctttcaaccctgtcataacagccttttgtgagcctgattaacattttacgcaacacctcaatcgcttacagccaccacctgccatgcagctcacaatgttgctaaatagtgaaacaatttgcactaaatgtgatcccttcgactcgaaatgcttccttttggtgcgtcatattattgcagccctccagatgattcagattattacccgatctttcaggtgacttcaggattatgcaaacctggcactggctttgcaaagtcgtggatggccgatcgccacagacaggaacgcacatcaaagtgcgcaatacataacaacacaacacgacatgccacacaggatgctttatgaaaaagatgatgctctctactctggttgctgcggcttctctgcttgccgttgctcagcaggctcatgcaggtaccacacttgatgcgattaaaaagaaagggttcgttcaatgtggtatcagcgatggcctgccgggtttctcttatgcagatgccagcggcaaatttaccggccttgatgtggatatctgtcgtgcagccgccgccgccgtgtttggtgacgcaacaaaagtgaaatataccccgctgaccgcaaaagaacgttttaccgctttgcagtcaggggaagtcgatattctttctcgtaacaccacctggacttcatcacgtgacggcggcatgggcttcatgtttaccggcgttaactactatgatggcattggcttcctgacccataagaaagccggcctgaagagtgcgaaagagctggatggtgcgaccgtctgtattcaggctggtactgataccgagctgaatgtggctgacttcttcaaagccaacaaaatgcagtacacgccggtcacctttgaccgctcggatgaatccgccaaagcactggatagtggccgctgcgatacgctggcatctgaccagtctcagctgtacgccctacgcattaaattaggtaaaccagatgacttcatcgtcttacctgaagtgatctctaaagagccactgggcccggttgtgcgtcgcggtgatgatgactggttcaccatcgttaaatggtcgcttttcgccatgctgaacgcagaagagatgggcatcagctctaaaaacgttgatgagatgacggctaaacctaccacacctgatatggcgcacctgcttggcgctgaaggcgactttggcaaagatttgaagctggataacaaatgggcttacaacatcattaaacaggttggtaactatcaggaaagttttgatcgtaacgtcggtaaagacagcccgctgaaaattgcccgtggtcagaatgcgctctggaacaaaggcggcattcagtacgcaccaccggtacgttaatcacgcctcacccgtcgggcaccgttttctacggtgccccagcaaagctttcgttactgaggtctaaacatgtcacaacgcccaaccgtgaaaagggatttttcgttcggtaatcccacggttcgagcctggctttaccagatagttgcgatcattaccgtacttgctgtggtgggctatctcatccacaacaccgttatcaatctcgctaatcgcggtattacttccggctttggttttctggaacgcaatgctggtttcggcattgtgcagcatcttattgattacactgaaggtgacacctacgcacgcgtctttttggtgggcctgactaacacgttactggtgtcggcactctgtattgtttttgcttcaatactgggtttttttattggtctggcgcgtctttccgataactggttactgcgtaaaatcgccaatatctacattgaaacctttcgcaatattccccctttgctgcagattttcttttggtactttgcggtattacgtaatctgcccggtccacgtcaggcgcttaacgcttttgatctcgcctttgtcagtaaccgcggtctgtacgtaccctggccgacctatgcgccgggcagctggccttttgttattgcccttgcactggctgttgtagcgatttacggcctgttccgttttaatcgtcagcatcagcttaaaaccggtcaattacgtcgcacctggcctgccgccattgcgatgttattggtgttccctttcattgcgcatctgggctttggcgcagcgatgcactgggatatacctgagttacgcggttttaacttcaggggcggctttgtcatgattcctgaactggccgcccttacgttggcgctgtcgatctatacctcctcttttattgcggaagtgattcgctcaggtatccaggccgtgccctatgggcagcatgaagcggcccgctcgctggggctgccgaatcccgttacgctgcgtcaggtcattatcccgcaggccatgcgcgtaattattccgccccttaccagccagtatctgaatattgtgaagaactcttcactggctgctgcaattggttatcccgatatggtgtcgttgtttgccggcacggtccttaatcagaccggacaagccattgagaccattgctatcaccatgagcgtttacctgattatcagcctgctgatttcaatgttgatgaacttctacaaccgcaaaatcgcgctggttgagcgttaagagaacgggataattatgtctgtcactgcacatgaaacaccgctgatagcctcctcgccgttgaatcgggcatggcgatgggcacgcaagaacctgttttcaggttggtttaataccttattgaccctgttctgtatctggcttatctggcatgtgattccacctgctctgaactggctgatctttgatgcgaactggtttggcacaacacgggctgactgcaccaaagagggcgcatgttgggtcttcattcatgcccgcttcggtcagtttatgtatgggctctatcctcatgaactgcgctggcgcatcaatctggcgctgatcattgggctcgcgtctatcgttccgatgtttgttaaacgtctgccttaccgtgggcgctatattgccgcctgggcagtatgttatcccctcgttgtctggtttctgttgtatggcggcttcttaggactcgaccgggtcgaaacccgtcaatggggtgggctcacgctgacgttaatcatcgcgtctgttggtatcgcgggggcattacctctgggtattttgctggcgctggggcgacgctcccggatgccggtggtacgaacgctgtcagtgatttttattgagttctggcgtggcgtgccgctgataacggtgctgttcatgtcatcggttatgttgccactgtttatggcagaagggacgaccatcgacaaactggtgcgcgcattggttggcgtcattttgttccagtcggcttatgtggccgaagtagtacgtggtgggttacaggcgttaccaaaagggcagtttgaagccgctgaatcattggcgttgggatactggaagacccagatgctggtcatcctgccgcaggcattaaagctgactattccgggactggtgaataccattattgcgttattcaaagataccagcctggtgatcattattggtttgttcgatctgtttagtagcgtgcaacaggctaccgtcgatcccgcctggttaggcatgtctactgaaggctatgtctttgccgcgctggtctactggattttctgttttagcatgtcgcgttacagccagtatctggaaaaacgttttcacaccgggcgcaaatcgcactgaggtttctatgacacaaataataactgattcaaccaatgcgatgatttcgcttgaaaatgtgaacaagtggtacgggcaatttcacgtgctgaaagatattaatctgcaggtgaaacctcgtgaacgtatcgtgttgtgtggtccctctggttcaggtaaatccaccacgattcgctgcatcaatcatcttgaagagcatcagaagggccgtattgttgtagatggtattcatttgaatgaggatgtgcgcaatatcgagcgagttcgtactgaggtcggtatggtgtttcaacacttcaatcttttccctcatcttaccgttttacaaaactgtacgctggcaccgatgtgggttcgtaagattgccaaaaaagaggctgaagagcttgctatgcattacctgaagcgggtgcgtattgaagagcatgcgcataagtttccaggtcaactgtctgggggacagcagcagcgtgtcgctatcgcacgttcgttatgtatgaaacccaagatcatgttgtttgacgagccgacatctgccctggatccagagatggtaaaagaagtactcgatacgatgattgggctggcagaagacggtatgacgatgttgtgtgtgacacatgaaatgggctttgcgcgtacggtggccgacagagtgatctttatggatcgcggtgagatcgtagaagttgcgccgccgcaggagttttttgcgaatccccggtcagaacgcacccgcgctttcctgtctcaggttattcactgaccctgctccatctctcagcacctccgtcatacggaggtgctgttctgccgcgcctgacaactgcatacagcgcgtctattccccgtatattctcacttcgctaacgctgattacacaacgcttcaactgacagagttgcctgtccgcaatcatacttcattgcgccagcagtccttcttcttgccggttacatggcttttattggccattttacgggtcaggggagagccacccggccgttttaagtacatcatcagtgcctgtggcgacccatatacgtttaacagagactttttaccgaataacagacgtaaaaaagccctgaactttcgttcagggcttttttgtttgatgcctggcagttccctactctcgcatggggagaccccacactaccatcggcgctacggcgtttcacttctgagttcggcatggggtcaggtgggaccaccgcgctacagccgccaggcaaattctttatttgccgaactctagccatatataactggtgctgatacccagagtcgaactggggacctcacccttaccaagggtgcgctctaccaactgagccatatcagcacgcaacaggtactcccggcacttttatgctgatgctcgggtctttcaatttgatgccttgcagttgatgaatcacgcggtgattcacccttcgggccgctgctctgcagcgttcaaaagcattcgcttttgtcctactctctttgagtagagaactgcccgaagtaacgtgcaggttttcaatttgatgcctggcagttccctactctcgcatggggagaccccacactaccatcggcgctacggcgtttcacttctgagttcggcatggggtcaggtgggaccaccgcgctacagccgccaggcaaattctttatttgccgaactctagccatatataactggtgctgatacccagagtcgaactggggacctcacccttaccaagggtgcgctctaccaactgagccatatcagcacgcaacaggtactcccggcacttttatgctgatgctcgggtctttcaatttgatgccttgcagttgatgaatcacgcggtgattcacccttcgggccgctgctctgcagcgttcaaaagcattcgcttttgtcctactctctttgagtagagaactgcccgaagtaacgtgcaggttttcaatttgatgcctggcagttccctactctcgcatggggagaccccacactaccatcggcgctacggcgtttcacttctgagttcggcatggggtcaggtgggaccaccgcgctacagccgccaggcaaattctttatttgccgaactctagccatatataactggtgctgatacccagagtcgaactggggacctcacccttaccaagggtgcgctctaccaactgagccatatcagcacgcaacaggtactcccggcacttttatgctgatgctcgggtctttcaatttgatgccttgcagttgatgaatcacgcggtgattcacccttcgggccgctgctctgcagcgttcaaaagcattcgcttttgtcctactctctttgagtagagaactgcccgaagtaacgtgcaggttttcaatttgatgcctggcagttccctactctcgcatggggagaccccacactaccatcggcgctacggcgtttcacttctgagttcggcatggggtcaggtgggaccaccgcgctacagccgccaggcaaattctttgt

SEQ ID NO: 14 - DNA, 4477201 bp, Pantoea sp. OXWO6B1 (residues 1-1,492,401 of 4,477,201)
ctcgccttaggggtcgactcaccctgctccgattaacgttgaacaggaacccttggtcttccggcgacaaggtttttcaccttgtttatcgttacttatgtcagcattcgcacttctgatacctccagcatgcctcacagcacaccttcaacggcttacagaacgctcccctacccaacaacacatagtgtcgctgccgcagcttcggtgcatggtttagccccgttacatcttccgcgcaggccgactcgaccagtgagctattacgctttctttaaatgatggctgcttctaagccaacatcctggctgtctgtgccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagccgggatggccccctagccgaaacagtgctctacccccggagatgagttcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccagttaagactcggtttccctgcggctcccctatacggttaaccttgctacagaatataagtcgctgacccattatacaaaaggtacgcagtcacccccataaagaaggctcccactgcttgtacgtacacggtttcaggttctgtttcactcccctcgccggggttcttttcgcctttccctcacggtactggttcactatcggtcagtcaggagtatttagccttggaggatggtccccccatattcagacaggataccacgtgtcccgccttactcatcgaactcacagcctgtgcacctttgtgtacgggagtatcaccctgtaccctgcgactttccagacgcttccactgatgcacaagctgatgatggttctgggctcctccccgttcgctcgccgctactgggggaatctcggttgatttcttttcctcggggtacttagatgtttcagttcccccggttcgcctcatgcagctatgtattcactgcatgatagtgtgacgagtcacactgggtttccccattcgggtatcgccggttattgcggttcatatcaccttaccggcgcttatcgcagattagcacgcccttcatcgcctctgactgccagggcatccaccgtgtacgcttagtcgcttaacctcacaacccacaggcgtttatctgtattaccgtaacggctgcgcgtaaagaatgcgtcgttgcgcggtgctcgccatgctcacgtacttcagtacgctccgctggctgcgcgccgacgcgtcttgctttcttcactgctcgcgcgctactgcataacagttagcttgtaagctgtaagcttttgagagactcgaacgcgttgtgctgtgttccttattacggaggaacacgacaatgcgtcgtttcaaattttcagcttgttccggattgttaaagagcaacatcttaaacatgactcgtaagtcatctttaagatatgtgggcaacacctttcacctgtcaccaagcaagtggcgtcccctaggggattcgaacccctgttaccgccgtgaaagggcggtgtcctgggcctctagacgaaggggacgtgaaatacttgtgcaacagacacgggtaatttcacgtgaaggtgagattatataatcaggcgacaatagttattgttaccgcaccccaacgcgtagacgctttgctcattacttttctatcagacaatctgtgtgagcacttcgcgggaaggtatcttcaggtaaggaggtgatccaaccgcaggttcccctacggttaccttgttacgacttcaccccagtcatgaatcacaaagtggtaagcgccctcccggaggttaagctacctacttcttttgcaacccactcccatggtgtgacgggcggtgtgtacaaggcccgggaacgtattcaccgtggcattctgatccacgattactagcgattccgacttcacggagtcgagttgcagactccgatccggactacgacgcactttgtgaggtccgcttgctctcgcgaggtcgcttctctttgtatgcgccattgtagcacgtgtgtagccctactcgtaagggccatgatgacttgacgtcatccccaccttcctccggtttatcaccggcagtctcctttgagttcccgaccgaatcgctggcaacaaaggataagggttgcgctcgttgcgggacttaacccaacatttcacaacacgagctgacgacagccatgcagcacctgtctcacggttcccgaaggcactaaggcatctctgccgaattccgtggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccactcctcaagggaacaacctccaagtcgacatcgtttacggcgtggactaccagggtatctaatcctgtttgctccccacgctttcgcacctgagcgtcagtcttcgtccagggggccgccttcgccaccggtattcctccagatctctacgcatttcaccgctacacctggaattctacccccctctacgagactcaagcctgccagtttcaaatgcagttcccaggttaagcccggggatttcacatctgacttaacagaccgcctgcgtgcgctttacgcccagtaattccgattaacgcttgcaccctccgtattaccgcggctgctggcacggagttagccggtgcttcttctgcgggtaacgtcaatcactgcggttattaaccacaatgccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgggccgttaccccgcctactagctaatcccatctgggttcatccgatagtgagaggcccgaaggtccccctctttggtcttgcgacgttatgcggtattagccaccgtttccagtggttatccccctctatcgggcagatccccagacattactcacccgtccgccactcgtcacccgagagcaagctctctgtgctaccgtccgacttgcatgtgttaggcctgccgccagcgttcaatctgagccatgatcaaactcttcaatttaagtttgatttgctgaaaccagttcagcggtgctcatctgtaaaacgtcataatgaatttcattatgtgttcactcgtgagacttgatattttttacgtccggagacgctgatatcaatcctgcgagtgcccacacagattgtctgataaattgttaaagagcagtgcgaacagcgggttaaccgtctgtcgcgaggtggcgtatattacgctttcctccttcagagtcaacctctttttcagaagtttttctccggcggttcagtttcctgaacctcccgacaccgcattccgtaagccgttgtgccgtgtcagtggaggcgcattatagggatccgaataaattgcacaaccctttttttggatcttttttctgactgtcgagaaaacattcatattggttagatcgccaacgatccggggcaaaatccccttgccagcaggtcagaatcacagcaggctgccggtaaactcagtaaaggagaatacaatgactgtagcgttacgcccttataaacatcttttcccgcagttgggtctgcgcgtcatggttgattccacaagcgtggtggtgggcgacgtcattatcgaagatgatgtaggtatctggcctttagtggctattcgtggtgatgtgaatcaggttcgcatcggtgcccgtaccaatattcaggatggcagcgtacttcatgtaacccataagtctgatgccaatccagcaggtttcccactggttatcggtcaggatgttaccgttgggcataaggcgatgctgcatggctgcaccatcggtaatcgcgtgctggttgggatgggttcaatcgtgctggatggcgtgattgttgaagatgatgttctgattggtgccgggagtctggtcccgccgggtaagagactggaaagcggttatctttatgtaggcagcccggtaaaacaaattcgaccgctgaatgaaaaagaaattgaaggattgctctactctgcccgcaactatgttagctggaagaacgactatctggcaggcgacagccagacccatccttcattatctacctgatcgttacggatacagtcttcagccacatcttccagatcccagcgatggtcacgaaacagggccatcgtgtctccctccccgaactgttggtgtaacgcatccacgctgatagcacaggtcagtcccatgccattaaccaaaacgggaaaacaaacagcctttaatgtgacatccagcgtttcacggtctggaaactggatagcctgattcatgactgtatctcggcttttaaggacgcaatgacaggcgcaatctccggcatgatgccatgccacagatgaaaggcatgcgcggcctgacccaccagcatgcctaacccatcagccagatgagatgaaccctgctggtgacaccagcccaaaaaagcggtcaatccattctggtagaacatgtcataacagcgtaaatccgcatgaattaatgaagacgataacggtggcacatcgccattgatgccgctcgacgttgcgttaatcagcaaatcaaaatgtttaccttcaagctcctcaaaagaaagggcactcaccgccccacggtgcgcaaacgtctttgccatgctctgggcattagcagccgtacggtttaccagcgtaattgacgtgcccagcgaaagcagaggaaggatgacgccacgcgccgcacctcccgcccccaccagcaaaatatgatcgccaggtttgatcatcgacagacgctgcagatcgctgactaaaccgatgccatccgtattatcgccaagaatctgaccatcctggcatttcttcaacgtgttgacggcaccagagagagaggcacgttcggtgagctggtctgcatatccccaggcctgttgtttaaaaggtaacgtgatattggcgcctgccccaccctgagagaaaaaagtggtgatagcctggggaaaggcatcgacaggcgcttcaatacgatcgtattgaagcgtaatacccgtttgcctggcaaaggcctgatgaatttgcggggatttgctgtgactgatcggatgtccgaaaactgcaaaatatgccatctgctagccctgccgtatctggttgccgctaatcacgtcacggatctcagaagggtttagccttcctcccgtctctccattgagtacgggaaacgcagcaccaaactgcagtttaacctcttctactgaacggcaaggtggctgaccagaaagattcgcgctggttgaaaccagaggtttaccaaacgcccggcacaacgcctgaacgtcaggatggtcgctgacgcgaatagccagggaatcaaactgtccggttaaccaacgtggcgtttgcggtgctgctggcacaacaaaggtgaccgggcctggccagcaggcaaacatacgttcacgctgcatcgccgttaagacatgatcggagacgtagggcataagctggccgtaatcggccgctatcagaatcaaccctttttccactgggcgtcttttcaatgccagcagagccatcactgccgattcatcgtcggggtcgcagcccaggccgaataccgcttcagtgggataagcaatcacggcatgttgcttcagatggttcacacaatcctgtagtgagccggaaactggttgattttgcatggttatgtcttacgtctcttcagtgataactttgccacaacttttactggcgcaaaaaagccgggtgccctgcgccgtctttttttcaactaaaagcggaaattcacaatgtggacagcgtccagcgactggcgtcagattaacggtaaactggcaggctggatagcggtcacaggaatggaaggttttgccaaaacgcgatcgccgctgtaccagtttaccttgctgacactgcgggcagtcgatggttgtctcatcaggtttatcgatcgtttccgtgtaatcacacgctggatagtcgctacagccaataaacatgccaaaacggccctgacgtaacactttatcagcaccacattgcgggcaagcatgaccttccagaacttttactacatgtccgtcggcctggtttcccaggggccggatgtagtcgcaggcagggtagtttgcacagcccaaaaaagggccgtgttttcctgaacgtataacaagttctgccccgcaagcggggcaggggtcctgtttacgcgcagtaaagagtgcggttttactcataacgataatgcatcagtgaaaatttaatgcagcataccttcgttgacgtcgaataacagttcttccatctgttgataggcgttttcacatcctgggatgttaaacaacaccatcaacaccacccatttaagatcctcaagatcgaaatcaagagtatcaagcgccatgacacgttcaatgaccatttctcgtgtttccagactcaagacctggatttgctccaggaaaagcaggaaaccgcggctttcggcatctaaacgcttgctctcttcatctgtatagatgcgcatggagagcggatcatttgccagtaaaattggggcgaccagaccttcctggtagtctgccaatttttctaaccagttcaacgcgttatagatatcttcgcgatgaaaaccggcatccgtcaagtcatctgtcaatctgtcctgatcaacacccatttctgcttcgttgtggatataggtctcaaacaagtacatgagtacgtcgaacatggcatgccctcctcaatcggacatagccgccgggtacagctgcgatccatcctgctaactccagttccagcaattgagctgtaataactggcacaggttggccggcacgttcagcgacaacgtcaacaggtgtaacctcatcacctacgttagccaacagctcggcaaatggcaatggagcatcgtcactggcatcagaataaatttcgtctgattgtgtaacaggtaaccagttaagcatagcgcgtaaatcttcaatgatgttattaggatgtgccaccagcatcgcgccctgttgaatcagccagtttgttccctcactgccgctgtttcctaatgcgccgggcaaggcataaaccgcgcgattttgctctaatgcataacgggctgtgactaatgaaccactctttaatgacgcttctatgactaaaacgccctggctcagcccactgataatacggtttctgcgtggaaaacgatgtgccagcggtacggcatccagcggaaactcagataccacggcgccgccctgcccgacaatctcctgcgccaatgcaccatgctttttgggataaagatgctccagtccgctgcccagcaccgcaacggttttcccctgaaccctcagcgcggcgcgatgcgcaacgccatcgataccaagcgccaggccgctggtgatagtaaagccacttagcgataactgttgagtaaaccagtcacaccagtagcggccagagtgggaacattgacggctgccgaccaccgctaactgcggtgcccccaacacggcggggtcgcctttcacatacagcagcggaggaaaacaggccgtttcagccagttgagcgggataaagcggatcaagtgcggtaatcagatggtgcaacgggttcgttgccagccacgtcttaactgtcgccagccaacggggggagatatgatggtaatagtggcgttgtgaagcctcaaacccgttcagagttaacacatcatcaacatctttgtcttcagacagttgctgtgccgcgcttaaccagcgcctgcccgttatgcccggaatggcggccagccgcagtaacggctcccttttttgcatctttacagcctcctgataaccgttgcttccctccgcagaatgctgtcaatcaggtgctaaaaagtctacaatatggggcagtaatctttcccttttagaatatatatctggatatttatgtcagttttacaggtattacattttcctgacgagcgcctgcgcaaaattgccgcgcctgttaaagaagttaacgcggacgttcagcgtatcgttgatgatatgttcgaaaccatgtattccgaagaaggtatcggcctggctgccacgcaggtggacattcaccagcgcatcattgtgattgatgtatcagagaaccgcgatgagcgtctggtattaattaatcctgagcttctggaaaaaagcggtgaaacaggtattgaagaaggctgtctgtccattcctgagcaacgcgcttttgtgccacgtgctgagcgagtaaaagtccgtgcgttagatcgtgacggtaaaagtttcgaacttgaaaccggtgatctgctggctatctgtattcaacacgaaatcgaccatctcgatggcaaactgtttattgattatctttcgcctttaaagcgtcagcgcatcaaaactaagttagaaaaactggcgcgacaaaacgcccaggcttcctgagatctgaaaaagggataaacgtgtctgctccgcttaaaattatttttgctggcacgccagactttgcagcgcgtcaccttgacgcgctgcttgcttctgagcatcaggtggttggcgtctttacccaaccggatcgtcccgcaggtcgtggcaataagttgaccgccggcccggttaaatccttagccctggcccaaaacattccggtatttcaacccaaatccttgcgccctgcagaaaaccaacagctgattgcagatttgcaggctgacgtaatggtggtggtcgcttatgggctcattctgccaaaagccgtgcttgatatgccccgactgggctgtatcaacgtacacggttccctgctgccacgctggcgtggcgccgcgcccattcagcgcgcgctctgggcgggcgacagtgaaaccggtgtgaccatcatgcagatggatgttgggctggataccggtgatatgctattgaaactggcctgtccaattagcgcggaagataccagtgccacgctttatgacaagctggcagatctgggcccggcaggactgctgacaaccttagctcagttacgtgatggtcaagcgcaggccattcagcaagacgaaagccaggccaactatgcggagaagctcagtaaagaggaagcgcgccttaactggacgctgtcggccgaacagctggaacgctgcatccgtgccttcaatccctggccgataagcttttttatggtgaatgatcagccggttaaagtctggcaagcctgcgtcttacctcatgtgaacaaacagccaggagagattatccaggctgacaaacaaggcattcaaattgccactgccgacggcgtgctgaatttgcttcagcttcaacccgccggtaaaaaaccgatgtcggcacaggatctgcttaactcgcgccgagaatggtttgaagccggcactcttctggactgaccctcaggcccggcaaaaaccgggccatttgcttgatggcactatcttatgactaaaccaaccaatcttcgtagcctgtctgctcaactgatcgagcgcgttgtcgataaaggcgagtccctgaataccgtcttgcctgcggcacagaaaaagctctcagacaaagatgccgcgctggtccaggagatctgctttggtgtgttgcgcaccttaccgcagctggaagcgcttatcggcaaattgatggaacgcccgttaacgggtaagcagcgtacactgcacttcctgattatggtgggcttatatcagctgctctatacacgtgcacctgctcatgcggcattagatgagacagttgccggtgctgaagtgctgaaacgagcaaacctgaaagggttaattaatggcgtattacgtcagttccagcgtcgtcaggaagaactgcttgccagtattcaggatggcccacagcgtcacctgcatccgggctggttactgaaccggcttcaacaggcctggccagcgcactggcagcaaattgttgaggcgaacaaccagcgtccgccaatgtggttaagggttaaccgtcagcaccattcgcgtgacagctggctggccctgctgacggcggatgaaaggaacgcagctgttgctgacgatgtgcctgaagctttgcgtcttgaatcgccggcatccgttaatgtgttacccggctttgaacaaggctggattaccgtacaggatctctccgcccagcgttgtgcgcttctgcttgagcccaaaaacggtgagcaaattctggatctctgcgcggcgccgggaggtaaaacgacccatatactcgaaatcgcccctgaggctcaggtgcttgctgtcgatgttgacgcgcagcgcctgaagcgcgtgcatgaaaatctgggccgtcttggtatgaccgcagaagtgaaacagggagatggacgtaccccgcagcaatggtgtgaccaacgtcagtttgatcgcatactgctggatgcgccctgctcagcaactggcgttatccgtcgtcatcctgatatcaagtggttacgtcgcgatcgtgatattactgagctggcagccttacagcgtgacattctggatgcgacatggccactgcttaaaccgggcggtacgatgatctatgcaacctgctctgtgctgccagatgagaatcagcagcaaatcagcgactttgtacagcgccacgcggatgctcaggctgtgtcgctgtctggtgctccccttaacggctggcaggtctttcctgaagcagaaggcggagacggttttttctacgctaagcttgtgaagctcgcgagtccacactgagaaggcattgaaaagcgatgaaaatcataattcttggtgccggtcaggtcggcggtaccctggctgaaaacctggttggcgaaaacaacgacattaccgttgtcgacacggactccacgcgtttacgccaactgcaggataagtttgatttacgcgttgtacagggtcatggttctcatccgcgtattttacgcgaagccggtgcagaagatgccgatatgctggtcgccgtcaccagttctgatgaaaccaatatgattgcctgtcagatcgcctattcgcttttcaatacaccgaatcgcattgcccgtattcgtgcggcagactatttgcgtgatgccgataagctttttatccccgaggctgtgcccattgatcatttgatttcgcctgagcaactggttatcgacaatatttatcgtctgattcagtatcctggtgcgctgcaggtggtcaactttgccgaaggcaaggtcagtctggccgttgtaaaagcttattacggtggcccgctcgtgggtaatccgctgtcgattctgcgcgaccacatgccgcatattgatacgcgggttgcggctatcttccgacaggatcgtcctatccgcccgcaaggctcgaccattattgaggccggcgatgaagtctttttcattgccgccagccaacatattcgcgcggtaatgagcgaaatgcagcgtctggagaaaccctataagcgcatcatgttagtgggcggcgggaatattggatttggtctggcgcagcaactcgaaaaaaattacagcgtaaaacttattgagcgcaatccgcagcgcgctgccgagctggctgaacagttgcacgatactgtggtgttctatggcgatgcgtccgatcaggaattgctggcagaagaacacattgagcaggtcgatttatttatcgccgttaccaatgatgacgaagccaatattatgtccgccatgctggcgaaaaaaatgggtgccaagaaagcgatggtactgattcaacgacgggcttatgttgatctggttcagggcagcgttatcgatattgccatctcgccacagcaggcgacgatctcggcattgctgggacatgtacgtaaagcggatattgttggcgtctcgtcattacgtcgtggtatcgccgaagccatcgaggcgattgcacatggtgatgaaactacgtcaagagttgtgggccgctccattgatgatatcaagctgccaccgggcacaattattggcgcagtggtccggggggatgatgtgatgatcgcgaatgacaatttgcgcatcgaacagggcgaccacgtggtgatgtttttaaccgataagaaatttgtaccggacgtcgagcgcctgttccagccaagtccgttcttcctgtaataaaaggtcgcgcgttgtctgacataatccggctaattgctcgcagcgatggcaaatatggcaagctttgttaaactttatggcattggctaaggcaaggagagaagtatgagtttattcaaagagtttcgtgattttgcgatgcgcggcaatgttgttgatctggccgtgggtgtcattattggtgcggcatttggtaaaattgtttcatcattagtggcaaatatcatcatgccaccgctgggcttattgatcggcggcgttgatttcaaatcattcggctgggtacttaaacctgctgtgggtgatgcgccagcggttgtaatgcaatacggcatttttctgcagaccgttttcgactttatcatcgttgcgtttgccattttcatggcgattaaactgatgaataaactctaccagaaaaaagaagtcgaaaagcctgcgccgaaaccctctaatgaggaagttctgttaacggaaattcgtgacttgctcaaacagcagaatacaaaaatctaaaacgttaaagccgcagacattgcggcttttttgtcattaaaagcagaagggcagtgataagtcctgcacttatcactgccctcccatccccgaccttttgcatgtttctctttacgtttaaagctgcctttccctttttggttctgttcaacacgctgtctaaataaagggtcgtgcagtagtgcctcaatcgcattatcacgtatttgccctttggtatgacgataacgggacatatctcctccatcagtttaggtgacccgaagatccaactgcgcgaaaccttgccgcagtgaaagaaattatactcgccttgacgccagataaaaatagtcgctattcaaccgtgagcttatgggtaatggccggaccgtattcgccctcaagaaacgctgtgctcatgcccgcctgacgcagtttcactgtcaggtgccgcaatttgcgcgcatgcatttctgctgcaggatcgcccgggtccagttggcgtaaaagatcgtttacttccagcgcttcacgacgtaattcaagctcagggggaagaaaccccgcattcttgagtaaacgatagcccgcgcgtaattcaggtggaacatggctgtcatcgtccaacactaatggcgcaccttctccggcaagattgctgagttcgcctttctcctgcgccgctttaatatgctgttcagccagctgatcgattaaccacattgttagcctcctatgtcacaccacaagcgtagcagagggcaaatagcaggcaataaaaaacccgccgaagcgggtttttcacgttgcaacagattactctgctgcagcctctgcttgagcttctggacgatcaaccagctcgatgtatgccatcggagcgttgtcaccagcgcggaagccacacttcagaatgcgagtgtaaccacctgcacggctcgcgaaacgcgggcctaactcattaaacagttttgccacgatctcgttatcacgagtgcgggcgaatgccagacgacgattagctacgctgtcggtcttggcaagagtaatcagcggctcaactacgcggcgcaactctttggctttcggcagagtcgtcttgatgatctcatgacgaaccagagagccagccatgttgcggaacatagcctgacgatggctgctgttgcggttcagttgacgaccactcttacgatggcgcatgaccttatccttctcagtgaaaccttaacctgtgatcgggttattcatcagcaatgcttgccggtggccagttttccaggcgcatgcccagagacagaccacgtgaggccagcacatctttaatctcggtaagagattttttaccaaggttaggcgttttaagcagctcaacctcggtacgctgtaccagatcaccgatgtagtggatagcttctgccttaaggcagttagcagagcggacagtcaattccagatcgtcaacagggcgcagcaggatcggatcgaattctggtttctcttctttcacttccggctgacgtacatcacgtaagtcaacgaaagcttccagttgttctgccaggatggttgccgcacgacgaatcgcctcttcaggatcgattgtgccgttggtttccatttcgatgaccagcttgtccaggtcggtgcgctgctctacacgcgctgcttcaacattgtaggcgatacggtctacagggctgtagcaagcgtcaactaacagacggccgatcgggcgctcatcttcttccgaatgaattcgggcagaagccggcacataaccacgaccacgctgaactttgatacgcatactaatagatgcgttgtcatcggtcagatggcagatcacatgctgcggcttgacgatttcgacatcaccatcatgggtaatgtcggctgcagtcacagggccaatgccagatttattcaaggtaagaataacttcatctttgccctgaactcttaccgccaaacctttaaggttgagcaggatttccaggatatcttcctgtacaccctctttggtgctgtactcgtgcagtacaccatcaatttcaacctcggtcaccgcgcaacccggcattgatgaaagcagaatacggcgcagcgcgttaccaagagtatggccaaagccacgctctaaaggctcaagggtcaccttggcgtgcgtcgaactcacttgctcgatatctaccaggcgcggttttagaaactctgtcacagaaccctgcattgtgtcctctctttggtactaagctttacttggagtaaagctcgacgatcaggtgttcgttaatgtccgcagacagatcggtacgttcaggaatacgtttgaacacaccttccatcttagttgcatcaacttccagccaggttggcttttcacgctgctcagccagctccagagcggccttcacgcgagattgctttttggctttctcacggatgctaacgacatcattcggagatacctgataagaagcgatgttaacaacgcgaccattgaccagaacagacttatggctcaccaactgacgtgcttccgcacgcgtggcaccaaagcccatacgataaacgacgttgtccagacgaccttccagcagagccaacaggttttcaccggtgttgcctttcagacgtgctgcttctttgtaatagttacggaactgacgctcaagaacaccgtacatacgacgaactttttgcttttcacgtaactggccgccgtagtcagacagacgtggcttacgcgcaccgtgctgaccaggagcttgttcaattttacacttggaatcaatcgcgcgaacgccagacttaaggaataagtcagtgccctcacgacggctcagcttgagcttaggacccaaatatcttgccattttctttctccaactatcctaaaaaacggggcgttatacgcgacgttttttcggcggacgacaaccgttatgagggatcggagtcacatcagtaatattcgtgatgcggaaaccagcggcgttcagtgcacgaattgttgattcgcgacccggacccggacccttaaccataacttccaggttcttaataccgtaatcttttaccgcttctgcacagcgctctgcagcgacctgagcagcaaacggagtggatttacgtgaaccgcggaaaccggaaccaccggcggttgcccaacccagtgcgttaccctgacgatcagtaatggtaacgattgtgttgttaaaagaagcatggacatgagccacgccatctgagacttgttttcttacacgcttacgtgcacgaactggtgcctttgccattatttactcaccccgattatttcttgatcggtttacgcggacccttacgggtacgtgcgttggtcttagtacgctgaccgcgaaccggaagaccacgacgatggcgcaaaccacggtagcaaccaaggtccataagacgcttgatgctcagggtgatttcacggcgcagatcaccttctacaacgaatttagcaactgcatcacgcagctgatcaatttgttcttcagacagctcactgatcttaacattttcagcaatacccgttgaagcgcagatggcttttgagcgagtcttaccaataccgaagatcgaagttaatgcgataacggtatgtttctgatcaggaatgttaatgcctgctatacgggccactatgcactcctactatttaatatgtacgtaccatgccgaaaagcccgttttcaggatactcaaatggaaacgtacagacatacaaaagattggctggctaatctagccagctcaacccgactttgcaagaaaaatatgtgaaaatcagccttggcgctgtttatgctttggctcggcgctacagatcacacgaacgacaccgtcgcgacgaatgattttgcagttacgacataatttcttgacggaagcacgaactttcatttttactctccgtaacttctcaaccacctgaattaacggccgtagcccttcaggttagctttcttcaatgcagactcgtactgacttgacatcatcagagtttgcacttgagccataaagtccatgatgacgaccactacgatgagcagtgatgtaccgccaaagtagaaaggaactttcatcgcatcacgcatgaactccgggataaggcagataaacgtaatatacagggcaccgattaaggttaaccgcgtcattactttatcaatatacttcgccgtttgctctcccggacgaattcccggtacgaatgcaccagacttcttcaggttatctgctgtttcacgcgggttgaaaaccaacgccgtgtagaagaaacagaagaagatgatagcagtcgcatagagtagcacataaagcggctgtcctggctgcaaatacatcgaaattgttgtcagccagttccaaccggtaccgcccccgaaccacgatgcaatcgttgccgggaacagaataatgctggaagcgaagattgccgggataacccctgccatattcactttcaacggtaaatgtgtgctctgtgcagcgtatacacggcgaccttgttgacgtttcgcatagttcaccacaatgcggcgttgaccacgctcaacgaaaataacaaagaaggtcactgcaaatacgagaactgcaaccaacagcaacagaaggaagtgcaggtcaccttgccgcgcttgctcgatggtatggccaatggccggcgggagacccgcaacaatacctgcgaagataatgatcgaaataccgttaccgataccacgttcagtaatctgttcgcccagccacatcaggaacattgtcccggtaaccagactcacaacagcggtaaaatagaatgcaaagcctggattcatcaccaggccctgcataccaggcatattcggtaaaccggtagcaataccgattgactggaatacggccaataccaacgtaccgtaacgggtgtactggctaatcttacgacggccagcctccccttctttcttgatttcagctaacgcaggatgaaccaccgttaacagctggataataatcgatgccgaaatgtacggcatgatacccagagcaaaaatagaagcacggctgagagcaccaccagagaacatgttaaacatttcaatgatggtgccacgctgttgctcaagcagtttggcaagtacagtggcatcaataccagggatcggaatgaaagagccaatacggaagacaatcagtgcaccgataacaaacagaagtctgcgtttcagttcaccaaagccacctttggcactttgaaaatctaatcccggttgtttagccatctgctacttattcctcgattttaccgccagcagcttcgattgcagcacgcgcacctttggtgacacgtaagccgcgaaccgttaccggtgcagaaacttcaccagaaagaataactttaacgtattcaatctgaacaccgacaatgttggctgctttcagcgcgttcaggtcgacgataccgccttcaactttcgccagatcagacagacgaatctctgtggtgatcattgctttgcgagaggtgaaaccgaacttcggcagacgacggtacagaggcatctgaccaccttcgaaaccgcgacgtacgccaccgccagaacgtgagttctgacctttgtgaccacgaccaccggtttttccgaggccagaaccaataccacgacccagacgcttgctagcgtgcttagacccttcggccggagacagagtatttaaacgcatctcttactcctccactttaaccatgtaggaaaccgcgttgaccatgccgcgtacagctggcgtatcttcacgctctacggtatgaccaatacgacgcagacccaggccaaccagagtggctttatgcttaggcaagcggccgattgaactacgggtttgggtgattttaatagtgttagccatcgtgattaccccagaatttcttcaacggatttaccacgcttagcagcgaccatttccggagacttcatattgcccagaccgtcaatagttgcacgaaccacgttaatcgggttagtagaaccataggcttttgccagaacgttatgtactccagcgacttccagaacggcgcgcattgcaccaccggcgatgataccggtaccttctgaagccggctgcatgaacacacgggacccagtgtgcgcacctttaacagggtgctgcagggtgccgttgatcagcgcgacatttaccatgttgcgacgggctttctccatcgctttctggatcgctgctggaacttcgcgcgctttaccgtaaccaaaaccaacgcggccgttaccatcacccactacagtcagtgcggtgaaggagaaaatacgaccaccttttacagttttagaaacacggtttaccgcgatcagtttttcctgcagttcgccagcttgtttctcgatgtgtgccatcttagacctctaccttagaactgaaggccagcttcacgggcagcatctgccagtgcctggacgcgaccatgatattggaaaccggaacggtcgaaagaaacaccagtgatgcctttttcgattgcgcgttctgcaatagctttacctacagcagctgcggcttctttattaccggtaaacttcagttgttcagtgatagctttttctacagtagaagcagcaaccagaacttcggaaccgttcggggcgattacctgtgcgtaaatgtgacgcggggtacgatgtaccaccaggcgagtagcacccagctctttgagcttgcgacgtgcacgggtcgcacgacggatacgagcagatttcttatccatagtgttaccttacttcttcttagcctctttggtacgcacgacttcgtcggcgtaacggacacccttgcctttataaggctcaggacgacggtaggcgcgcaagtcagctgcaacctggccgatcacctgcttatcagcgcctttcagcacgatttcagtctgagtcggacactctgcagtgatacccgcgggcagctggtgatcaactggatgagaaaagcccagagacaggttaactacgttgccttttacggcagcacgataaccaacaccaaccagctgcagcttcttagtgaagccttcggtaacaccgataaccatcgagttcagcagcgcgcgagatgtacccgcctgcgcccagccgtcaacataaccttcgcgcggggcgaaagtcagagcgttgtcagcatgcttaacttcaacagcatcattgatagtacgagtcagctcgccgtttttacctttaatcgaaattacctgaccgttgagttttacctctacgccggcaggaacaacgacaggtgctttagcaacacgagacatagtatcctccgattacgctacgtagcagataatttcgccaccaagacctgcctggcgcgctgcacgatcagtcatgacacctttcgatgtagaaattacagcgatacccataccagccattacctttggcagctcatcttttttcttatagatgcgcaggccgggacggcttactcgctgaatgctttctacaacagctttaccctggaaatacttaagagtcagttccagttccagcttgatgtcgccttcgattttaaaatcttcaataaagccttcttccttcagcacgttggcaattgccaatttcagcttggaggagggcatggtgaccgcaactttgttcgcggcctgaccgttacggatacgggtcagcatatccgcgatcggatcttgcatgctcatctgtgttactcccgtgattcaattggtgacaattaccagctagcctttttcagacccgggatttcaccgcgcattgcggcttcacggaccttgatacggctcaacccaaacttccgcaggaaaccgtgcggacgacctgtttgacggcagcggttacgctgacgtgaagggctggaatcacgcggcagactctgcagcttgagaacggcatcccaacggtcttcgtcggaagcgttcacatcagaaatgatcgctttcagttcagcgcgttttgcgaagaatttgtctgctaatttcacacgcttaacttcgcgtgctttcatagattgcttagccattaagtaaccctaccttacttacggaacgggaagtcaaaggcagccagcagagcacggccttcatcatcagatttcgcagtagtggtaatggtaatatccaaaccacgaacgcgatcgactttgtcatagtcgatttctgggaagatgatctgctcacgtacacccatgctgtagttgccacgaccatcgaatgacttagcggacaagccacggaagtcacggatacgcggtacagcaatggtgatcagacgctcaaagaactcccacatgcgttcgccacgcagagttactttacagccgatcggatagccctgacggattttgaagcctgcaactgatttgcgtgctttggtgatcaacggtttttgaccggagattgctgccaggtcagctgctgcgttatccagcagtttcttgtcagcgatcgcttcaccaacacccatgttcagggtgatcttctcgacccgagggacttgcatgacagaattgtagccgaactcactcatgagtttctggactacctcgtctttgtagtaatcatgcagtttcgccatcgtactactccaaattacttgatagtttcgctattagacttgaagaaacggacttttttgccgtcttcgaatctaaagcctacacggtcagccttaccggttgccgcattgaagagtgcaacgttagaaacctgaattgcagcttctttttcaacgatgccgcctggttggttcagagccgggacaggcttctgatgtttcttaaccaggttgataccttcaacgatgaccttgccagaagacaggacgttcttaactttaccgcgcttacctttatctttaccggttaacacgataacttcgtcgttacgacggattttagctgccattgttagctccttagagtacttctggtgccagagagataattttcatgaacttttcagtacgaagttcacgagttaccggcccaaaaatacgcgtaccgataggctgctcactgttattgtttaaaataacgcatgcattaccatcgaagcgaatgacagaaccgtccgggcgacgaacacccttcctggtgcgcaccactaccgccttcaggacatcaccttttttaactttaccacgtggaattgcttccttgatggtaactttaatgatgtcgccgacgcctgcgtagcgacggtgcgagccacccagaaccttgatacacattacgcgacgtgcaccggagttgtcggcgacgttcagcatagtctgttcttggatcatttcagtgctccgctaatgtcaactactacttcgggacccagacctcaggtcgtttgaaagccccataattgagggcgcggcattataacaccggttctcgcagatgggtagaaaaaatgaacggctcatccgagccgttcattcgatttttaaagagggcagattctattacagaattgctttctctacaacgcgaacaagtgtccaggacttagtcttagacagtggacggcattcgcggatttctaccacgtcaccgattccacattcgttgttctcgtcatggatgtgcagcttagtcgtacgcttaatgaattttccataaattggatgcttcacgaaacgctcgatagcaacaaccgcagatttctgcattttgtcactaacgacacgaccctgcagagtacggattttatcggtcattacgaacccgccttctcagtcagtaaagtcttaacgcgcgcaacatcacggcgaacctgcttcagcagatgagactgctgcagttggccagatgctgcctgcatgcgcaggttaaattgctcacgcagcagattaagcagctcagtgttcagctcttcaacgcttttttcacgcagctctgttgctttcattacatcaccgtcttagttacaaaggtggttttgataggcagttttgctgctgccagcttgaatgcttcacgggccagctcttctggtacgccgtccatttcatacaggactttaccaggctggatcagggcaacccaatactcgacgttacccttacctttacccatacgcacttccagcggcttctcggtgatcggtttgtccgggaatacacggatccagatcttaccttgacgcttaactgcacgggtcatagcacgacgtgctgcttcgatctgacgggcagtcagacgaccacggccaacagctttcagaccgaaagtcccgaagctaacatccgtaccctgcgccagaccacggttgcggcctttatgcactttacggaattttgtacgctttggttgtaacatagcgactctccttacttacggcctttacgctgctgctttttaggttgagcagccggttccggttgttcaacagcagccataccacccaggatctcgcctttgaagatccataccttaacgccgattacaccataagtggtgtgcgcttcagaggtgttgtagtcaatgtcagcacgcagagtgtgcaacggcacgcgaccttcacgataccattcggtacgtgcgatctcggcgccgcccagacggccgctaacttcaactttaatacccttcgcgcccagacgcatggcgttctgaaccgcacgcttcatagcacgacggaacatcacacgacgctccagctgtgaagtgatgctgtcagcaaccagtttcgcgtccagttccggtttacggacttcggcgatattgatctgtgcaggaacgccagcgattttcgctacgaccgtgcgcagtttttcaacgtcttcacctttcttaccgatcacgatgccaggacgagcagtgtgaatagtcacacggatgctcttagccggacgctcgataacgatacgagatacagacgccttcgccagttccttagtcaggtactgacgtactttaaagtcgctgtccaggttgtcagcgaattctttggtgttcgcaaaccaggtagagttccatggttttacaatacccaggcgaataccattaggatgtactttctgacccattgctagtctccagagtctcagcgatcggacacaaccacagtaatgtggctggtgcgcttcaggatgcgatctgcacgaccttttgcacgaggcataatgcgcttcatgcttgggccttcgtcgacgaaaattttcgcgactttgagatcgtcgatatcagcgccatcgttgtgttcagcgttagcaatggcagattccagaactttcttgaccagtacagccgctttcttgttggtgtaggtcaaaatatccagtgcctgcgacactttcttaccgcggatcaggtcagcaacaaggcgaaccttctgagcagaagaacgagcgtggcgatgttgagctaaagtttccatctcttcctcctacttatttcttcttggcttttttatcagccgcgtgaccgcgataagtacgtgtcggcgcgaattcacccagtttgtgaccaaccatttcgtcggaaacaaagacaggaacgtgctgacgaccattatggacagcgatggtcaaaccgatcatgttaggaaagatcgttgaacgacgggaccaagtgcgcaaaggcttcttgtcaccgctttccaccgctttctctaccttcttcagcaagtgcaggtcaataaaaggacctttcttgagagaacgtggcatggcttatcctctaatattatttgctacggcgacgtacgataaacttatcggtacgcttgttgctacgggtcttcttacctttggtctgaacgccccacggggttaccgggtgcttaccaaagttacgaccttcaccaccaccgtgcgggtgatctactgggttcatcgcggtaccacgaacggtcggacgaacaccacgccaacgggttgcaccggctttacccagaacgcgcagcatatgctcagcgttaccgacttcgcccagagttgcgcgacagtcagcttcgactttacgcatttcacctgaacgcagacgcagggttacgtaggaaccatcacgcgcaacgatctgcacgtaagcaccggctgagcgagcaatctgaccgcctttgcctggtttcatttctacgttgtgaacggtagaacccaccgggatgttacgcatcggcagtgtgttacctgctttgatcgcagcatcaacgccagattggatctggtcgccggctttcaggcctttaggggccaggatgtaacggcgttcgccgtctttgtacagaaccagtgcgatattcgcagagcggttcggatcgtactcaagacgttcaacggttgccgggataccatctttgttgcgtttgaaatcaaccagacggtaagcctgcttatgaccaccaccgatgtgacgggtagtgatgcgaccgttgttgttgcggccaccggatttgctgttcttttccagcaatggagcaaacggcttgcccttgtgcaactctgggttcaccactttaacgacgtggcgacgacccggagatgtcggtttacatttaacaactgccattgtctttctcctccgacttactcagcgccgccgacgaagtccagattctggccttccttcagggtgacgtaagcttttttccagtcgctacgacgaccgatacgctgtccgtgacgcttaactttacctttaactaccagggtgtttacgtctttaacttctacttcgaacagcttctcaacagcagcaacgatctctgctttagtcgcgtctttagctactttgagtacgatggtgttggttttttccatcgcgctagatgccttttcagatacgtgcggcgcgcgcagtactttcagcagacgttcttcacggatcatgccagcatctcctcaacttgcttaactgcatcagcagtcataacgactttgtcgaaggcgatcaggctaactgggtcgatacccgctgcatcacgcacgtcaaccttgtacaggttacgcgcagccaggaacagattctcatccagttcaccggtgatgatcagcacgtcttccagcgccatgtctttcagcttctgtgccagcaacttggttttcggtgcttcgacagagaactgctcgacgacgatcagacggtcttgacgtaccagttcggacaggatgcttttcagcgcgccgcggtacatctttttattaactttttgactgtggtcttgtggcttcgcagcgaaggttacgccacctgaacgccagattgggctctttacagaacctgctcgcgcacggccggtacccttctgacgccaaggctttttgcctgaaccagtgacttcggcgcgagttttctgcgcacgactaccctggcgggcgcctgatgcgtaagcaacaacaacctggtgaaccagcgcttcgttgaaatcacgaccgaaggtagtttcggaaacagtcagcgcgctctgcgcgtctttcaatactaattccattgctatccccttacgccttcacagctggtttaacgatcaggtcgctaccggtagcaccgggaactgcacctttaaccagcagcaggttgcgctcagcgtcaacacgtactacgtccaggctctgaaccgttacgcgctcattacccagctgacctgccattttcttgcctttgaacactttgcccggagtctggttctgaccgatagaacccggaacgcggtgagacaaggagttaccgtgggtcgcgtcctgggtacggaagttccagcgcttaacggtacctgcgaaacctttacctttagaggtgccagttacgtctacttttttaacgtcagcgaaaatttcaacgctgatgctctgacctacggcatactcatcaccttcaacggtgcggaattcccacaggccacggccggcttcaacgccagctttagcaaaatgaccagcttcaggtttggtcacacggtttgcttttttagcaccggtggtaacctgaattgcctggtaaccatcgttttccaggcctttgacctgagtaacgcggttcgcttcaacttcgattacggttactgggatagaaacgccatcttcagtgaagatgcgggtcattcccacttttttaccgactaaaccaatcattgtttcaacctctcaatcgctcgatgacctgattaacccaggctgatctgcacgtcaacaccggcagccaggtccagacgcatcagagcatcaacggttttttcagttggctcaacgatgtctaccagacgcttgtgagtgcgaatttcgtactgatcacgcgcatctttgttaacgtgcggagagatcagaacggtaaagcgctctttgcgggttggcagcgggatcggaccacgtacctgcgcaccagtgcgcttggcagtctcgacgatttccgcggttgattgatcgatcagacgatgatcaaacgctttaagacggatacggattctttggttcgacatgagaccaaggctccaaacattttatagacgaaaaaaattactactcgagcccattacgattgatgggagagtgtaatcgttcagcatataactccacagttgggagtattgtcagacggcccaaaattctgccgtctgcgattcagctcgaatcgcgcccaccaatatcggtaggcccgcgcattatacgtatatttgctcaggaagcaacccatgttgcgtttttgcccgtgaaaagtgcaatcgggcttgtttgctaaagccagcacaagatgatgaagagtaaatgcaaaactgtaattcctctgtgagtgaccttccacgttgctgatcctgcccatgactccgaatcagccttcagtcaggctgtagcgacatttccggtctcttcgaggtgacaagcggtgctcatcattctgtttactgttacggcactcggtgccgcactcggcagctttcttgcgttggcctgccagcgctatcatccggccatatcgccagacgactggttcacttccctctggacgccgccctcgcattgtacgcactgccaggcacctgtcttatggcgagacagaatcccggtgataagctggctgcgcctgcacggccgctgtcggttttgccgacgtcctgtcggcctgctcccgctgctgtttgagttaacgggcgccctgctctgcctgttactggctatgttgttcagtgaccacctcatcgtggccgcttttattctgacggcatcctgcctgttattgttacttgcagccatcgaccagcgtcatctcttgctaccggacgtgctgacaggcgcgttactttggctgggactcgcacgcttctttttctataagccagtcactgtatctgcggcagtgggtggcgcaattgcaggttatggctcgctgtggctgcttgcctggctatatcgtcagataaagaatcaggcgggattaggctacggggatattaaactttttgccgcgctgggcacatggtgcggttggcaggccctaccctggattgcactggttgccagcctgacggctctgcttgcctttatcgcactggtcgtcatcaacaggacgttgtctgtaaacagcccgcttccctttggtccattcctggccgtcgcgggctggggagtgatagtgattcaaagcctcactcgtctctgatttgcgcctgaaggtagttttgaatgcccattttattgatcagctccagctcggtctcgatccagtcaatatgatgctcttcgtctgccaggatttggatcatcatatcccgactcacgtagtcatgaattttgtcggcatacgcgatagcttcacgcagatcttttgcaccttcgagttcaagattgagatcggactgtaacatctcttccacatcctcaccaaccctgagccgtcccagatcctgcagattcgggatgccttcaagaaacaggatacgttcaatgtatttgtccgcatgcttcatttcatcgatggactcatggtactcaacatcattaagacgcatcagcccccagtttttgaacatccgtgcgtggagaaaatactgattgatcgcaaccagttcattccccaacagtttattgagatgacttatgattttcgcatcgcccttcatttcacgtcctccgctcatgtttatttgagcgtagatgcggttaaaaagaagtcaaaaaaacgcgatgaaaattgtgggtattatcatgtccgatgacgaaagccttcaggctatctctttatactgcggaacctgctgcatctcatcgtccatgatttcacgggcgacacgaatgcatttaccgcattgctttcctactggcacgatttggcgcagttgctgaatagattttggctgatagcggcgcacgacttcacggagggttttatcactgatggcattacacagacagacgtacatttattcatcactcagtctatttcgtgcacacagtgtaaatgcgaatcgtttttatttcaaacctaccctttgtaagggaaaatgcgttttgaacgatttaaagcaaaaaaaagagcaccgaagtgctcttttttattttgctgtgaccgcgtaagcagtcacatcagatatcacaattaagcgataactttagcaacaacgcccgcgccaacggtacggccaccttcgcggatggcgaagcgcagaccttcgtccattgcgattgggtgaatcagggtaacaaccattttgatgttgtcgcccggcatgaccatctcaacgccttctggcagctctactgaaccggtcacgtctgtggtacggaagtagaactgtggacggtagcccttgaagaacggagtatggcggccaccttcgtctttagacagaacgtagacttctgactcaaacttggtgtgtggcttgattgagcccggcttagccagtacctgaccacgctggatgtcttcacgcttgataccgcgcagcagaacaccacagttttcgcctgcctgaccctggtccagcagtttgcggaacatttcaacgccggtacaggttgatttcgcagtatctttgatacccacgatttcaacttcgtcgccgactttaacgatgccgcgctctacacgaccggtcacaacggtaccacgaccagagattgagaatacgtcttcgattggcagcaggaatggcatatcgattgcacgtaccgggtccgggatgtagttatccaggtgaccagccagctcaacgattttctcttcccactctgggttgccttccagcgctttcagagctgaaccgcgaacgattggagtatcgtcgcccgggaagtcgtactgtgacagcaggtcacggacttccatctcaaccagttccagcagctcttcgtcatcaaccatgtcacacttgttcaggaacacgatgatgtaaggaacgcctacctgacgacccagcaggatgtgctcacgggtctgcggcattgggccgtcagtcgcagcaacaaccaggatcgcgccgtccatctgcgcagcaccggtgatcatgtttttcacatagtcggcgtggcctgggcagtcaacgtgcgcatagtggcgagacggggtttcatactcaacgtgtgcagtgttgatggtgataccacgtgctttttcttccggggtgctgtcgatctggtcgaacgcacgcgcctggccaccgttggttttagccagaacggtagtgatagctgcagtcagggtggttttaccgtggtcgacgtgaccgatggtgcccacgtttacgtgcagtttgttacgttgaaattgctctttcgccatggcgatattccttacgttatgccttcatcactttggacgaaggcatcagttcaaatttaaaccgtagcttatttgctacgagcttcaataacggcctgcgcaacgttgttcggcgcgtcgtcatacttcaggaactccatggagtacgaagcacgacctttggtcagagagcgcagctgagttgcatatccgaacatttcagacagcgggacttcagcgtggatctgaacgccagtagcgttagattcttgccctttgagcataccacgacgacggctaaggtcaccgattacgtcaccggtgttctcttctggggtctcgacttcaaccttcatgataggctcaagcagaactggctgcgctttcttaaagccatctttaaaggcaatagacgcggctagtttaaacgccagctcagaggagtcaacgtcatggtaagaaccgaagtgcagacgaacacccagatccacaaccggataaccggccagtgggcctgatttcaactgctcctggatacctttatcaaccgcagggatgaattcgccaggaattacaccacctttgatatcgttgacaaattcgtaacctttcgggttcgaacctggctccagtgggtacatgtcgataacaacatgaccgtactgaccacgaccaccagactgcttggcgtgcttaccttcaataccggtaactttagagcggatcgcttcacgataagcaacctgtggtttacccacgtttgcttcaacgttgaattcacgcttcatacggtcaacgatgatgtcgaggtgcagctcacccataccggcgatgatggtctggttggtttcttcatcagtccatacgcggaatgatggatcttccttcgccagacgacccagagccagacccattttttcctggtcagctttggttttcggctcaacggcgatagagattaccggctcagggaattccatgcgctcaagaatgatgacgttgtctggatcacacagcgtgtcacccgtggttacgtctttcaagccgatcgctgctgcgatgtcgcccgcacgaacttctttgatctcttcacgtttgttggcgtgcatctgaacaatacggcccagacgctcacggtttgacttaaccgggttgaacacggtgtcgccagtgttaaccacaccagagtaaacgcggaagaaggtcaggttaccaacaaacgggtcggtagcgattttgaacgccagtgcagcaaacggctctttgtcgtctgagtgacgctcagccggcgtgtctttaccgtcgtccagcataccgttaatcgcggtaacgtcagtcggtgctggcaggtattcaacaaccgcatccagcatcgcctgaacacctttgttcttaaatgcagaaccacaggtaaccaggatgatttcgttcttcagaacgcgtttgcgcagagatgttttgatctcttcttctgtcagttcttcaccgccgaagaatttctccatcagctcatcagaaccttcagctgcagcttcaacaagcttcgcacgccattcttcagccagttcctgcatattagctgggatatcttcgtatacgaaggtaacgccctgatcggcatcgttccagttgatagctttcattttcaccaggtcaacaacaccggtaaagccgtcttctgcgccgatggccagctgaagtggaactgggtttgcacccaagcgcgctttcatctgatcaacaactttcaggaagttagcacccatgcggtccattttgttaacgaacgcaatgcgtggaactttatatttgttcgcctggcgccatacggtttcagactgtggctgaacaccaccaaccgcacagtaaaccatgactgcgccatcaagcacacgcatagaacgctcaacttcgatggtgaagtcaacgtgtcccggggtgtcgatgatgtttacgtggtgtggttcaaactgcttagccataccagaccagaaacaggtggtcgcagcagacgtgatggtaataccacgttcctgctcctgctccatccagtccatggttgctgcgccgtcatggacttcaccgattttgtggtttacaccggtgtagaacagaacacgttcggtagttgtagtcttaccggcgtcgatgtgggcactgataccaatgttacggtagcgctcaatgggtgttttacgagccatttgattcctctgattcttagacgttctaagttaaaaaagcccagcaggtgagtcactgggacgcccgctgggttaataacaactacgaagctgttaccagcggtagtgtgcgaacgccttgttggcttctgccatgcggtgaacgtcttcacgtttcttaactgcagtacctttgttttctgcagcatcagaaagttcgttcgccaggcggagagccatagatttatcaccgcgtttacgagcagcttctacaatccaacgcattgccagggcattacgacgaaccggacggacttcaactggaacctggtaggtagacccaccaacgcgacgtgacttaacttcgacagtcggacgcacgttctcgagagcaacctcgaacgcttccaggccatctttaccagcgcgttgagccagggtctcaagcgcggtgtagacgatagtttcggcagtagactttttaccatctaccatcaggatgtttacaaatttagccagcagctctgatccgaacttaggatccggcagaattttacgctgaccaatgacgcgacgacgtggcatggaaatactccgttgttaattcaggattgtccaaaactctacgagtttagtttgacatttaagttaaaacgtttggccttacttaacggagaaccattaagcctttggcttcttcacgccgtacttggagcgtgactgcttacggtctttaacacctgagcagtccagcgcgccacggacggtgtggtaacgcacacctggcaagtctttaacacgaccgccacggatcaggatcacggagtgttcctgcaggttatgaccttcaccgccgatgtaggaggtaacttcaaaaccgttagtcaaacgcacacggcaaactttacgcagtgctgagtttggttttttaggagtggtagtgtacacacgagtacaaacaccacgtttctgcgggcaagcttccagcgccggcacgttgctctttgcaactttgcggacgcgtggtttgcgaaccagctggttaactgttgccattaaatagctcctgggatttagctttttgcttcgtaaacacgtaataaatcacctcgtagaattacgaggaggcagaattttagggctgtgtcaaaagggtgtcaagaaataaccagggggtcagcgaattaccaggccatttgttgtcgatgttttaccgttaacgcaacgaaaaaagtatagtctactggctgcacaatgggagaaatttgctcactcagcccgcgtgcgctcagatcgtcttgcagcgcccagagttttacaccgcaggcgctcagtttttccagcgccctactgccctggatcgctgccagtacgccgtcctgcaacaataacaggtcgtcgtccgggctcaacagtaaggacagcgtatcaatgtcgctgtaagccggcgaatgaaataaagtatgcagcatgactcgctcttaaaaagtcaggattcggtcaaagccagccagtttttgacgcagtaacggcgcatctaaaatctcagcatccaaaatacgcggagcactttccgctaaaccgcgaacccgcaacgcgtcccgacacaggtaacattgctcgatatcatacagcgccagcacaccaaaggtcgcggcataatgacgactgtgaatattttctggctgttgcccactgttgagctgaagtacaccgtcaccaataaaaaacaggccgatgtcatcgcttaatgcaccggtcgccaaggcagcatccagcccttcacgacctgcactggtgccatgcggcgcacgggtaaagacaaacgcaacacgattcatcagaactgcaccatgcgttcgcaccgcagtgccgcttcagccagcgcacccaagccggccagcatgaagccgggttgcagattggcgccgggcaacgccagccttgacgcttcctgttgatcggtcacgccgcgccgtaatgctgctgcgacacagatattcagcgcgacgccctgtgcctggctcagtgactgccacgcccggaccagatcaaactcatcactggccggtgccgtcagctgattcgcattcagcacgccttcccggtaaaaaaacacactgtccagttgatggccggctgccagcaacgcgttggcaaacagcagagcgctggtcgcctgttgcgtgccataggcggggcccgtgaccaacagcgcgtaacgcattagcgatcctgcccctggaagtcaccgtttttaaactgacggatgtagagatacacggtgtgcttggaaatatttaagcggtctgcaacctggttgatggcatctttgatgtcgaaaatacctttctcatacaggtttaatacgatctgacggttcttggcattattcgacacattgcgatcggcgctcacttcttcaatagtaaattccagcgtttgcatgaccaggtcgtctaccgaacttgcaaagttaacgttggagtcaacctgctgcatttcaggcggcagaaatgtcgacataatctgtgaaaacggtacatcaaggttcatgttgatacacaacagcccaataacccgctgctgacgattgcgaatcgcgattgtcactgacttcatcaacacaccgcttttcgcacgggtaaagtaagcgcgggaaacattgctgtctgcgccctgcatatcatgcagcatccgcaacgctaagtccgtaatgggcgatccgactttacgaccagtgtgctcaccgttagcaatacgcacagccgaacagttcaaatcctccagtgagtgcaggacgatttcacaatgcgagccgatcagcatggcaaggccatctacgacagcctcatacgactttaaaatatcgtaatcagtttgctcgaacggatgctgctccagaagatcgaagtcgctcagttcaccgggattgaatggattagacattgaagacatcaccctacatggctggagcctgtcacagcggcttacgggcagactcaatattgggataattatgcaggcgatagtctggcaaatgtcgcgggcttatgccagaggtttgtcataatgcgcagaaaccgccacccgaaggtggcggcagacagattactgggatttcttcgcgtcagcagcaggtgcctgcgttttttcatctgcttttggtgcaggtttgatatcaagcagttcaacatcaaagaccagggtagagttcgctggaatacccggaacgccgttcttaccataggcaagattcggtgggataaccagtttgatcttaccgcctttcttaacgtgcttcaggccttcggtccagcctgggatcacgccatcaagacggaatgacagtggctcaccgcgggtgtaagagttatcgaactccgtaccgtcgatcagcgtacctttgtagttaacgaccacggtatcgctgtctttcggcgcatcaccggtgccttctttctctactttgtacagcagaccgctgtcggttttcttcacgccgctctctttggcaaacttagcgctgtaagcttcacctttctcggcattttctttcgcatctttttccatcttggctgaagccgcgcctttcacacgcacttcaaacgcctgcagtgtttgctcgatctcttcgtcagacagtttgctcttgccaccaaacgcatcctgaacaccggcaatcagctgctgtttgtccagtttgatgcccagcttctcttgttctttcagagagttgtccatataacggcccagtgacgcacccaaagcatacgcagattgctgatcttcatttttgaaggctgcattttttggagcctgaggagcagtctgaggcgcatcggctgctgccggtgccgctgcagtttctgcagccattgccagcggagcattcagcgcgacggccatggtggtagctaacaatgtgactttgaacagtgatttcatcctttctccaaaaccgaagcctgacacctcgggaatcattgcggactgcgggcccacactataactttacgtggcagtggcgaacactcccacagcgtaattatctggtctacttccgaccttttttgcgtcaggaagtttcaccagagatgatgccatctgggcctttttcaagctaaacgctaaataaaacataaaaaatagggcaattctgcaacgtcagcctttagaattatgcgctgagtagcaccttaacaggagaacaggtcatgcaacagtcagagtgggaacaacgtattgaaacgcttgaaagcaaactggcttttcaggagatgactatcgatcaactgaacaataccgtggtccagcatgaacttgaaatgagtaagatgcgcgaacatatgcgtctgttgcttgagaagtttaaagccagcgcgccatcgatgattgccgatccgtcagaagaaaccccaccgccgcattactgatacaggcctgggtccccgaacatctggcgcgatccgaaagacgcaaaaaagtaaggccacccggaggtggccttgaaatgcagagtcgaacttagtggctgcaaccgcaaccgccagtaccgcaaccaccctgaccgtggtcatgatcgtggtcgtggtcatggtcatggtcgtgatcgtggtgatggccatcagcaccgtgaacgtggccatgagccagctcttccggtgtggcttcacgaatcgcaaccacctcaacattgaaattcaggttctgacccgccagcatgtggttaccgtcaaccacaacatgctcgtcttcaacttcggtgatttcaaccggcactggaccctggtcggtttccgccagaaaacgcatgccaacctgtaattcgtcaacgcccataaagacgtctttaggtacgcgctgtaccaggttgtcatcgtactgaccgtaagcgtcgtttgccgggatatgcacgtcaaacttatcgcccgctacgtggttttccagcgcgttttccagaccagaaatcagggaaccatgaccgtgcagatagtctaacggtgcactcaccggtgactcgtcaaccaacacaccgtcttctgtacgtacctgataggccaggcttaccaccaggtcttttgctactttcatgatatctcctaaccgttgagaactaagatcccgtctcattggtctattcttgcgtgcaataacaccaaccagaaaggttcggggctgagtacaagaggctgtctttttctcttgcgaccacagcgttaatggcgtcaattgtaacggaattcaatcccgctgtgtggttaagcttaaaaaaagctgggccatttcgctactctggatggaaaatgcctatcacttgctcattgccacgaacctgatcgcgcgcctgtttatccgcttcgcgcatttgatggccgcacttcacacactcaacgacatcgacattgttttcgcgccacatagccaacgtgtctttttcctggcagtgcggacaaaccgcaccggcaataaaacgtttacgcatgatgctctacctgcctcttctgattactcatcgtcgtcccagtcatggatctgacgcctttcgtgctgcatttcgcgctgaaaaatatcttcaagttcacgccgagcttcacgtacccgagaaatctgtgccttgtcagattgggcgggcaccagttcccgcaacatacgcatatccagccgacggaagtgctgctgcgcacggtgcgcctgatgcggatgcatccccagcgacatcaatgtcttgcggcccagctccagcgcactggagaaggtttcacgcgagaactgcgtgacgcctgcctgcagcagttcatgggcttctacgcggccgcgagcccgcgccatgatatgcagatgcggaaaatgctgctggcagagatgcacaatcgtcatggcatcttcaggattgctacaggtaattacgatggattgcgcactggccgcacccgccgcacgtagcagctccagctcggtggcatcaccataataaaccttgtagccatattttcgcatcaggctcactgcgctgatatcccgctccagtaccgtgatacgtttattgttcgccatcagtaaacgaccaacgacctgaccaaaacgaccaaagcccaccacgatgacctggggctgatcgtcctcgacgaacggcttttcagcatcttcgtcaatttcattaaaacgacgcgctaacagccgatcgatgacctgcatcagaagtggcgtggtcatcatggacagggttacggtaaccagcaggagcggcagttgatcgcccgaaaacagtttggccgatgaggccgcagaaaacagcacaaaggcaaactctccgccctggctcagtacaccggcaaactgctggcgctccgagctgcgcaaaccataaatccgtcccagcacatacaaaaccaggatcttcaccgccaccagcaccagtacgcccagcaagatcgcgataatatgggtatagagcacgccaagattcagcgccatgcctaccgaaataaaaaacagccccagcagtaaacctttaaacggctcgatcgccacttccagctcgtgccggtattcactttccgccaacaggataccggcgataaacgtccctaacgccatggataagcccagcgcatccataaacagcgccgaacccagcaccaacaacaatgaagccgcggtaaacacctcgcgtacgcccgaggccgcgatatagcgaaaaatggggcgcagcaaatagcggcccccaattaacatgccggcaaaggccagcaccttcatgcccactttcatccagtcgatgctgccgctgtcatttcctgccaacagtggaatcaacgccagagccggtatcaccgccaggtcctgaaacagcagcaccgaaaaacctaactgcccggattcgctgcgattcatgcctttatcgcgcatcagctggagcgccatcgccgtggatgacattgccaggccaataccgccaatgaccgcggctcgccagtcaaacttcgtcagccacagcagcgtgcccagaatcgccgctgaaaaaatgacctgcgccgcgccaataccaaaaatggaccggcgcagcgcccacagctttgccggattaagttccagcccgatgatgaacatcaggaacacgacgcccagctcggaaaagtgcaggatctcgtcaacgtcgctaataaaacccagtccccagggtccgatagcaataccggccagcaaatatcccaaaactgcgccaataccgaggcgcgccgctaccggtacgatcagtaccgccgcgaccagatagatcactcccgcggtcagcagcgtttgtccttccatttataaccctccattcggcagcggtgctgccagccagtcgctgtatgcgcgggcataatttttcagtaaatcggggtgctggcggcgggcccagtagataatcatcggcggcatccagtgcatacggcacatctgcgccgtcagctcaaaggggcgcaaaatgtcattcatggaataacggttaagcccgtgcttctggaacgccgtttctggctctcctgtggtcacaatgctgcgccagtattttccttccagcgcattaccatctacgccgttggcaaacccccgcgacagtacgcgatccagccactcttttaacagcgccggacagctataggtatagagcggatgctgaaaaataatcacatcatgctcacgcagcagctgctgctcgtggtagacatcgataaaaaaatccgggtaggcagcatagagatcgtgaacggtgacatgttctgttttctcagccgcctccagcaaaatgcgatttgctttcgaatcctgtgcttcaggatgagcaaatagcagcaaaatcttaggtggctgcgacatcctttccctccaaagcgtcgtcattggtgcagatttccgctaccatgcacaacgcaacaagaacccaattatgttgcaggtaaattaacatattctgacgatacggcgcttatgattgtcttctctgccctacaaattcgccgcggtattcgcgtcctgctcgataacgcgaccgctaccatcaatcccggccaaaaagtcgggctggtgggtaaaaacggctgtggaaaatccacgctgctgtcgttgctgaaaggcgagatcagcagcgatgctggctccttcacctttcccagcaactggtcactcgcctgggttaatcaggaaactcctgccctgagccaggctgcccttgactatgtcatcgatggcgatcgcgagtaccgccagcttgaagcggaactggcagaggcgaacagcagcaatgacggaaatgccatcgccctgttgcacgctaagctcgacaccattcaggcatggacgattcagtcacgtgcctcaagcttgttgcacgggctgggatttagtcaggaacagcttcagcgtccggtgagtgatttttctggcggctggcgcatgcgacttaacctggcgcaggcgttgctgtgtcgttcagacctgctgttgctggacgaaccgactaaccacctcgatctggatgcggttatctggctggagcgctggctgaaaagctatgaaggcacgctgattctaatctcacacgatcgcgacttccttgatcctgtggtggataaaattatccacatcgagcagcaaacgatgatcgagtacaccggcaactacagctccttcgaacgccagcgcgtagccaagctggcacagcagcaggcgttatatcagagccagcaggaaaaagtggctcacctgcaaaaatatattgatcgcttccgcgctcaggcgaccaaagcgaagcaggcccaaagccgcattaagatgctggagcgcatggagctgattgcgcctgcgcacgtcgataatccctttagtttcagcttccgcgcaccggaaagtctgcctaatccgctgctgaaaatggaaaaagtgaccgcaggctatggcgatcgcattattcttgatgccattaagcttaacctggtgcccggctcacgtattggcttgctgggccgcaacggtgccggtaaatccacgctgatcaagctgttggctggcgagcttagcgcgaaggtgggcgagattggcctggcaaaaggcattaagctgggttacttcgcccagcatcagctcgaattcctgcgtgccgacgaatcgcctttacagcacctttcccgtatcgcaccgaaagtgttagagcagcagctacgtgattaccttggcggctttggctttcagggcgataaagtcacggagatcaccgaacggttctccggtggagaaaaggcacgcctggtgctggcgctcatcgtctggcagcgccctaacctgctgttgctggatgaacccaccaaccatctggatctggatatgcgtcaggcattaaccgaggcgctcatcgatttcgaaggggcgttagtggtggtctcgcacgatcgccatctgttacgcgccacaacggacgatctctatctggttcacgatggcagcgtcgatgtgttccccggcgatctggaagattatcagcagtggctgagcgatctgcaaaaacagcagacgcagcaggacgcggcacctaagcaggacaatggcaacagcgcccaggcccgtaaggatcagaagcgccgtgaggcggagctacggacgcaaacccagccgctgcgcaaagagattgagaaattagaaaagcagatggcgaaatggcaaagccagctcgccgacgccgaagcactactctcggacagcgccatctacgaacagcagcgtaaggccgatctcactgccgcgctacagaagcaggccgagagtaaatcggcgctggaagaggtggagatggcctggctggaggcgcaggagcaactggaaacgatgctcaccgcctgatccaggcggctgcgttgggacgtcttcatcccatctgagttcacaccgccgtaccggctcagcgtccggtacggttcaatagggtttatcgcccagcaccgttgcccgttgcatcacccgccgtgttggataatagtccgcattcgcatagtgctgtgtaacccggttgtcccatatggccaaatcgtttggctgccagcgccagcgcacctgaaactccggtttcgtcacgtgggcaaacaagaagcccaatagcgcctcgctctctttctgacggatatccatgattcgggtagtaaatccctcgttcacaaacagggcttttttgccgctgacgggatgcgtacggatcaccggatggtacaccggtgggtttttcgcgacggcctgttgccagcgctgatgctcctctggcgtgttgcggtgcttgtattcgggaaacgattttgtaaagtcatgttcagcctgcagttcagccagtaaggttttaaaaggcgcagacagcgcctcatacgccgcgatgccgctggtccacagcgtgtcaccgccacactccggcagcactttggacgcaagcaacgccacggctggcggcgtttgaataaaggtcacatcggtgtgccagttatcattatctggcggattatcctggtgcgtatccagaacaatgatctcttcaacgccttccgcatgcggataaaccgggtggatatgaagatcgccaaagcgaatcgccagcgcacgatgctgttcgggcgtaataacctgctcacgcaggaacaggacctggtggcgcagcagcgcatgatagagctgttcaaactgcgcgtcactgagcggacgggatacatcaaggttgccaacctgggcaccaataaaaggcccgagtggcttaatctctaacttttcgttcatttttgctctccattccagggcgtcaggcggcgctgcagcgcacgcagactcagctctaaactaaacgcaaccacggcaataaccgcgatccccgccagcaccacatctgtcgccagaaactcacccgccgactgcaccataaaacctaaaccccgggtggccgcgatgagctcggcggccaccagcgttgaccatcccacaccaaggccaattcgtaatcccgtcagtatctctggcaaggcgccgggtaaaatgacccaacgcagctgctgccagcggttcgctcccagcgacgccgccgcgcgcagacgcacctgctgcgcattgcgcacgccagcgaccgtcgacagcaccaccggggcaaatatcgccagaaaaatcaacaatattttcgatgtctcaccaataccgaaccagatgaccatcaggggcaaatacgccagcggcggcacgggccggtaaagctcaatcaacgggtcgatcagcgcacgtaccaccgggctgatgcccatggcaatccccaccgggatgccgatcgccgctgccgcagttaaggcaatcagcatacgtgtcaggctggcggacaaatgctgccacagcgtggcgtccataaagccttgtggaccggcaaccaacagcagctttcgcaccacctgctgtggcgaaggtaaaaacagcggtgcaatcagccccagcgcggtcacactccaccagatgaacagcagcaggagcaggcttagcgcgctcaacgtaaacggggtggaaaaaggccagcgcaggcgacgctggcgcacgcttgtcggctcatcattgaccagcgcactcatacaaatgcctcccgctgttcaaatacccgactcagtacatattcccgctgagcaataaaatcaggatcggatttgatgctgcggcaggattcgccctccacaaaacgctgaccgaaattaagcgtcagtttttcctgtacccggcccggcgacggagagagcagcaccagctcgctggccaaaaagatggcttcttcaatgtcatgggtgataagcagaatctgcttaccactgttacgccacagggttaatagcagcgtttgcatttgctcgcgggtgaacgcgtcaagcgcgccgaaaggctcatccagcagcaataactgtggatcggccgccagcgcccgggcgataccaacgcgctgacgctgaccaccggatagctgccagatctgccgtttttccgcgccttccagcccaacgcttttgataaagcgccgtgcaatcacctcacgcggctggcgcgccatgccggcgagctgtaaaccgaaagccacattatccagtacgttacgccacggcagcaggccttcactctgaaacaccacgccacgctctgcgcccggcccgagaacaggcttttcgtccagggaaatcgcgccggattcgaccggtaaaaacccggcaatcaggttaagtaaggtggttttgccacagcctgacggccccagaaccaccatcagcgcttttttatcaagctgcagcgtgatgtcctgtaacacaggctgaccggcataactcgcgttcaggtgagcgatacgtaacatgctgttctcctcagggtttaaccaggggcgcaacaaaacggctggtcacataactgctgtaatcattgcctgcctgcggcactttgccctgcgctttcaaaaactgcgccgtatccacaatggcttgattaacaggctgttccaactgcgtaacctgttgcgcggcggtgaggtaggtattgcccttaaccagcgccggaacctgctgttctggcacgccgcttaaacgcgcgagtttgcgcagattgtcgggctgtttaagccactgctcgggattgtcgagataggctttctgcgcctcaagggtgctgcgggcaaaggcggtaacgatatcaggatgttgctgagcgaagtctttgcgcacgacccagacatccagcgtgggcgatccccagcggccaacctgtgaagagtccgttaagacgtggccgtccttttccagcgcattcactgcgggcgcccaaacgtacgcaccgtcaatgtcgccgcgttgccaggctgccacaatggcgggcggctgtagattcaccagttgaacctgggaaggcttgatgccccagtgttttaaggcagagagcaagctgtagtgcgtggtggaaatgaacgggacggcgatgcgtttacctatcaggtcctgaggactggcgaggttttttttgaccaccagcgcctctgaattccccaactgtgaagccagtaagaaagcttcgacaggcagctgttgcgtcgccgccacggctaacggactggacccaatattgccgatctggacatcacccgaggccagtgcccgcagtacgcccgcgccgctgtcgaatttgcgccacgcaaccgtcgcaccgctctctttggcaaaggtgttatctgcctgcgccactttggccggttccgccgaggtttgataagccaccgtcacattgaccgcgcaggcctgaaaggccagcagtgacagcacagaagccagaatcgttaatcgccctttcaacatgattttttcccatcacttttatgatgtgggcagtgttgctggcgagattaatttcacaaaggaattaaaagttatccctaatagaaagaaattcttagatcatcatctgcaatagattgccgttatatgcaaattaaaattcagacaaaaagccataaatttgtcaggcgctcacatgcaggttgtgctattgatatgcgctattatttgctccctggtgaggtctgcgagttcgatgtcgatcgacaaagttgccctgttagctggcgtgtctaaggccacggtatcccgcgtgcttaacgctcacccaggtgtgaaggcggatacgcgtcagaaagtgctggatgccatttccacaagcggctatcaacccaacctgttagcccgtcaactgcgtacctcgcaaagccatatgttgctggtactgatttcagatatcaccaatcccttttgcgcccgggtggtgcaaggcattgaagcggaagcagaaatgcacggttaccacatcctgctgtgtaattctgcctcacagtttaaacgtgaggccgcttacctgacgctgttaacaggcaaagtggttgatggcgtcattacgatggacgcggcggccggcctgcaaagccttattgatatcatcggcgattcgccctggattcagtgctgtgagtttgatccacagattgcggcctcctcggtctccattgatcatcttgaagccgcccgtgacaccatacattaccttgccgccaggggccgcaagcgcatcgcgctggtgaatggcgacatgcgttatctgtattcccagtatcgtgagcagggctatcgccaggccatcgaacagtcggatttaggctgggcagaggtggtgtataccgaaggcatttcctgtgaggaaggcagccgggcgttacaggagatgttgcgcctgccagaacgaccggacgctgtctttgccgtttccgatgtgctggcagttggcgtggtccatgcggcgctggaagctggcttgcgcgtaccggacgatctcgctgtggtcggttttgacggtatcccgtttaccagtagcctgaatccgccgttgaccaccatagagcaaccgatgtatcagttgggtgcacgcagcgtacagttgctcctgaagaaaattcgccagccgcacgcgccagttgtcagggaagtgttaccctggaaacgcctggagcgtgcgtccagttaggatcagtgccagatcagcagtacgcacgccgccgttaacagtcccatgctgaggttaaatattttccacgcgcgcggactgcgtaaaatgcggccgatcatggcgccaaagcccatccagataatgcccgccaccagattgaccataaacatccccccgctgattaacagtacagagtgatgataaccggcaccggccaggctaaagctcgctatcgcccccagggccattaaccaggctttgggattgatcagctgcaacaatcctccctgccagaaaggcatgggcgcgaccggcaccgcatcggtctcgagcttttcataggccgcagtggcgattttccatgccagccacagcaaatagaggctaccggccactttcagaatcaagtgcaatgagggatagagcagaatcaatcctcctacgccaaacgccaccatgaggagcatcagctgcataccaatcatgatgccaaccatcaacggaatggtgcgaataaaaccaaagttggcacctgaggcggtgagtaacatattattaggtccgggtgttatcgccgcgacccagagaaaccctaacagtgataaaaaaagactgagttccatttaaccgggttctccctccattatgtaaaaacttatcgaagctaacagtgtgatatggaacagacaagcctttacaacatgaaattttcgggcccggatggcgcggcgtttatccctgtgcgcggcctggcgaatcctcatctgcaaaccctgctgccgcgcctcatccgccgcacgataagagtcacgcctcactggcaacggcttgatttacccgatggtgattttgtcgacctggcctggagtgaagatccgcagtttgcacagcataaaccgcgcgtagtgttgtttcatggtctggaaggcagtttccacagtccttatatccacggcctgatgcaggtttgcaagcaacgtggctggctggccgtagtgatgcattttcgcggctgcagcggcgagccgaatcgtctgaaccggatttatcactcaggagaaaccgaggatgcacgctttttcctgaactggctgacgacgcgctggggccgcgttccgaccgccgcggtggggttctcactgggcgggaacatgctgggttgcctgctggggcaacagggcaatgatgccgtcattgatgccggcgttattgtttctgcgccgctgctgcttgagccctgcagcgcccgactggaacgtggattttcccaggtttatcagcgttacctgctgagccagcttaaaaaaaatgcccaacgcaaactacacgcatggcctgacactttacccatagatcttaaacagctcagcgcgctgcgccgcctgcgagacttcgacgacgcgatcaccgcccgcgcacatggctttgccgatgccacagattattatcgccgcgccagcgccatgccgctgcttcgctcggtggcaaagccgttgctgatcatccatgcgaaagacgacccgtttatgagtgatgaggtgatcccgcagaatgaccaattatctgccactattacctatcagctgacgcgccatggcggtcatgttggctttgttggtggcaccttgcgtcagcctcagttgtggctggaacagcgcgtgccacagtggatttccccttacctggatagctaaccctgtgatgattccctggcaacaggtttcccccgaaaccctcgaaaatttaattgaagcctttgtcctgcgcgaaggcaccgactacggtgaacaggaactcagcctgacggaaaaagtcgccgatgtgcgacgtcagctgcagcaaggtgaggtggttctggtctggtctgagcttcacgaatcggtaaacatcatgcgcaaaagcgagtttcgcggctgatgcacagaatgaaaaatcgtgctaacaatgctcatcgcccgacttcacagggagttttactatgtctgcacgccatccgatcattgcggtaacgggttccagtggcgcgggaaccaccaccaccagcctggcattccgtaaaatttttcagcaactcaatttgcacgcggccgagctggaaggtgacagctttcaccgttttacccggccagaaatggatatggcgattcgtaaagcacgcgatctgggtcgccacatcagctattttggcccggaagcgaacgactttggcctgctggaacaaacctttattgaatacggtgagcacggcaaaggccagtcacggaaatacctgcacacctacgacgaagccgtgccctggaatcaggtgccgggcacctttacgccgtggcagccgctgcccccggatacggacgtgcttttttatgaaggactgcacggcggggtgatgacggctcagcataacgtcgctgaaaaggtggatttactggtcggcgtggtgccgattgtcaacctggagtggattcagaagctggtccgcgataccggtgaacgcggtcattcccgtgaggccgtcatggattcggttgtgcgctcgatggaagattacatcaacttcataacgccacaattctcacgcacccatatcaactttcagcgcgtccctaccgtggatacctccaacccgtttgcggcccgcaccattccttcgctggatgagagttttgtcgtcattcactttcagtgtctggaagatattgatttcccttatctgctggccatgctgcagggatcgttcatttccaatatcaatacgctggtggtaccgggcggaaaaatggggctggcgatggagttgattatggcgccgttggtgaaacggcttatggaaggcaaacgcattgaataaaatcagaggccgcgcgggcctctgagagatcacagctcgataacctcgtagctgtgggtgatcgcgacccctttgcctaacataatggcaaccgagcaatatttttccgccgacaggtcgaccgcacgcgccacggctttatctgaaagtgcttttccactcacgataaaatgcaggttgatacgggtaaagatgcgaggggcttcttcccgacgctctgattcgagttttacttcgcaatcagccacatcgttgcggcctttttgcaaaattgaaaccacatcgattgcgctgcaaccaccggccgccatcagcaccatttccataggactgggcgctttatcaccggaattaccatccattaagacctgatggccggatgatgattcgccgaggaatgttaacccttcaacccatttgactcttgcctgcataatttcgcccccagaataccctgtttttgcgccagagtacgcttttgcctggtaaacagcaatccagagaaatcagcctcattgctgaagcgagacaacacaagacagtcggcgaaagctgtgctacaaacagtgctgaaaatattttttcgtcatccgaagatgaagccgggaagaattatgcgcactgcgccgaatgcagcccgaataatttcctgaatggaaacacgcttaacgctttcatcgcctggcagggaaacagagccctgtattttgggcacgattacaatagaggataatagcgaatggttctcggcaaaccgcaaacagaccctacacttgaatggttcctgtcccattgccatattcacaagtatccatccaaaagtacgctgattcatcaaggtgaaaaagccgaaacgctttactacatcgtgaaaggttccgtcgcggtactgattaaggatgaagaaggcaaggagatgattctttcttacctgaatcaaggcgattttattggtgagcttggcctgtttgaagaaggtcaggaacgcagcgcctgggtacgtgcgaaaacggcgtgcgaagtagcagaaatttcctacaagaaattccgtcagctcatccaggttaacccggatattctgatgcgtctttcttcacagatggcgcgccgtctccaggtgacgtcagaaaaagtgggaaatctcgcgttcctggatgtcaccggacgcattgcacagacgttgcttaacctggctaaacagcctgacgccatgacgcatcctgacggcatgcaaattaaaattactcgtcaggaaattggccaaatcgttggttgttcacgtgaaaccgtgggccgtatcttgaagatgctggaagatcagaatctgatctccgcacacggcaaaaccatcgttgtttacggcacccgctaagccttattattcacggcgtgatggcaacattatgccgtgaatatcttgtgttgagcccatgtggcgaagaataatttatcaccccgaagttaactatgcgctgcgccagactctggtgttgtgccttccggtcgcgctcggctggctgtttggcgatctgcaaaaagggttgctgttctcattagttcccgcctgctgcaatattgctggcctggatacaccgcacaaacgtttctttaagcgcctgattattggcggcagcctgtttgcctttggcagtttgctgatgcagtggctactgctcaaagacgtccctctgccgttgattctgtttgcgatgccgttactccttggcgtcaccggtgaaatcagcccgctgcacgcccgactgctacccggtacgctcattgccgcgatttttaccatcagcctgattggccgtatgcccatttacgtgcctccgctgctctatatcggcggtacgctctggtacggattattcaactggttttggttctggctgtggaaagagcagccgatgcgcgaaagcctgagtttaatctaccgtgagctggcaaattactgtgacgcaaagtacagcttgctgacgcagcttaccgatcctgaaaaagccctgccgcccctgctggtgcgtcagcaaaaagcagtcgacctgattaacacctgctaccaacagatgcatatgttgtccgcaagccgcgatcacagccataaacgtctgacccgggcatttcaggtggcgctggatttacaggaacatatctccgtcagcctgcatcagccggaagaagtccagaagctggtggaacaaagccatgcggaagccgttatccgctggaatgccaggacgatttcagcccgactgcgcgagctggccgacgatattctgtatcaccaactctccagccgttttgatatggacaagcagctgggtgcgctggaaaaaatcgcccgccagcatccggacaatccggtgggtaacttctgcctctatcatttcagccgcatcgcccgggtacttcgtacccaaaagccgctttatcaacgtgacctgatggccgatcgccagcgtcgtttgccgctgctgcccgcgctgcgaagctatctgtcgctgcgttcttccgcgctgcgcaccgccggtcgttttgccgtcatgctgatgctgggcagcgccctggcggtgtttttctccattccaaagccctactggattttgatgacaatcatgtttgtcagccagagcaactacagtgcaacccgggttcgtatccagcaccgggccctgggcacctttgccgggttggtcattgcggcagcctcgctgcgcctggatgtgccagagccgctggtgttgagcatcatgctggccattacctttatcagctatcgctttacccgacagttttacggctggtcgatggtaggatttacggtcacggccgtttatacgctgcaactgctttcccttaacggggcacagtttttattgccccgcctgctggatacgctgatgggttgcctgatcgcctttggtggcatgttatggctgtggccgcagtggcagagcgcgctgttgcgtcagaatgcgcatgatgcactggaggcctgtcaggacgcgctgcggatgttactcggcccggagcagtctccagataagctggcttaccagcggattaaggtcaaccaggcccataacgcggtgtttaattccctgaatcaggcgatgcaggagccgggatttaactcacgctacctgcaggatatgcgcttatgggtcacgcactgccagtttattgttgaacacatcaatgccatgacgattctggcgcgcgaacacaccatgctgccgcccacgctggctgagcactatctgcaatggtgcgagattgcactgcaacgttgccagcaacgactggaatatgatggggaaagttcgcagacggatctgctgcagggcgttgaagatattaacgaggggcccgtcacggtgctggagcagcacgtccggcgcattcttgatcatctgaaagtgatgcacacgatctcatctttggcctggaaccagcggcctcatcatggccgctggctgatgcgcagtctgcgccggaaataactcaggccgacagcaccttctctaccgcgttggcaaagcgcgtcatgccctcttctatatcggcaggctcgataatcagcgatggcgcaaagcgcatcacatcggtcccggccaccagcaccatcacgccttctgcggctgacgcattcaggatatcgcgcgccttgcccgcatgctgcggtttcagggctgcaccaatcagtaaacctttaccccggatatcgctgaacagatcgtgacgcgcatcaatcgccttaagggcctcaacaaactgctgacgacggatttccacgccattcaatacctctggtgtattgatgatatccagcgcggtttctgcaatcgcacaggccagcgggtttccgccataggtggtgccatgaacgccaggtgccatggttgaggccacctcattcgtggtcagcatcgcactgaccggaaaaccaccgcccagcgccttcgccgaggtcagaatgtctggcgtcacgccatagtgctcataggcaaacaatttaccgctgcgtcccatgccgctttgtacttcatccagtaccagcagcgcctggtgtttgtcgcacagttcacgtaagccctgcagaaacgctggcgtggccggcatcacaccgccctcgccctgaatcggctccaccacaatcgcgcaggtatgatcgtcaatgacggcttttaccgcatccaggtcgttgaaaggcacgtgaacgatatcggcgggtttcggaccaaaaccatcggaatactttggctgtccgcccaccgtaacggtgaacagcgtccggccgtggaaggcattatgaaaggcaataattttacttttaaacgggctgtgacgtttgcaggcataataacgagccagcttaaaggcggcttcattggcttccgcaccggaattagcaaaaaagacgcgctccgcaaacgtggcgttgatgagtttactggccagccgcagcgcgggttcattggtgaacacattgctggtatgccacaaggtttcaccctgtttcttcagggtttcaaccagcgccgggtgacaatggcccagtgcggtgacggcaatcccgccagagaagtcgatatactctttgccctgctgatcccagactcggctccctttgcctttcaccggtacaaactgtgcaggtgcataaacaggcaaaataacctgatcgaacgtctcccgcgttaccgccatattttccgctgccattgacaacctcgttaactggttcgttgagtcaagatgaaataataatcatgaaatatgcataaaaaatcacttaaaggcaaacacaacttcattgattcaggaaattagctaacagcaggtgcccctgctcactgaggatgctctcggggtgaaactgcacgccttccagcgccagggttttatggcgaatccccataatctcatccggctgaccgtcgcgcaggctccaggccgtgacatcaaattcatcaggcagcgtatccgctttaacgataagagagtggtagcgcgtcacggtcaatggctgattaaggccacggaacacaccaccaccattgtgctgtatcgccgaggttttaccatgcatcacgttgcgggcacgcacgatctgcgcaccgaaaacctgagcgatggcctgatgacccaggcaaacacctaacaccggaagacgaccggcgaagtggcgaatggcctgcaacgaaataccgctctgatcgggcgtacaggggccgggcgagatcaccaaatggctcagcggcagggcgcgcatctcatcaagagtgatggcatcatttctcactacccgtacgttggctcccagttggcaaaaatactggtagaggttccaggtaaacgagtcgtagttatcaataagcagcagcatggttatggtttcaggcagaccggaaggatgcgcgcatcgctcggcatccagagtgatgtccagagcggcatcttaccatgctgttcatggtgagtgtgatgcggggaagcaggaaagcccatgtcgcacagggaggcacactgctggcgtctcccttatgctgcaacggttcagacagctttggcttcactgacgatgctggcgaaagccttttcaagcagttgcacatcaccggacgccccggcctgatttgccgcaacccatgcttccgcgctcagactgtcccatgcaagcaggtagccggcatgcagagccaactgctcgaagaaaacacgctgcgccctgccgttaccttcgcggaagggatgcagcatattgatttcacagtagtaccaggcaatccgcttcgcgaaatcagccagagggagatcggccaggcccttctcgtcttccagtgctgccagcagcgcattcccctctttttcgatgtactcgaaatggcagaaaggggtttcgtcgcgccagatgtcgagcgtacgcagttcgccagcccagctgtaaacgtcctgaaacaacgtacggtggatatggcaaagatagggtaatccggcgttgcgcgggcccagttcaagcgtggcgagtcgtgcggcactgaagcttaactcggctttacgcagctgtgccgcatcgtgaataccgagacggtttttcaacacagtgtcgttttgccacaggtaggggtcctgagtaacggcagtattagcagccatattgcctcctcagtgaggccaggcgctcttctgcatcttcacccttgatttctggttctgtcagggtaaagccttcgagtcggcaacttgcccgatagctggcatgtcgccgctgttgccagagcactgctttttgtttatctgtgagtgtgtttgccataccgcctcctgctcaggtttgccctaagtataagagcaaatttcccctttgccggagacgagatggcattacaccgaattagggtaaaactttagccgacagaatgaccacgggcttgatggggacattctgataggggcccacgtctttagtcggcacctgagagattttgtccacgacgtcctggccttttacaatcttaccaaacacggcataaccgaaatcgcgttgaccatgatccaggaaagcgttgtcagtaacgttcaggaagaactggctggttgcgctgtctttatcggcggtacgcgccatagagatagtgccacgcagattgcgtaagccgttatccgcttcgtttttgatcggcgcgttggtctgcttttgctgcatttcactggtgaagccaccaccctggatcataaagccaggaatcacgcgatgaaaaatcgtgttgttgtaaaagccgttgttcacatagtccacgaagtttttaacggaaaccggcgctttttgattattcagttcgagttcgatattgccggcagaggtgttaagcaggacatgcgtatcacctttagccgctaaagctgagacggaaacagaagagagcgctaacagggcaactgccgctgtcaaagtacgtttaaacatgagtaattccttactttggagagctagctcaaaaacgatattgattgtaaagagcatgtaatacaagagccagcgttttacctatatttacgctaacaatgcgcactatagctggaataaagcggcttccgcttcgtgactaaaatcacagtattgatgaaatgaatgacatctgttttcactgttagtttattaagatcacggttacgtttacaatttctgacgcttcaggccctccggcttctcaacaggttcagaacatgacaaatcgtaatcgtatcggccttacctggattagctttctctcgtacgcgcttaccggcgcactggtgattgtcaccggcatggtaatgggcgatattgcgaaagatttccagattcctatcgacagtatgggtaacaccttcaccttcctgaacagcggcattctggctgcggttttccttaatgcctggttgatggtgattgtaccgctcaaacggcaactgatttttggctttgtactcatggtattagccgttatcggcttaatgaccagccgtgatctgtcggtattttcactgtgcatgttcgtacttggcgtggtcagcggcattaccatgtcgattgggacattcctgattacccacatgtatgaaggccgtcagcgcggttcacgcctgctgttcacggattcgttcttcagcatggcaggcaccattttccctgtgcttgccggtattctgctggcgcgccatctgccgtggtactgggtttacgtctgcattggtgtgatttacgtcggcattttcatcatgacgctgtttgttgagtttcccgtgctgcgtaagccagagaacagcccgaccgtcgagaaagaaaaatggggcgttggcgtgctgctgctggctatcgcggcgctatgctacatcctgggtcagttaggctttatttcctgggtgccagagtacgcgacgaaggtcatgggcatgaacatcgacgatgccggccaactggtgggaagtttctggactgcctatatggtgggcatgtgggcgttcagcttcctgctgcgcttcttcgatctgcaacgtattctgatggttctggctggcctggcgacggtgttgatgtactggttcgtgagcagtcacgacgcgggcatgctgaggtggatcatcttaacgctgggctttagctctagtgcgatttacaccacgattattaccctgggctcgctgcaaaccaaagtcgcctcacccaagctggttaactttatcctgacctgtggcacggtcggcaccatgctgacctttattgtcacgtcaccaattgtgaaaaacagcggcgttcacagcgcgctgttaaccgcaaatggcctgtacgcggtcgtgtttattatgtgcgtactgttaggtctggtaactaaacaccgtacccacggtcacaacacgcattaatcccgtcgggcggcgttaccgcgccgcccacgtgttttagcgtttaaaggtcacgtcttcccactgttctaaacagatggcgctgttggcaggctgtgtcgcggcgataacgtttccgcgacgaagcgaataacgcaccggcacttgccttcttactgcgtcgaaaccattctccgctggcagaataatcaagctggcatcatgaccgcgctgaatgccatatcctgaaagattcatcgttctggcactgttgtgggtgatcagatcgagcccggcattgatttgttcatagcccatcaactgacacacgtgtaatcccatatgtagcacctggagcatatttcccgtacccagcggataccagggatcgaacacatcatcgtgaccaaagcagacgttgatgtccgcctccagcagctctttgacgcgggtaatgccacggcgtttgggataactgtcgaagcggccctgtaaatgaatattgaccagcggattggcgacaaagttaatgccggagagcttcagtagccgaaacagacgcgatgtgtaagccccgttataggagtgcatcgccgtcgtatggctcgcggtcacccgcgcgcccatgccgtcgcggtgtgccagcgcagccacggtttcgacgaagcgcgactgctcatcgtcaatttcgtcacagtgcacatccaccagcctgtcgtaacggttagccaatgcaaaggttttatgcagggactccacgccgtattcccgggtgaactcaaaatggggaatggccccaacgacatcggcaccgagtcgaagcgcctcttcaagcaatgcttcgccattgggataagacaggatgccttcctgtggaaacgccacaatttgaagagtaatccagggtgccatctcggccttaagttccagcatcgccttgagtgccgttaaggtgggatcggacacatcgacatgggtgcgaacacactgtatgccgttggctatttgccacttcagcgtctgcatcgcccgccgtttgacatcttcatgactcagcaaggctttgcgctctgcccagcgttcaatgccctcaaacagcgtaccagactgattccaggcaggctctcccgcagtttgcgtcgtatccaggtgaatatggggttcaataaagggcgcgagtgccaggccgccttccgcatccagcgctgcgccgtcggcggctatctgctgaggctgtgccgaaatacgggcgatttttccttcatcaatttctatctgccacaggccgtcacgcgtgggcaaacgcagattattgatccagcgaagtggtgcggttgtcatacctggctcctgatgagttaagcgctactgattaaagctaacacgttagcgctgccctgctccagatgactttgtgaacttcacgtgcaggacgctgaatcgtgacactcaccctgaagaggtatatcgcattacgattgatgtacatcaataagcgccagacaagccgcgctattgtagccgcagatatcgcaaatttgaggcaaaaatgagcaatcacagtgtcgtcattatcggtaacggcatggtcggtcaccgcttcatcgaagaactcatggataaagccgcgcctggtcagttttccttaacggttttttgtgaagaaccccgtgtcgcctacgatcgcgttcacctctccgcttacttcgctcaccataccgctgaaaaactttcccttgtccgggaaggctactacgaaaaacatcatgtcaatctgctgctgggcgagcgtgccatgaccattaaccgtgatgaaaagcgggttcactccagcaccgggcgcgccgtgcattatgacacgctggtctttgcgaccggctccgtcccgtggattccgcctgttgcgggcgcagagggcagtggttgctttgtctaccgtacgattgaagatctgaatgccattgaagcctgctcgcgtcgtagccagcgcggtgcggtaatcggtggtggcctgcttggccttgaagcggcaggtgcgctgaaaaatctgggcgtcgaaacccacgtgattgaattcgcccccgtgttaatggctgagcaagtagaccaacagggcggtgagctgttacgtcgtaagatcgagcagatgggcgtgcaggttcacaccggcaaaaatacccagcagattgtgcatcatgataacggcggcaagacattgctgttcgctgatggcagccatctcgatgtcgactttatcgtgttctccaccggtatccgcccacaggataagctggccaaacagtgtggtctgacgctgggtacgcgcggcggtatcgccatcaacgaccagtgccagacaagcgatccggctatctacgccatcggcgagtgcgccgcctggcacaatcgtgcctatggactggtggcgccgggctataaaatggcgcaggtggccagcgatgtactgttgggccgcactaatgcgtttgccggtgccgacatgagtgccaaactgaaactgctgggcgttgacgtgggcggtattggtgacacccgcgccagcacgccgggtgcccgcagcattgtctggctggacgaggcgaaatccatctacaaacgactgattgtgagtcaggaccacaaaacgctgctgggcgcggtgttagtgggcgataccgccgattacggtaatctgctgcagttggtgctgaatgccattccgctgcccgccgatccggaaacgctgatcttacccgcaggcagcggtgaaaaagcctcgattggggtggacgcgctgcctgccagtgcgcaaatctgctcctgctttgatgtcagtaaaggcgatatcgttaacgccgtgaaaggcggttgtcacactgtcgccgcgctcaaggccgaaacccgagccggcaccggttgtggcggctgtattcccctgatcacccaggtcctgaacaatgagctgagtcatcagggcattgaagtgagtaatcatatatgtgagcacttcccctactctcgtcaggcgttgtatcacctgattaaggtagaagggattaaaacctttgctgcgctactgacgaagcacggccatggctatggctgtgaaatctgtaaaccgactgttggctcgctgttggcgtcctgctggaacgagtacattctgaaacccgagcacgcctctctgcaggacagcaacgacaacttcctgggcaatatccagaaagatggcacctattctgtcattccacgttcaccgggcggggagataacgccacagggacttaaggtcattggcgacatcgcacagcagtatcatctctacaccaaaatcaccggctcccagcgtattggcctgtttggtgcgcaaaaagatgatttacccgccatctggtcgcagttaatcgccgccggatttgaaaccggtcaggcctatgccaaagcgctccgtatggcaaaaacctgtgtaggcagcagctggtgtcgctatggcgtgggtgacagccttggcttcggcatcatgctggagaaccgctataaaggcattcgcacgccgcataaaatgaaattcggcgtgtcgggttgcacccgtgaatgcgccgaagcccagggcaaagatgttgggattatcgcgacggaaaaaggctggaacctgtatgtgtgcggtaatggaggcataaaaccccgtcatggcgatctgctggcggcagaccttgatgacgcgacgctgattgcttatctggaccgctttatgatgttttatatccgcaccgccgatcggttacagcggacctcactgtggctggagagccttgaaggtggtatcgactacctgcgcagcgtcatcgttgatgacagcttagggcttaacccgcagctcgaacaggatctgagcattctgcgcgccagcgccgaatgtgagtggcaaacggcgctacaggacccgcaaggcctggtgcgttttgcccatttcatcaatacacctcagcgcgatcccaacgtacagatcgttgccgaacgccttcagcatcgtccggcgcgcccggatgagcgtatcgccgtcacgctaatcgaggagaacacactatgagtgaatggacccgcgtctgcccgttagcgcagatcctgcctgccaccggcgtctgtgcctgggtcagtggtcatcagattgccgtcttccgccccagcgctgatgatcgcgtatttgctctcagtaaccttgacccttttgcagacgccagcgttctgtctcgcgggattatcggtgaacatcagggcgaactgtgggtcgccagcccgttgaaaaaacagcgtttccgcctgcgtgatggatactgcatggaggatgcatcacgctctgtgccggtgtatccggtccgcgtcaatgcaggccaggttgaggttaaggcactgcccgcgcggatttagcgccacctgttccccaaaacgattatcatcgtttatccctctcaagccagcccgtgaatacgggcttttagcaggactggctatggactatttcccgcttttttgtcgtctgcaaggcaaacgctgcctgctggtgggtgccggcgacgtcgccgagcgtaaagcccggctgctgctggccgccggggccagcctcagcgtgggcgcactgaccttttcttctgcttttcagcactgggcgcaagcgggagagctgaccttgatacacggtgattttcacccggactggctggcgggctgctggctggtcgtcgcggccaccaacgatgagggggttaatcaacaggtcgccgacgtggctgaaacacagcaaatcttttgtaatctggtcgatgcacccgagcaggccagtgccatcatgccctccattattgaccgctcgccgctgatgattgccgtgtcctccggcggtcgggcgcccgtgctggcaaggcttctgcgtgaaaaactggaggcgatgttgccgcagcacctgggaaaactggcccagcgagccggaaccttgcgcagcagggtgaaaaagcagttcaccgcgatggcgcaacgtcgccacttctgggaacgtttttttagcagcgacaggctggcgcaaagcctggcgaatggcgacaacacacgggcagatgaactaaccgaaaccctgttcgcagaggatcggcgaacacaaggtgaagtggtgctggtcggtgccggcccgggcgatgcggggttactgacgctcaaaggtttacagcagatccagcaggcggatgtgatcgtttacgacaggctggtttccgatgccgttctcgatctcgtgcgtcgtgatgcggaacgtgtctttgtgggtaaacgtgcaggtcaccactgcgtgccccaggatgagatcaaccagctgttgctccagcaggcccagcgcggtaaacgggtcgtacgtttgaaaggtggcgatccctttatctttggccggggcggtgaagagctggagattctggcacagcatcagatcccctttagcgtggtgcccggcattacggcagcatcgggctgtgccgcctacagcggtattcccctcacccatcgcgaccatgcgcaaagcgtacggctggtcactggccatctgcaaaagcagggctcactggcctggcagacgctggcggcagaacagcaaacgttggtgttttatatgggcctcacgcaggcagcagaaattcagcaacagcttattcatcacggcatgcgcgccgatatgcccgtagccctggtggagaaaggcaccagcacagaccaacgcgttctcaccggtacgctgcaagcgctcagcgatttagcgcaacaggttaccagccccagtctgattatcgtgggcagcgtggtcagcctgcgcgaaacattacgttggttttaaaacaataacggcgagctttcgctcgccgttgaggttatgccagcactgactaaggctgagaaacaaaacccacggcggcatacacctttttcagggtttcctgcgcctgagcacgggctttttgtgcgccctcacgcatcacctgctccagcaacgcttcatcgttacggaagcgatgataacgttcctgcagatcagtcagcatgccagataccgcatccgcgaccgcgcctttcaggtgcccgtacattttgccttcaaattcctgctccagctccgctaccggcttgccggtcacgccggacaggatgtccagcaggtttgacacgcccgccttctctttaacgtcatagcgaatgaccggtggctcttcagagtcagtcatcgcacgcttgatttttttgaccacggatttgggatcttccagcaggccgataacgttattgcggttatcgtccgacttagacatctttttcgtcggttccagcagggacatcacgcgtgcgccagatttaggaatgaacggctcaggcactttaaagacatcgccatacagggcattaaaccggctggcaatgtcgcgactcagttcaagatgctgtttctgatcttcacccaccggcacctgcgtcgtctgataaagcaaaatatctgcggccatcagcaccggatagctgaacaatcctgcgttaatgttttcttcatagcgcgaggatttgtctttgaactgcgtcatacggttcagctcaccaaaataggtgtagcagttcagaatccagctcagctgcgtgtgctctggcacatgagactgaacgaagacagtgcttttctttggatcaataccgcaggccaggtacagcgccagcgtatctaaggtggctttacgcagtgctgtcgggtcctggcgaacggtgatcgcgtgcaggtcgacgatacagtaaatgcagtggaaatcgtcctgcatctgcacccactgacgcagcgcacccatatagttgccaatggtcagttcgccggacggctgtgcgccgctgaaaacgatgggtttgctcatgcttatgtcctgataaattaccgcccgatagcgggcaaaaggtcgtcaaaagagtcaagggcgagatcgggctggctggtggcaataggttcgccatagttatagccaaaagtcataccgatattgggtacaccagccgactgcgcagccagaatatcattgcgcgaatcgccaacaaacagcagttggtcaggcaacaggccaaatttacccagcaccagaaaaatagcagcaggatggggttttttaaccaccacgtcgtcaccgccaataatcagtgaaaacgcgccatcaatccccagggaggccagcaaaggcgcaacgaatggcgtgggcttattggtgacaatcgccatcgggatgttcagcgcctgaagttttgccagcgtttctttaacctgaggaaacagcgtactgccggcgtccaccgtattggcgtaatgtttgtcaaataatacccgggcatcgcgctgctcatcctgctgaggctcgcgtcccagtgcccaggtcagggcgcgcgacatcatgatatccgcaccgttaccaatccaggtggacacgcgcccgacgccagcggcaggcaaacgcaggtccgcaagcgtcagatcgatagcatcagccaggcccggcgcgctgtcgaccagcgtgccatccaggtcgaacgccagcgcgtgaatatcagtgaaatgagccattcgctttctccagctcgttccgcatgtcgtcgatcacttttttatagtccggatgcccaaagatggctgaaccggccacaaacatatccgcacccgcggcggcgatttggccaatgttatcaatcttcacaccaccatccacttccagacgaatgctgtagccgctctgatcgatacgtttacgcgcttcacgaagtttatccagggtgcccggaataaatgactgaccaccgaaaccgggattcaccgacatcagcagaatgatatccagcttatccatcacgtagtcgaggtagctgagcggcgtggcggggttaaacaccagaccggccttgcaaccgtgctctttaatcagctgcagcgtacggtcaacatgctcgctggcttccgggtggaaggtgatataggtagcgccggctttggcaaactcgggaattaacgcgtccacgggcttcaccattaaatgcacatcgatcggggccgtaataccgtagtcacgcagtgctttcagtaccatcggtcccatcgtcagattaggaacatagtggttgtccataacgtcgaagtgaaccacgtcgcctccagccgccagtgctttcgcagtgtcttcacccaggcgggcaaagtctgccgaaaggattgaaggggccagcaaatattgtttcatccgattctccactgttgtgcgccagcatcactgctggcgaaataccctggccgcggacgaaacagactagcgataaagtgccaggagttcgtcgaccttggtgcggccggttatgcttcggctaatagaacgccggactttgaccacatgtaacacggcatcctgataccagcaacgcgtcagttcagtatcatggttagaaatcagcaccgggatttgactctccgacgccagcttcgcagccagttgcgccagatgttgctgctcattcatactgaaactattcgtatggtaagccgtaaagttagccgtcgcggacagtggcgcgtacggcggatcacaatataccacagagcctttctgggcattgttcagggtaacatcgtatgattcgcagacaaacgtcgctttttgcgcacgttcagcaaaccagagcagctcggcttccggaaagtaaggtttgcggtagcgaccaaaaggcacattgaactcgccgcgcaaattgtaacgacacaggccgttgtaacaatggcgattgagatagaggaataacagcgcacgctgataagcgtctttgctgagattaaattcagtacggagctgataatagcaggcttcgttattgccttcaggcgtgaacagcaaacgcgcatcgcgaataaaatccgccgtacgcgttttcacgatgttgtagagattgatgagatcgttgttgatgtcggccaggtgatagcgatcaaaatcggagttgagaaacactgagccagcgccgacaaagggttcgatcaggcaatcaccttgcggcaaataacggtggatctcttcgactaagggaaattttccccccgcccattttaaaaaagcgcgattttttttcatgctgtcgtggtatttacatcttattgtgaggctgtggttgaaccgacagcagatctgcgcttaaaacgggaccagcagctgccggccccatatcatttattggctggcttctttcctgacctgactaaccggtttcacccatggattctgtgcgcgcacttcagcaggcaacgcagctacggcacgtttcgcgtctgccggtgttgcatatgcaccacttaccagcacataccagggctggccgttacgcgttgttttatacacgtgatacgcgctcagattttgtttcttcgcccaggcattcaggctctctgccttcgacgcaccgctcagctgcagcgtataattaccgccaggcagagatttactcgccgttgcaccgttgccagcggctttagcaggcgcattattcactgcggtgtgcgctggcgtggtgtgggttttatgttcactggccgtcggcttagcggcggttttcgccggctgctcacgcgtatggcgtggcgtcaatgcggcctggcctgcgttggtacggcctgctgcgggcgcattggctgcggcggcggaaccggctttgccactgaccgttgcgggagccgtaggcagtgagctgctgttttctgccccctgagccgcgccatcaacctgctgctgttgattcgtcagggcggtgttcagatcgccaggtaaagtaacacgctgctgattcgccggggtttcaacaggcgcggcctgcgtcggcgtagacgcaactggcggcatggaaatgtcgcgtggcgcattcgtcgcctccggagaagatgccgtgccaggtgcattctgggttgtcgcagacggtgatggcgtcccggcggcattctgtccaccgctcatggcggttgagccactcaggtcaatatttttttcgctgccagaacctgtcgagccagtagcaggcgtgctcttgttgccattggccgaagaagacttactgtcgtcagaaccattcagcgcagagccaattcccagcactaccagcagtaacaccagaataccaacgcccatcatgacatgctgacgcgataccggtgctttcgtcgcagaagacgatttacgtgggcgcgagggacggcggtcgctggcgtcaggttttaactcatcatccggtttgaattcatcatccggtttgaactcatccattctgcctcctccgtaaagcggcatcccgcactgcgcacccgcgcgccgcgtcaccacttacctgcttaatatcaagatttctggcaatcattaattgcagccatcaccatatcatgagctacgccaccgcgcacttcagcacgtccaatcgacagcggcagtatcagacgcaattcaccagccagaacctttttgtcacgcatcatatgcggcaaatagtcttctgcctgcatctctaccggcccgttcaccggtaaaccggcacgttgcagtaaagcaatgacgcgatcgcagtcctgtgcgctgaactggcccagacgttgcgccgtgcgcgccgccatcaccatcccagcggcaatcgcctcaccgtgtaaccagttgccatagcccatatgggcttcaatagcatgaccaaaagtatgaccaagattaagtaatgcgcgctggccgtgctcgcgctcatctgcggcgacgacctcagcctttaactcacagcaacggcggatacaccaggccagtgcggattcatccagcgccagaagacgatcaagattctgctcaagccactgaaagaattcaccgtccagaataatgccgtacttgatgacctcagccagaccggaagccagctcacgcggcggcagtgagcgaagacactcggtgtcgatcacgacagacgcgggctgataaaacgcgccaatcatgtttttgccaagaggatgattaacggccgttttgccaccaaccgaggagtcaacctgggacagcagcgttgtcggcacctgaataaaacgcacgccacgctgatagcttgccgccgcaaaacccgtaagatcgccaataacaccaccgccaagcgccaccagcgtggtatcacgaccatggggtttttgcagtagtgcagtaaagacctgatccatcacggcaagcgttttaaattgctcaccgtcgggcaaaatcacctgatccgttttcacccccgccgccttcagcagagccgataccttatcaaggtagagcggtgccagcgtctggttagtcaccagcatggcattatcacccgcttttaacggccaaaaagaagccggatcgttaaacagtccggcggcgatagtgatggggtaactacgttcccccagtgaaacggtgatcttctccatggtgctcgatacctgtcaaagagccttcaaacgttggatcaacttttttccaacatgttgataatctgattcgccaccacttttgcactttgatcgtcagtgcggatggtaacatcggcgatctcttcataaagcgggttgcgttcatctgccagcgcttcaagcacttcacgtggcggcgactctacctgcagtaaggggcgttttttatcacgctgtgtacgtgccagttgtttctcaatagtggtttcaagataaaccacgacgccgcgggcggagagacgattacgtgtttcccgggattttacggagccgccaccggtcgccaggacgatgccctgcttctcggtcagttcattgatgattttttcttcacgatcgcggaagccagcttcgccttcaacgtcaaaaacccagcccacatccgctccggtgcgtcgctcaatttcctgatcggaatcgaagaactccatattgagttgctgagccaactgacggccaatagtgcttttgccggcacccatcggcccaaccagaaagatattgcgtttctctgccattttgtcggtattactaagaattcgttaatgataccccgctttcagcattttgctggcgggacaggaactgagacctcatgagcgttagcaagagtcagacgaaaaattatctcaacactcaaggctgtttggcaaccgattatattgctaacagcacatccatttctgaattggcccgtcgttcgcgaaactgtaatgcgtcagtacagcgttgtgacatcactgcttacagaggaattctctcatctgtttgcctggtttttccaacacagacgcttacaacgtgttaaaaatcgctaaaccttgtaagctaattccagccctgcgtcaacgcagttggactttatgggcacattttccgttttatcgtgccgtaagcgctgcttccctgaccaatcgcggcgtcataaaaataaccagctcacgtttcttatgttcttcggactgctgtcgaaacaggttgcccacagcgggaagatgaccaagcagtggaacctggcgctgcccgcgcgtgcgctgctgatggaaaatcccgcccaatgccagggtttgcccgtcgttgaccgtcacctgggtttcaatttcctgcttatcgatagacaggacctgtgaatcaccggtctgaatcgcgcgccccggtacgttctggctgatacgaatttttagctgaatgcggccattgcctaaaacggttggcgtcacttccatgcccagcaccgcctctttaaactcgatactggtcgccccgctgttgcccgcggagacttcataagggatttctgttccctgtttgatggtggcggtttgttgatgcgaggtaaacaggcgtgggctggcgataatttcgacctgattctcctgctccagggcgctgagttctaaatccaggagtttacccccaattcgcgacagtgtgacgccaaccgagacggcgggcgaattcagccctaacgggatatcaagcagaggatgacgtaacgcacggtcaacgacgtcgcccgcattgtacagccgccagttaacgcccagctcatgcaggtgatcttcgctgatggtgacgatatgtgccgccagttccacctgctccagcggtacatcaagcgcgcgcacccagcgctcggtttctttcagggccgccgcgctgtcgcgcagcagcacgctgttcgtccggctgtctaccgtggcgcttcctcttgctgtcatcagcgactgacgttcgccctgcaggctgcgatggacctcactggcactggcatagtgcaggcttatcctgcgctgttgtaggggctgttgctgcaacacctctgcttgctgcgcctgttccgcctcgcgccgctgctgttgccagtgctctggataaaccagcagaacgttgtcctcttccagcaaggtcagccgcgccatgcgggcgaccagcgacagcgcctgctgccagggcacgttatccagccgcagtgagagcgtcccctgaacctcgggggaaatcatcaggttgatctgttgataatcggccagtgcctgtaaaacccgctcaatgggcgcatcgtcaaaggccaggctcaagccctcatcatggctggcgcgggcggacgtcaggcagatcagcagaaacgtcagaatcgatatccttatcatgcgggcttcctttgagatgaaaggtgaaatattgagacgaacagctaccgggcaccgacagcttcagtgtgcgcgacgtaaactggtctgtttgccagggaagcaggggaaagggttggtcgctgagcactttcacggcgttaccctgcggggtcaggagccagccctggaacctcggcgcacggccgataattccctgtaagcgccattcgctgagcggttcaacttctgccacacaagccacgccggtaagaggacgaaacggatcgcgcgcctgcgcaatgccgcagcagagcaggagcagcatgacgctaaaaggtttcatcagcgtccagccagagctgcgccaccaggtgcgccgggtgtgcggtgagttgaaaacggccagggaaagccgtcgcggattgggacagcgctgtaaaaaggggctgaaactgcgaccactccaggtggagcgtcagcgcccgcggctgttcatcgctaagccacgcctccagttgtgcgcctcgctctgcgataatggcctccagcgtcagttgcgctgcaggttgcctagtcgccgcctgcgccagctcagcctctaacacgtcaatgtcaggatgccgggccagttgcacctgctgctgttgcaggcgttgctgctgttgtgccagctggtgcatggcagcgtctaacgcttgccgctgtggcgctaacaccgtccaccaggcaacaaagaacaggccggaagcagccgccagcaggctgccatagcgaagcggcacggctaactgtagccagaactgaaacccgttactcactgttctcctccttcagcctgatccgcaacgtgaagtggtaatccccttctgactggcgctgcacattgccctgtctaatctgtgaaaaaagcgccacgcccgttaaacgctggcgaaaatggcggatatcctgcatctgctgcgccttgccctccagaagcaaatccgtattgcgcttctccaatcgggttaaccacagcccgtcgggcagcaagccgggcaagtccagccaaagctgttgccagacgctaaactgcctggcctgctgacgcagccagctgcggcgttgctgtacctcggccagctgttgcagcagcagtttttgctgttccacgcgctgcacaagcgtctcaagggcacgcgtaagccggatatgctgaagttcaacctgagtgagcgcctgatgcccttgccagaaccgcagtgcgaccgctgacactaaaatcagtaacgttatggccagcgcaacaaggccctggcgtcgttggcgttgccagcgccagcgacgccagggtaaaaggttaaccgcgaccattagcgatcctcttgtcgcaacgccaggccggtcgccagtacaaatgcagcggggttgtcaggcaaaggcggcgagggacagcgcaacagttgcaaaggtgaaaaaggtgaaaaaggaaccgtaccggcgggggatgaaacgctatcagcatcacaataaaaaacgcggcttgcctgaggaaaagcctgcttatgcagcgccgccagcccgccctcatcggcaaaagatgcggcgttgatgccgtcactccacaggtagcgtgcatcctgtcgtaaaaccactacacttcccgcagttaattgcgcctgttcagtaacgatattgagcgcctgggtggcaagttcaaatacgctgggtttcagtcctgcctgtgccagcggagcgtgccactgtttaaccacatccagccgggcggccgtgacacacagttgcccatgcgcggggtcgagacggtaatccagcgccagttcgcgcggatcaacgggaaaaagacgttgggcagccgcccggacaaaacggcttaatgccggttcttttaacggcggttcgggaagcgaaagcggctgctgcagtaccaactgggcaggaagccctacacgcagtgagtagcgctggggtaagcactttcgccagcggtctaacactgacagcaattcaggggaagattgcagcacgccgtttcttaacgtatcttgcgccagccgctgctgccaccagtggcataattgccaaccctggcggcgacgcaggatggcaagggcacagcactgcctgttctggatatccagcccaatttgccaggtgtgaaaagccatgcgcgcgatctccttatcgtccggaaaaatggacatatcaaagcgtctggcttgcctttatactactgcgcggttgcttataaactgcccaaacgacaacagatgggaaatctcaggtgaagttcgtaaagtatttattaatccttgcagtgtgttgcatcttgctgggagctggctcgatttatggtttgtacaaatatattgagccgcagttacccgacgttaacacgctgaaagatgtgcgtttgcaaaccccaatgcaggtttacagcgctgagggcgaccttatcgcccagtacggtgaaatgcgccgtataccgcttagcctgcaacaggttccgcctgagatggttaaagcatttattgcaacggaagacagccgcttctatgagcatcacggtgtagatcccatcgggattttccgtgctgccagtgttgcgctggtgtcaggccatgcttcgcagggggccagtacgataacccagcagctggcacgtaacttcttccttagcccagaacgctccctgatgcgaaaaatcaaggaagcctttctggcgattcgcatagagcagttgctgaataaagacgagattcttgagctttacctgaacaaaatctacctcggctaccgggcttacggtgtgggtgccgcctcacaggtttattttggtaagcccgttaatgagctgtcattgagcgaaatggcgaccatcgccggtctgcctaaagccccgtcgacctttaacccgctttattcacacagccgcgccgtcgcacgtcgcaatgtcgttctggcccgtatgctggatcagcattacattacccagcaacagtacgatgaggcgcgtaacacaccgttagtcgccacctatcatggccctaaaatcgtcttctctgcgccttatctcagtgagatggcacgccaggagatggtaaaacgctatggtaataatgcttacaccgatggctacaaggtttacaccaccgtcacacgacgtctgcagcagtctgcgcaggaggccgtgcagaacaacgtaatggcttatgatatgcgtcatggctaccgtggcccgaccagcgtgctgtggaaagtcggtgaacctgcatggggacaggcgcagattgttaaagcgttaaaaaatcttcctctgtacggtccccttcatccggccgttgttacccatgcgcagagcgatgaagccaccgtcatgatgaaagatggtagcaacgtgtcactgaccatggctggcgttcgctgggcgcgtgcctttaagtctgacacggtgcaagggccaacccctaaaagcctgactcaggttctgcagccaggccagcagatttgggtacgccaggttggcgatacatggtggctgggccaggtcccggacgtgaactcagcactggtttcattagatccgaccaacggtgccgtgcgcgcactggtgggcggttttgactttaaccaaagcatgttcaaccgcgccactcaggcactgcgccaggtgggctcgaacattaagccgttcctgtacacggccgcgatggatcgggggttaacgctggcatccattcttaacgatgtgcctatttcccgctgggatgcaggtgccggtgcggactggcgtccgaaaaactcaccgcctacttacgatggcccgattcgtctgcgccaggggctgggtcagtcgaaaaacgttgtgatggttcgcgcgatgcgtgcgatgggcgtggattacgcggccgagtacttacagcgctttggcttcccggcgcagaacattgtgcatactgaatcactggcccttggggcagcctcgtttacccctttgcaggtggtgcgcggttattccgtcatggcgaatggcggcttcctgattgatccttacttcattagcaagattgaaaatgaacagggacaaaccgtttttgaagaaaaaccgagaattgcctgccctcagtgcaacttaccagtgatttacggtgaaaccaaaaaagcgctggcgctgaacgccgagagcgttgagaacgttgcgccttcggctcagcagcaaaaccagacggtgccgcagcctgagctggagcaggtacctgcacagccgcagccgggtggtgaacagcagtatgcgccgcacgtgattaatacgccgctgtcattcctgatcaaaagtgcgctgaacagtaatatttttggcgaaccgggctggatgggcacgggctggcgtgccgggcgcgacctgaagcgtaacgatattggcggaaaaacgggcacaaccaacagttccaaagatgcctggttctcgggctacggccccggcgtcgtcacctcggtgtggatcggctttgacgatgcgcgtcgcgatctgggtcgcagtaccctttctggcgcgattcccgatcaaatatcgggttatgaaggcggcgcgaagagtgcacagcctgcctgggatgactttatgaaggtcgctctggatggcgtgccggttcagccgctcacgccaccggatggcatcgtgaccgtcaccatcgatcggagtacgggcaaactggcaaacggcagtggtaatacgcgccaggagtactttatcaacgggacgcagccaaccgagtattcggtgcatgatgcaggcaccaccattatggacaatggcgagagccacgaactgttctgataatcctcaggggcggcgcgagtcgcccctggttatccggcctgtcttgcgcggatgttaatagctgatacgtccctgcttcaccagccactcacgtaccataaacaatgcactgacgttgcgcgcttcgcgaaaatcaggctcctgcaataatgccagcatgttgcttaacggccagtgatgcaccaccagcggttcaggctcatcgccttccagcttctcctgataaagcccttctgccacgacaatattcatcttgctggaaaagtacgacggcgccatggtcagtttgcccagggtagtcagctggcccgcaccgaatcccgcctcctctttgagttcacggtccgcagcctggtttacggtttcacccggatcgatcaagcctttagggaagcccagttcgtaggtctccagacccaccgcgtactcttcaatcagcaccaggtgatcatcgataatcggcacgatcatcactgcttcacgttccgagggcttcatgcgctcgtaaatacgccgtgcgccattactgaaggccaggtctaccgcttcaacagtaaacaatcgtgaccttgccacggtttctacattgaggatgtcaggtttttttaacgactttttcatatcagcctcaaacttgctgcgccagcactcaggagcgaattagcatacctaacgatccgcctttgtgcgactctccaaccgcacgcagcgcgtatgccgcttttttctacgataacactggtttcctgagtacaaaaaatttgtgttagtcaatatctcgcttcaaaattcagataatgccgatacaataacgggtgcactgtcgttactattctggcagtgtgtgatgtcataacgcctaattaaatgatttacagaactatttcgtttattgttaaacgtgtcagagttgtttaacctcccataaatcgtcttgcatcgtgggcgaatctggggatgtaagtttaaagtgaaggcagtattttggctgaattgagcaaagcatgagcacaataattattatattggccgtagtgctaacctgttcaattctggcaggtattggattttggtacgctatgcggcgcaggcccccgttggcgaaaccgctgccattcattagcccgccctgccgtaagctgtctgaacgggagcgcaaggcggttgaacagtaccttgctgcccttgaaaaacagccccgtatcctcagtcccggtgaatcccgccgtcaacatgacaagctggtgctgaccgcgcaaagcaacaatgtctatcctgtcacgcgggcgattacccgttatggcctctccaccgacgatccccataagtggcgctactatctggatgaagtcgaagtccatttgccgccgctgtgggaacagtacatcacggatgaaaactacgttgagctcatccgcacccagtccgttccattaatcatctctttgaatggacactcgctggtggattacgccgttgatcagcagtcgctacccagcctgatacgtccggcttccaccaacgcatcgatccgcaaagcggaaagtgaaaacgtggaattagtgcgggtgcgcaaagaaaccctggaagagtaccggctgtctcgccctgacggcacgcgggaagcggtcattatttcttttgccttgatgttgttttttatcggcttgctgttgccagccagtctaatgatctggctgtcggtgattgccggcatcatgatcgtcgccagtctgtggctgatgtatcgtgtgcctggtgagaatggcctgcgtgaaattcactgtctgcgcggcgcgcccaagcgctggggcttatttggtgagtcaaatcaggaacagagcaacattacgctggggattatcgatctggcttatcctgcccactggcagccctacgttgctcacgatctgggtcaggtgacggacgtcgatatttatctgaatcgccaggtggtgcgccaggggcgctttctttcactgcaggatgaggtcagaaattttccgctgcaacgctggcgtaaaaatgtcgtgctggcctgcggctcgctgattgttctggctttattaatcacctggattccgctcagcatgcccatcaagctgagtctggcctgggctaaaggcaccgacagcctggatgtcagcagcgttaaccaactgagtagcgtggatcttaaagtcggcgacagcctgaaggtcacagggaccggcatgtgtgcggtgccggacaactaccaaagcaatcgcacctatacctatatgccgttcgattgctcacaaatttactggaataacgcaacgcccctgccgctgccccactcagatattattgagaaagcctcggcattgctggataccacgacgaaacagctgcatcccgaaaccaacaccgatcccaaactgaatcctcagttagcctcggcaattcagaaatcgggcatgattctgctggatgacttttcagacctggtgctgaaaacgcaggcgctctgcagccaggcacaggactgtatgcgtcttaaaaatgccctggtgaacctgggtaatgccaaagactgggacaccttagtcagccgcgccgattccggtcagcttaacgggatgaatgtcctgctgcgtccggtcagtgctgaagcgctggaaaacctggtgcacaccgcgacctccaccttcttcttccgtgaaacgcgtcgcgccgctgagaaccttaacagcccaccgccgggcggattcgttatcgccagcgatgaagggcaccagctcgtcaatcagccccagcctgctgttccgctgtttgatcttgaggcgtcgtcacagtggcaagagctgcaacgtctgtcctcactgttgctgcatacgccgttcagcgccaccggcatcattaccaatatctataccgatgcaaacggcacacgccacatcgccctgcacaatgagcctgatgccatggcaaaatggcgctatctgggtgccgcgctgttgctgatggtgctgctggcctgcggcatcgtgaacggcctgctggcattgcggcgcattcatctgaatcgtcagcgtatgcatgctatccagcaatattacgataaatgctttaatcctacgctaagcactatacagggcgtgcgctccatattttgagccccttgcaactgtgctaccctgttgcgctaactggcaacgggtaaattcaccatgatgttcaaccggtctgactttgacaccgtgctgctcgatatggacggcacgttgctcgatctggcgtttgaccgctttttctggctggagcttgtccctgataccctgcgtacccaacgcggtatttctgctgctcaggcgcgtcagattattgaagaaaaatatcaggccgtggcgcatacgctaaactggtattgtctggattactggtcgcaggcgctgcagttagacattcatgctatgacctgggaacagcgccatcgcgtcagcttgcgtgttgatacactgccttttttacaggctttacgtcaggcgggtaaacgcaccatcctgctcaccaatgcgcatccctggaatctggacgttaaactgaaacaaacaggtttagcatcacaccttgatttattactttccacccatacctttggctatccgaaagaagatcaacgtttgtggcaggcggttgagcagcacactggctttgatgcatcacggacagtgttcatcgatgacaacgaaaccattcttgatgccgccaaatcatggggaatcggctggtgcctgggcgtcagtaatcctgactccggtcgtcctgaacaacactttcagcgtcacggtgcaataagcgactaccgcacactgattcaggcctgggagcagcaatgaaagaaaaaccaagcgaaggcgttcgtcttgataaatggctttgggcggcgcgtttctacaaaacccgttctatcgcacgcgagatgattgaaggtggcaaggttcattacaacggccagcgcagtaaacccagcaagcttgtcgagcgggatgctgagttaaccctacgtcagggtaatgatgagcgcaccgtagtgatcgccgacatcagcgagcagcgccgttctgccagtgaagcacagctgctttaccgcgagacggaagccagtattgaaaaacgtgaaaaagtagccctggcgcgcaagatgaatgcgctgaccatgccccatcccgatcgccggcccgacaagaaagaacgccgcgatttgatgaaatttaagttatcgggtgatgaataaacaggttactgaacctatcaccgcccgccaaaagagagaaaattatgtctgagcaagatcaactgcgtcgttatctgtttgaaaatgcgtccgttcgcggcgaactggtcaatgtttcaaacacctggcaagccatcctgaaaaatcacgactatccgcctgcggtacaaaccctgctgggcgaattgctggtggcgaccagcctgcttaccgcaacgctaaaatttgacggtgaaattaccgttcagcttcagggcgatggtcccctgacgttagccgtgattaatggcaacaatcagcaggagttacgcggcatcgcacggatgaaaggtgacattcctgacgacagcacgctgaagagcatggtgggcaatggctatttggtcattaccatcacgcctgaaaaaggcgagcgctatcagggcgtggtcggtctggaaggcgacacgctaagtgaatgtctggaagactattttatgcgctccgaacagttgccgactcgtctgtttattcgcaccagcaacgcaggcgcagccgggattctgttgcaggttttaccggctcaggacaccgataaggaagactttgcgcatctggctacgctgaccgagacgattaaaacggaagagctgatcgatttgcccgcgaccgatgtgctgtggcgtctttaccatcaggaagaagtgaccgtttacgacccgcagccggttgtctacaaatgcacctgttcgcgcgaacgttgcagcgaggtactgagaacgctgccgcaggaagaagtcgacgagattattgctgaagatggcaaaatcgatatgaactgcgactactgcggatcacattacgtgttcgatgcggtagacattgccgggattcgtagccactcccttgagaacagcaatcgccttcactgatcggaccagggcggtcaggccgccctgcctgccccatcgctatgcccttaatttacttagcaaattatctttttttactttcttaacatcttaaaaacgttcgaaacatacccttaacgcgccctgagtctcatttttaacgaacaagcctttctcgcctgacacagtagcgtaaactgcgcgcgatcgtgtttccgcacctggccgtgcggcatgttacagacgcgatcccacactctctttgccctacagaacagacaccgatttaaggagcagtaaaatgcgcgttaacggcctgacctcgaaagcccttgccgatctgggcatcaccgataccactgacgtggttcataaccctgattacgatacgttgtttcaggaagagatgcgcccggagctcgaaggttttgagcgcggcaccctgacgcaaagcggcgctatcgcagtcgataccgggatttttaccgggcgctcgcctaaggataaatatattgttcgtgatgacaccacgcgcgatacgctgtggtggaacgatcaaggcaccggcaagaacgataaccaaccgctgtcccaggaaacctggcaggcgctgaaaaaatgcgtcacccagcagctctccgggaaacgcctgtttgttattgatgccttctgcggtgccaacccggattcacgcctgagcgtacgctttgtgactgaagttgcctggcaggcgcatttcgttaaaaacatgttcattcagccgagcgcagccgaactggataacttcacgcctgattttgtggtgatgaatggcgcgaaatgcaccaatcctgactggcaggcccaggggctgcattctgagaacttcgtcgcctttaatctgaccgaacgtatgcagttgattggtggcacgtggtacggcggagaaatgaaaaaagggctgttcgcggtgatgaactacctgttgccgttgaagggcattgcctccatgcactgctccgctaacgtgggtaaagcaggcgacgtcgcggtgttttttgggctttccggtacgggtaaaaccacgctgtctaccgatccggatcgccagttaatcggcgatgatgaacacggctgggatgacgatggcgtgtttaacttcgaaggcggttgctacgccaagacgattaacctctccgaacaggctgagccagaaatctatcgtgctattcgtcgtaatgccctgctggaaaacgtggtggtgcgtgaagacgggagcatcgattttgcggatggtagcaaaaccgaaaatacccgcgtgtcttatccgattaaccatatcgacaatatcgtgcagccggtttccaaagcaggccatgcgaagaaagtcattttcctgactgccgatgcctttggcgtgctaccgccggtctccaggctgacgccagagcagacccagtatcatttcctgtccggatttaccgcgaagctggccggcacggaacgaggtgtgaccgcaccaaccccgaccttctcagcctgttttggcgcagccttcctgacgctgcatcccacacagtatgcagaagtgttggtgaaacgcatggaagcggcgggcgcgcaggcttatctggttaatacgggctggaacggcagtggcaagcgtatctcattgaagaatacccgcgctatcatcaacgccattctcgcaggtgagctggacgatgcgccaacggagaccctgccggtgttcaacctgcaggtgccaaaaaccctgggcgatttggatgccgaaacgctcgacccgcgtcgtacatgggaaagcgaagagaagtggcacgctgccgcagatgatttagcacagcgttttatcaccaactttgaaaagtataccgataatgcggccggtgccgcgttggtaaaagcaggtccacagcgctaataacaacggcgcggcttaaccggccgcgccgttgttgctcaactcagcgtcaggttgccgctatgtggaaccacctcgggattttccgctaagggtaaccaggcacggatgcgtaatccgcctcgttcactgtcacctatctccagcgacccttgatgcgcatcgatgatgcgttgcactatcgccagccccaggcccgtgccgctggtgcttcgtgcgctgtcaccgcgcacaaaaggctgaaacagatgggccagctggtcaggcttaatgccgggaccgtcatcttcaacctggaaccaggcccggtgcagttcccgtccactgctgaccttaatccagccgttgccgtagcgcgcggcgttcaccaccaggttagccagggcgcgcttgatggagagcggattgatctccagcataagctcttccgccatgaccgcattttcaatttcccgttcgtaaccgctttctgctgccaccacctcacccagcacgctattaagatcggccagctcagtctgcatctcctgcccggtgcgcaggtaatcaatgaattgctcaatgatggcgttgcactcttcgatgtctttgttaatcgactcggccaggtagccatcctgctcattcatcatttcggtcgcaaggcgaatacgggttaacggcgtacgtaaatcatgactgacgcccgccatcagcagcgttctgtcatcggcaagctgcttgacgcccgccgccatttggttaaaggctcgcgtgaccgatcgcacttccgacgcgccgtattcacgtaacggtggcggaatgatgcctttacccacctgaagtgcggcatgctctaaatcgaccagcgggcggttttgaattcggataaaaagccaggcaccgcctatcgccagcaacataatcgccagggtatagcggaacagcggggagaagtcaccctgatggatttcggttaacggcacccgtacccagatatcgggcgatagccaggtctttaaccagacaacgggggagtttttgtttacctcgacgcgaacgtccgtggggccgccaagctgctggcccatctgatcgctaagaaacttatagtgctgcgcccagcgcagtccgctctcctctgctgccgcattggtatagagcgaaatacccagttcacgataaatttcgcggcgaaaagcgggcggcacttcaagctgcgtgccatcttccagctgtaaacggtctgtcatcagcatacgcacttcgtacgcgaggactttattaaactgttgcaggctgggaagaatggcaaagttcagcaccaccaggtaggtcgttaccaggctgacaaacagcaaggtaacgatcaacaacagggtgcgggcaaacgaacttcgtggcgagaagcgcagccgcctcatgctttactgccgtccggaacaaacacataacccaggccccaaacggtctggatatagcgtgggtgagcaggatcttcttccaccatacggcgcagacgagaaatctgaacgtcgatagaacgttccatggcgctgtattcacgaccacgggccaggttcatcagtttgtcgcgcgacagcggctcacgtgggtggctgaccagcgccttgagcacggcgaattcaccgctggtcaatggcataggttcatcttcacggaacatctcacgcgtgcccaggttgagtttgaacttaccaaaggcaatgaccgcttcttcctgagaaggcgcgcctggcagttcgttggcctgacggcgcaacacggcacgaatacgcgccagcagctcacgcgggttaaacggttttggaatatagtcgtcagcaccgatctccagtccgacaatacggtccacttcttcacccttggctgtcaccatgatgataggcatcgggttgctctgactacgcagacggcggcagatggaaaggccatcttcgcccggcagcatcaggtcaagcaccattaaatggaaggattcgcgggttaacagacgatccatttgttcggcgttggcgacactgcgcacctgaaagccctgctcggtaagatagcgctccagtagtgcacgcaaacgcatatcgtcatcgacgaccagaatcttgtagttttcttgcatttttaactcccaaaggcgcgattgcctgagccgatattgttaaaaaaagatgcggcacagtgacagtgtttaatggtttatattctagtcaaaattgttacaaagcatattaaacagcagcttatatttaaatttcggtctgactgcctgagaagctgtgtcatcaccacctgcgttgaacagaatacggcaaatctgaaatattaggtaaaattccgctattgcctggtttaaacaggatgcactggctgacagagcttgtaaattcaactgcttgccagaaaatttgccttaaattaaatcagtgacggatgacatatctggcatctggcggttttcccctctgataacagcataatatcccgcaaaaaaacaggttaatacgcgacctctctcggattagtttgagatccacccccaataaggccagttacaggtaaagagagataaatcaatcagtaaagcccgctttgcgcccggataaatatcacccagactgtagcgacaccaatttgccgttttacggggaaaccataatgaaaaaaacgattttactgctgagcgcgctggctttattcagtgtgggtcagacttatgccgcaaccgcaaccggtgaagctgcgggcgcacaggccaccaccacagcccagggtaactcaaatgctatcggtattggcgcagtcggcgcactgttaggcgtagcactggcgacagcgggcggcggcggcggtgacggcaacggaagcagcacctcgaccacgacatcgaccaaggccggtaagtaagacttgcccctcaggggcgcacattggtctgactaaggccgtgccgtcccctgcaaaagctgtacaaggtttttttgatccgtaaaaaacccttttcccacctctttttcgccacgcctgatttgctttacactgaagcactttcgattttaccggctgctgtaccatgagaacccgactgattacgcgtgaaggtttcaataccttaaaagcagaactcgatcacctgtggcgtgaagagcgacctgaagtcaccaaaaaagtgacctgggctgccagccttggcgaccgcagtgaaaatgcggattatcaatacaacaagaagcgcctgcgtgaaattgaccgccgtgtccgttatctcagcaaaagcattgagcaactgcgcattgtggattactcgccgcagcagaacggcaaagtgttttttggtgcctgggttgaagtcgaaaacgacgacggcgacatcaagcgctttcgaattgtgggttacgatgagatttttggccgcaaggattacatctccattgactcgcccatggcccgcgcactgttaaaaaaagcggtcggcgacgcggctgtggtcgagacgccagctggcccggcatgctggtatgttaatgaaattagttatattgaagcctgattcagaatatcgctgaaagcgggccgcttctctggcaatttcagccatcaatccgtataactatcggctatttctcaacccagaaagcaaaatagtccgatgatgaatgttcttagccagctaattgcaagtgagctacaggcgcgccccgagcaagttgatgcggccgtccgcctgttggatgaagggaataccgtgccgtttattgcacgttatcgtaaagaggtgacgggcggcctggatgacacacagctccgccagctcgaaacccgcctcagctacctgcgtgaattatccgagcgccggcaggccatcctgaaatccattgaggaacaaggaaaactcaccgacgaactggcgaatgccatcaataccaccctcagcaaaaccgaactcgaagatctctacctgccctataaacctaaacgccgtacacgtggacagattgcgattgaagccgggctggaaccgctggccgacacgttatggcaggacccgtcacaagatcctgagcaggtggcggcaggctatatcaatgcggataacggcgtcgctgatgtccgcgccgcgctggatggcgcgcgttacattctgatggaacgcttcgctgaagatgccgcgctgctggctaaagtccgtcactatctgtggaaaaacgcccacctggtttcaaaagtggtggaaggtaaagaggaagaaggcgctaaattccgcgactatttcgatcaccatgagccgctgcacagcgttccatcacatcgcgcgctggccatgctgcgcggtcgtaatgaaggtgtgttacagctgtctctgaatgccgatccccagtttgatgagccgccgcgcgaaagccacggcgaaaccttgattacagagcacctgaatctgcgactgaataatgcaccggccgacagctggcgcaaagccgtggtcagttggacatggcgcatcaaggttatgctgcatctggaaaccgagctgatgggcaccgtacgtgagcgcgctgaagatgaggccatcaacgtctttgcccgtaacctgcacgacctgttaatggcggcacctgcgggcatgagagccacgatgggcctggaccccggcctgcgtactggtgtgaaagttgccgtggttgacgcgaccggcaaggtggttgctaccgacacggtctatccgcacacaggacaaaccgccaaagcagccgctgcggtcgcggcgctgtgcgtgaaacatcaggtcgaactggtggccatcggcaatggtacgggctcacgtgaaaccgagcgtttcttcctggatctgcaaaagcagttcccgcaggtcacggcacagaaagttatcgtcagcgaagccggcgcttcggtttactctgcgtctgaattagccgcgctggaattcccggatcttgatgtctcactgcgtggcgcggtctcgatcgcccgtcgtctgcaagatcccctggctgagctggtgaaaatcgatccgaaatcgattggcgtaggccagtatcagcatgacgtcagccagagccagttagcgaaaaaactggatgcggtggtagaagactgtgtgaacgccgtcggtgtcgatctgaatacggcctcggttccgctgctgacgcgcgtggcagggttaacccgtatgatggcgcaaaatattgtgggctggcgtgatgagaatggccgtttccagaaccgtcagcagctactcaaggtcagccgtttggggcctaaagcgtttgagcagtgcgcgggctttctgcgtattaaccacggcgacaatccactggatgcttcaacggtgcacccggaagcctatccggtagtcgagcgtattctggcggcgaccgagcaggcgctgaatgcgctgatgggcaaccccaccagcctgcgtaacctgaaagcggtggactttaccgacgaccgctttggcttaccgaccgttaccgacatcatgaaagagctggaaaagccgggccgcgatcctcgtcctgaatttaaaacggcgcagtttgccgagggcgtggaaaccatgaacgatctgatgccaggcatggtactggaaggtgccgtcactaacgtcacgaactttggtgcgttcgtcgatattggcgtgcatcaggatggcctggtgcatatctcttcgctgtcagacaagtttgtggaagatcctcatcaggtcgtcaaagcgggcgacatcgttaaagtcaaagtgatggaagtggatctgcaacgtaagcgcattgccttgaccatgcgccttgacgagcagccgggtgaaggaaatgcccggagtggtaagagcaatacggcacgtgaagaaaaacgtccggccgccaataaaggtcgcccacgtcccgtcagccagcccgcaggaaatagcgccatgggtgacgctctcgcggcggcactgggtaaaaaacgctagtaaaaacacgcagtcacctcttatcccagttgtcggggtggaggtgactgtcatcaccgtcattatcccctgtcccgcggctgattcggtttacctgaacgcgctaaacccttgcaacccgacgtggtttaccgcgcgatgcctgcagtatttgtgatggatcgtccgcttcatgctgacggcttttcagcggtttttcagaccgaccttgcacgattaagttgaaaatccccaccctgacgctacgctaaaaagacgcccgtcataataacgacacctgctgtggcacccttttacatggaaaagatcactgctttaatcgataagatttatgacgatgcctttcctgaggccatgcgtgaacgcctgctcgccgcgatcgtcgaggcccgcgacacgaacaagctgccaagaaaggcgcactgggatgagcaggacgtggtgctgattacctatgccgatcagtttcgcgagccgggtaaacccacactcaacaccttttcgcgtttttatcagcagcatctgcaatccacctttccgctggtgcatctcctgccgttttatccctactcatccgacgacggtttttcggtcattgactaccatcaggtcgatccgctgtgtggcgactggcacgacattgccttgctgcatcaggaaacacgcctgatgtttgattttgtctgtaaccatatgtcggcacacagcgcgtggtttaaacattatctggctcaggatgagggctgggatgatttttttattagtctgccgcccagcaccgatctcagtgcggtcacgcgaccccgcacatcgccgctgctgacgccgttcacgctggcgaacggtgaaatccggtttatctggaccacgttcagcgccgatcagattgacctgaactttgccagtcccagggtgctcatgcgcatggttgaggtcttactcgactatctgaagcgtggggcggactatgtgcggctggatgcggtgggctacatgtggaaaacgccgggcacccgctgtattcatctggaaaaaacccatctgctggtcaaactgtttcgcgccattgccgatgtcgtcgcaccaggcactgttatcatcacggaaaccaacgtgccgcataaagacaacatcagctactttggtaacgggcaagacgaagcccagatggtctatcagttttccctgccaccgctggtgctgcacgccattcacaccggctcggctcgtgcactgcgtcaatgggccagcaccctggaagtgggcaagggcaacacaaccttttttaattttctggcctcgcacgatggcataggcctgaatccggctcgcggaattttatctgaagtcgagattacggccctggtacgcgatctggcgctggaaggcgcactgatttcctataaaaataaccccgacggcaccaccagcccctatgaaatcaacgtcacctatttcgacgcgcttaaccgtgaagatgatgacgatgaaacgcgcctcagacgcttcatgctggcacatgctattttactggccttccccggtgtgccggcgatctatatccaaagcatactgggttcacgtaatgattatgacggcgtgcgtgaggcagggcataaccgcgcgatcaaccggcaaaagtacccgctctccgtgatcgaagacgcgctggtaaacagcagcggcttacgccatcaggtttatacacagctaagcaaactgattcagcagcgtcggcgtttgtcggcctttcacccagataatccagtgatgatatttcagagcgacaatgcgttactgatgatgaaacgctatcatccagacagtggtgagggattgctctgtgttttcaatctcagtggcaggcaggtcaaggcgcagttaccggaggcgcacctttttcaggatgtgataaggggtgagaagattgatggcacccagccagtaacgctggatgcctggcaattcatgtggctacgataattacttgtaaacttccgctgtcgcactgaacttaccgtgctcacgaccggcgatcaccaggaaatacttgccgcccttctcgtcagctgcttcggacagcttcttcttggcatccatcggcgaggtggtttctgccgtggtattcacggtgccgattttggtcaggttcatcttctgcacttcttctttggtgacttctttcgccgcaaaagcagagaatgacactgcgcccatcatcattgatgcaacgacccatttcataaccttcatttgtctaccctcattcatgatccattgttgagatgtaagcagccgcaaatcgcttaaggctatatcgaacggcatagtcatctccctgactaatcgcatagaagtgcagcggccttgctcactcatgaagtattgtcgctgtgcggaaatttgccagtaacggcagcggttatctgtctaattggctgataaaagacacaatctgctggcagaacgcatcaggatgcgaaataaagggcgcgtgggcggctttgtccatcacgacagaaggcgacatcggcagcaacgcgtccagttgctgcgcgatacggcgcggtaccaggccatccagcgcgccatatatccgcagaaagggcagcctaatggcggtaagcctgtcccgtaagtcgtcgtcgctcagtattgtcagcccagcgttgagtaccgccacgtcaggcacaggctgcgacaaaacaatgtctttgagtttgcgcgcatcggcacgtgcggtttctgttcccatcgtctgcagcgccagaaaacgctccacggtgcgctgaaagtcgtggctgagctgctgctggaagttatgcaaggttaagggagcaatacctggccagtcatcacgggcggtaaaacagggcgaagaggccaccgtgatcagcgcacgcaaccgttctggctcgctcaacgccaactgcgtggcgaccagcccgccaagcgaccaacccaggacaacggcgcgcggcggcaaatggggcaacagtgcctgcgccatctgttccagcgacagggcgctgaagccctggctgcggccatagcctggcagatcgaccaggtgcagacgatattgtgcgctgagtcgcggcacaatgttttgccacacttccgcattcagtccccagccgtgcagcagcacaagatcgtcatcgctttcgccacaggtatgccagtaaagtgagctcatccgttactattccatgattgataaggaggtcactatgctaccaatgcctgccctgtgttggctatgtcagttgccgctgcgcatcgcgctgcatggcctgtgctgcgtctgtatgcgtcagttaccttgcctgccgtcacgctgtccacgctgcggcctgccagccgcatccggcagcctgtcctgtggccgctgtttgcgtaaaccgccgccctggcaggcgttagtctgcgtcagccattatcagccaccgttcagttcctgggtgaatcaattaaaattctcgggcattaccgcacttagggtgatgctggcccggctgcttttgctaagctggttggatgcgtatcgcagaggacaggcccgtcgtcccgacttactaatgtgtgttccgctgcattcacaacgctgctggtggcgcggttacaatcaaacagccctgctggcaacaccgctgtcacgctggctgggctgcgaattcagccaggcgttatcccgtcagcgcgcagccgccattcaacatcagttaagtgcccgccagcgtcgccgcaatttacgcggcgcgttttgccttgaaacggatgtgaccggccgccatattgccttaatcgatgatgtggtcacgaccggcagcacggtaagggaaattagccgcctgctacacaggcgaggcgcagccagcgtgcaagtctggtgcctgtgccgtaccttgtagagcctggatgatgggcgtattataaccaactaaattagtcaactattgagcaaatgacatgatccgaattactgattctgcccaagagcatttttcaaaactgctatccaaacaagaagatggcacccagattcgcgtattcgtgattaacccgggtacgccaactgccgaatgcggtgtgtcctactgcccacctgatgcggtggaagcgactgatactgaactgaagtttgaaaagctgtcagcctatgtcgatgagctgagcgcgccttatctggaagacgctgaaatcgacttcgtgacggataacctgggttcgcaactgacgcttaaggcgcctaacgctaaaatgcgcaaggtgtccgatgatgcgcccatggtcgagcgcgttgaatacctgttacaggctcagattaacccgcaactggccggtcatggcggtcgcgtttcgctgatggaaatcaccgaagacggttttgcgattctgcaattcggtggcggctgtaacggctgttcgatgattgacgtcaccctgaaggatggcattgagaaagaactgctggcggccttcccacaactgaaaggcgtgcgcgatatcaccgaacaccagcgcggcgagcactccttctactgatgtatccgcgcgacagccccgctgtcgcgcgtcctgacactatcctgccttacgtcgtttggtcacggttttcagcagtttattcacctcttcatcggcaaagatgctttccagcggttgggccagcttacgccgccagttgggatattgctccaccgttcccggcacattcaccggcgtggtcatccccagccagtcctctggctgcagcccgagcagggcactgtttgtgtccgccaggaaacggtgaacggactgattcagttcagccgtcatcgccagagaatccgcccgttttgcgctacgcgccggcacggctcccgctttatgcagcgcgtcgagtaacgcctgtttctgtttcatccgctgctgctgcaaattgagtaccgtttgcgcgtcaggatacagcccgattttctcaccaagctgcaaatcgcctgcactccagaagccggtcagcgtagggagatcgtgcgtactggcactggcgatggactggcgtggataatgctgtggcgcgcgataatcgccctgtttttcctgctcaaaccacaacactttccaggaaaacacgccgctgtcgcggagcagactgacgatctctttgggtacggtgcctaagtcctcgccaatcaccatgcagcgctggcgctggctttccagagccagaatgccaagcaggtcgtgcaccgggtaagcgacgtacgcgcctttatccgccgtttcccctgccgggacccaccagagacgtaacagagccatcacgtgatcgatacgtaatgcaccgcagtcacgcatattggcgcgcaatatatcgataaaaggctgatagcccctggcctgcaatacgtgagggtccattggcggcagtccccagttttgtcccaacgggccaagtctgtcaggcggcgcgccgatggacgccttgaggcgataaagctcgggatcgtgccaggtttcggcactgccctctgccacgccgacggccagatcgcgatacagccccacgctcattcccagcgcctgactccgcgcccagcactgagaaaactgttgctgagccagccactgcaaccactgccagaaggcaatctcatccgcgtgctgtgcgcaccaatcctgaacgtcagaagactggctgttacgccagccctcaggccatgctggccagccggcgtgcgcggcacctttgccctgcatttcaacctgcaggccatcataggcagcctgatagcgcaggctgtcaccgccctgctggataaacgctgcaaactgccgcttctgctcatcgtctgcaccccgggcctgaaactgtgcccagcagtgacgtaatgccgtaattttcagtgccatgacggcgtcgtaatccacccactcggtttcgcgggcctgatttaacgccttttgggttttggcacttttccaccacttctgacctgcgctgctttgttgaaaatcggcaacctgtgacacatcgatgtagatgatattcagccagcgacgcgatgaggggctgtaaggactggcaaaagcggggctggccggatagagcgcatgcaaggggttgagtccgacaaagtcgccgccgcgagcggcaagctgctccagcagggtttccagatcgccaaaatcaccgatgccccagtttttaccggaacgcacggtgtaaagctgaaccagcgcgccccagcgtttctctccggcgcgcaaggccggaggcagatagcaacggcgcggtgtaatgatcacgcgcgtgtgccactgacgtttccccttgctcagggtaagttggtgatagccctgtcccaaaggggaaggcaatgtaaaggcttcaccgcccgtcagcgatccgctaaaagtctttcctttttccgtctgtaactgccagtttatgctgccgtcgagctcaggcgtgagcacgcgttgacgattgccactgaagacaacgacgggcggcagcggggatttaccggctttctgcgggttctccatcacggccagtaaggcgcgcttggtgtcatcactgatggcttcgggttcaccgttcgcatcgaaatacgtgagcgcgattcccgccgccagtgcggctttatcaagtgacgtagatttcatcgcaattccttagcgttgcgcctgccagatgcgctgttggtagtcccgaatcgatcgatccgaactaaaaataccggttcgcgccgtattaagaatcgccgcgcgcgtccaggcttcctgatcacgccacaaggcctcaacccgtttttgcgcatcgatataagcctgataatccgccagcaccagccagggatcgccattttttgtcaggctatccaacattaggtcgaatgcatgcttatcgccatgactgaacttcccttttttcagtgacgtcagcagtgcatccagttctttgttgtgcttacggactttttgcggcttataacctccggctttcagggctttaacgtcatccacggtattgccgaaaataaaaatattttctgcgccgacctgctccgcaatttccacgtttgcgccatccagcgtgccaatcgtcagcgcgccatttagcgccagcttcatgttgccagtgccggacgcttcatagcccgccgttgaaatttgctctgacaaatcggcggcgggaatcagatattcggctgccgtaatgcggtaatcaggaatgaaaaccaccttgagtttgtcgccgacaagcgggtcgttattcaccacctcagccaccttgttgatggcatagataatgttttttgccaggtaatagcccggtgcagctttagcgccaaacagaaacacgcgggggataatactggcatcgttggggttgtcgcggacgtttttatagcagtgcaggatatgcaacaggccgagatgctggcgtttgtattcgtgcagacgtttgatctgcacgtcaaaaatcgcgttcgggttaaccacaatgccggtgcgctgcgcaatgtaagtggccagacgcgccttgttatgttgcttaacggcacgaaagcgctgacggaaagcgggatcgtcggcgaaaggctccagcccctgcaacgcggtcaggtgattgacccattcacgcttcagggtttcatcaatcagccccgctaacgcgggattacactgcttgatccagcggcgtggcgtaatgccgttggtgacattatgaaacttctgtggccagagctgatggtactcggggaaaagatccgtcacgaccagcccggaatgcagtgcagccacgccattcaccgcaaaaccactgacgacgcagaggttggccattctgacctgaccgtcggcgaccaccgccagcttgttccaaagcgctttgtcatcaggccagcgctgctttatctgctgcttcaggcgacgattgatctctttgataatcatcatgtggcgcggcagcaggctgcgcatcagcttctcatcccagcgctccagggcttcgggcattaaggtgtgattggtgtaagcaaacacgcggctggtgatatgccaggcttcatcccaacttaactggtgctcatccagcagcagacgcagcatctccggaatggcgatagtgggatgcgtatcgttaagctgaatcacttcaaaatccggcagggcatgaatgcttctgcccgcctgatgatggcgacgcagaatatcggcaaccgcacaggcacactgaaaatattgctgcatcaaacgcaggcgtttgccctgtggatgattgtcattgggatagagcactttggtcaggctggcggcatcaatcccctgcttctcagcctgtaaaaacttaccgtcattgaacagggtcaggtcaaagggatgctcactggtggctttccacagccgcaacggcagggtgacgccattgcgataacccgttaccggcaaatcccaggcttctccacgaagataaatggcgggctcccacactttacgcccgtcatcctgctttatgatttttccgcccatcgcgacgcggacatccagcgcggcgttatgacgaaaccagggataggtctcgcgctcccagtcatcgggtgcctcaacctgtttcccctcttcaaagcgctgacgaaacaaaccgtactggtagttaagcccatgcccagtggcgggctgcccaaccgtcgccatcgagtccatgtaacaggccgccagcctgccgaggccgccattgcccaatgccggatcgacctcttcttccagtaattcgcttaattcaacctgatattcagccagcagggatttgacctcatcataccaacctaaattcagcaggttatttcccgtaagacgtcccagcagaaactccatggaaagatagttcacgtggcgctgtggtgtcgcgccccggacggtcggttgcgcattgagcagttcacttactgtggcactgatagcctgccaccactggtgggatgtcatttgccttgcggaggagaaaccaagatgctgccagtgacgggttaacgcagcctgaaaacgggatttgttgaatttctgctgtggcatatcactcccttctgtatccatatgggtgaagcaaaaatggaatgcacatgggccagcaatattgccagcgaccctattcattaaatacgtgagtggagaaaaaagcgacaggcaggtttgaaaaacgccagttgtctaactggcgtagagaggtcagcagagttcgagatgaacctcatgctgttcaataactttcataatgctgtcaggcggcattttatcggtgtagagataatcaagctggctcatgttgcccagattgaccatcgcattacggccaaatttagagtggtcgacgaccagcatgacgcagcgcgagttttcgataatggcgcgtttggtgcgcacttcgtgatagtcgaactccagcaatgagccgtccatatcgataccgctgatgccgaggatgccgtaatcgaggcgaaactgtgaaataaaatcgagcgtcgcttcccccatgaccgcaccatcacgggtacgcacttctccgccggcgataatgacccggaaatctggcttgcccatcaacagcattgccacgttcaggttattggtcaccacgcgtaaatcactgtgatttagcaacgcatgagccacggcttccggcgtggtaccgatatcgataaacagcgttgcgccgtccggtatctggctggcaacccgctgcgcaatacgcgctttttctgctgaccacatcatcttgcgatcctgccaggcggtattctctgaactggaaggcaaggccgcgccgccgtgatggcgctgaattttattttgatcggcaaggtcgtttaaatcacgacgaatcgtttgtgggctgacctcaaaatgatcgaccagctcctcagtactgacatatccctgacgccgaaccagatcaataatggcgtcatgacgttgcgtctgcttcacattcctctcctgtttcgggcttattcttattcgttgtgactaccgtttacgcttgcgtgtgtcgacaaacgccattgccagtccgacaagcaatccaccaacgtgtgctgcgttagcgatagccagaccaaatgcaccaaaccagcccaccaccagccagacaagtgcaaaaccgattaacccacgctccagataaataccgctgtccggatcgcgttcaccgcgcagccagcagtaacccatcagggcatagaccacgccggacaagccgccaaaccagatgccgctaaatttcgactgaagccagccgctgagcaacgctgaaatgataaaaatgacaaaaagcttaccactgcccagccgtttttctaccgcaccaccgagataccaccaccacatcagattaaacaggatgtgaagcagagagaagtgaagcagcacatggctgaaccagcgccagacttcaaaatgctgatcgctatctggccatgccagccagtacattacggtgcgatcgcccaggacctgcatcagcacaaacaccgcaatacaggcgaacatcactaccatggtcagtggcccggcacgttcacggatatttgcccaaatattgcctcgctcatagcgcaagccgctgtcggttttgccactgtgccagcttgcagcctgatagcgaggatggttgggatcgcgcacaaactgctgaagttcgttttcgaccatcgaaagctgactttcatcatccagcataatgacgtactgactttcacgctctatacgcaatttcacgccgcgcgttgccatgtagtcaacaaaagcctgcgccatgcgcggctgattaaattgggtaatgcgcattgctcactctccgtgttacgcctgaccagtcactcagcgccactgatcacctgttgggggaaggcggcgcgccaggcatcaaacccgccatcaatactgtaagccgtcgtaaatccctggctgtgcaaataatctgctgcacttttactgctgttgccgtgatagcacatcaccagcaccggcaggctcgtgtcggttgagctgataaaatcattgaggttggcgttcgacaaatgcaaggcgccgctggcatgaccaagagcaaaactttgcgcatcgcggatatccaccatcactgcgccttgtgccagacgctgctcagcctgatgaacatcaatacattggtaggtttccatggtgtctctcatcacatcgtcaaaatgacgtctagtgtaacccgataatcctcgccaataacctgacaatgactacggctattcacctttacgccgacataatgttatccatatcacgcaaaattgtttttaggtggttaaatactggcgtcaatgttggtttgcgattatgattatgctcgaaaacgaacataagtgaactattccgaacatcggaggagacaacgtggaaaccaaagacctgatcgttatcggcggcggcatcaacggtgctggcatcgcagcagacgctgcaggacgcggactgtcggtgttaatgctagaggcgcgggacctggcttgcgcgacctcttccgccagctcaaaactgattcatggtggcctgcgctaccttgaacattatgaattccgtctggtgagcgaagccctggcagaacgcgaagtgctgttaaagatggcgcctcatatcgcgttccctatgcgatttcgcttaccgcatcgcccgcatctgcgtccggcatggatgatccgcaccgggttgtttatgtacgaccatctgggcaaacgtaccagcctgccgagcagtaagagcctgagcttcggtgcagagtcagcactcaagcccgaaattaagcgcggtttcgagtattccgactgctgggtggacgatgcccgcatggtggtactgaacgcgcaggaagtggttaagcatggtggtgaagtacgtacccgcacgcgtgtgacccgcgcctggcgtgaaaagggtttgtggatggtggaagctgaggatatcgacagcggcaaaaccttcacctggcaggctaaaggcctggtcaacgccgcaggcccatgggttaagcagttctttgatgatggcctggaactgaaatcaccttatggcattcgtcttatcaaaggcagccacatcgtggtgccgcgcgtacacaatgagaagcaggcttatattctgcaaaacgaagacaaccgcattgtgtttgtcattccgtggatggacgagttttccatcatcggtaccaccgatgtggaatacaaaggcgatccgaaaaacgttgccattgacgatagcgaaatcgactacatcctgaaggtgtacaacggccatttcaaaaagcagttaacgcctgatgatatcgtctggacctattccggcgtgcgcccactgtgtgacgatgagtcagattcgccgcaggctattacgcgcgattacacactggatgtgcgtgatgacaacggtgaaacgccgctgctgtccgttttcggcggtaaattaacgacctatcgtaagctggccgagcatgcgatggagaagttgtcgaagtattatcctgacgcgggtgcggcctggactaaaaactgcgtgctgcccggcggtaatatttccggcagcagcgacgattacgctgccagcctgcgccgtcgttacccgttcattactgaaaacatggcacgtcactacgcccgtacttacggtagcagcaccgaggtgttgcttaaagacgcgacatcgctggaagatctgggtgaaaacttcggtcatgagttttatgaagctgagttgcgttacctggtgcagcacgagtgggtgcgtgaagtggatgacgcgatctggcgtcgtaccaaacagggtatgtggctgaacgaagcccagcaggcacgtattgccgaatggctggcggtcaaggcgaaaccaacgctttcactggcatcgtaatagcgcgtcagcgctgagaaagcggtacaacgggttacggcctgttgtgccgtttttttttgcctgcgcggtggcgtgttgaggttcattgcatgaacgtggcttttggttggttgcctgggcggcatccagttatgtaactctgagaaggtttcgctcgccaggcggcgggcagtttcagtccgccccgtgcgggcgaccgacaaggggccgccagtcgccgcggccccttgaccccgggctcccgtcctgcccacccgccgctgcgcggtcccttcgctgcttcaggatttctgccggaccgccaggacgcgccgtccctggcgcggcctgactttcgccgacgtcctgtcggctcatccggaaatcctgcatccgctcagcgggacgggaaggccgacccaactcccccgctttgataactgtgccaaaacgactttccgcgtcgtttcagatgccagaaaacatcgcttcagataccagaaaagcatcacagcttattgctgttcattttttcattttcgtcaggcttccctgtcttcagttctgattacgcatgttaataacagacaggcgaagccagcctttgggaaaaatatacgccctcacaggcggggggtttgctggaggcatccggcgcgctgaggaaagaacggaggccaggacggtccgtcaggccgcagtgagcgacgaagggacagcgacggctgccggacgccgggattgttaaggggctggcgcaagccccttaacccgaccgcctgctcggacaggctgaaactccccgacgcctggcgggcggaatatgctcagtgcaaaaccgtagcgcccagccgggcggaacatgctcagtgcaaaaccgtagcgcccagctgggcaaaatatgctcggagcaaaacgctatccccactaccttgcaggcacagcacacctgaagcaaaaatgtagctcccctgcccgatggccggaacacaccggaagtaaaatggcatcgcccccgcccacaggcaaccccacatcaactaaagaataagccctcacaggcgaggatttgctggaggcatccggcgcgctgaggaaagaacagaggccaggacggcgcggcagggacgccgcgacgaggacggctgcgccacggagggcgcatccggacggtccgtcaggccgcagtgagtgacgaagggacagcgacggctgccggacgccgggattgttaaggggctggcgcgagccccttaacccgaccgcctgcacggacaggctgaaactccctgcctcctggcgggcggaacctgctcagtgcaaaacggtatcccaccgcctcaaaggcagaacatccctgaagcaggatcagagcgcctcccgcatgtcagccggaacacgtccgatacaaaaccgtattcacctgcccacaggcagagccaaaccaaaggaggaataagtcctcacaggcgggggtttccggaggcatccggcgcgctgaggaaagaacggaggccaggacggcgcggcagggacgccgcgacgaggacggctgcgccacggagggcgcatccggacggtccgtcaggccgcagtgagtgacgaagggacagcgacggctgccggacgccgggattgttaaggggctggcgcaagccccttaacccgaccgcctgcacgggcaggctgaaactccccgacgcctggcgggcggaatcctctcagagcagaaacgctaccgccaaactacaaccttaccggcgaaatattccaaatctcatccgcgtactcctgaatcgtacggtcagacgagaaatagcccataccagcaatgttcatcgccgcgcggtactgccattcatccggctggcgatacagctcatcaaccttatcctgggtatccacatagctgcggtaatccgctaacaattgatagtgatcgccgaagttaaccagcaaatcgaacagattccggtagcgaccagggtcctgcgggctaaagacacctgaggccagctgcgtcagcacctgatgcagctcggcatcttcttcatagtatttccgcgggttatagcctgctttacgcaaggcttcgacctgcggcgtggtattaccaaaaatgaagatgttttctttgcccacatgatcaagcatctcaacgttagcaccgtccagcgtgccgatagtcaacgcaccgttgagcgcaaacttcatgttactggtacccgatgcttcagtccctgccgttgaaatctgctcggagagatcggcggcaggaataataatctgcgccaggctcacgctgtagttaggaataaacacgaccttcagtttgtttttaacctgcggatcgttattaatgaccttagccacatcgttgatcagatgaataatgtgcttggcaacgtagtaagccgatgccgctttacccgcaaaaatgttaacacgcggtacccactcggcgtcaggatcggccttgatacggttgtagcgcgtaatcacgtgcaaaacgttaagtagctgacgcttgtactcatgaatgcgcttaatctgcacatcaaacagcgcattcggatcgataacaacatccagattcttcgctacccaggtcgctaaacgctttttgttttcgagtttggcttccgccactttctcaataaacgccgggtaatcaatacacgtcttcagctcgctgagctggcttaagtctgtacgccagttacgaccgatttgttcgtccagtaattctgacagcggcgggttagccagcgccagccaacgacgcggtgtcaccccgttggttttgttacagaagcggccagggaacaggcgggagaaatcagcaaacagggactgaaccatcaggttcgagtgcagctcagaaacgccgttaactttatggctgacgacaacagccagccaggccatacgtacacggcgtccgtcgttctcatcaatgattgaaatacgcgccagcagatcccagtcatcagggtagtattcctgaatcgttttcaggaagaagtcgttaatttcaaaaataatgctgaggtgacgcggcaggatcttaccgatcatatcgatcggccaggtttccagcgcttcgctcattaacgtatggttggtgtaagagaacacctggcagcacacatcaaacgcatcatcccaggtaaacttgtgctcatcaatcaataagcgcatgaattccggaatagccaataccgggtgcgtgtcattgaggtggatagcaattttgtccgccaggttgtcccaggtacgatgcatcatccagtgacgattcaggatatcctgcacggtggctgacaccaggaagtactcctgacgcaagcgcagttcacggccggaataggtcgagtcatcgggatagagcacacgcgacacgttttctgagtggtttttatcttccactgccgcaaaatagtcgccctgattgaatttacccaggttgatttcgttactggcctgcgcggcccacaagcgtaacgtattggtcgagtctgtgtcgtagccagggataatttgatcgtaggccatggccagaatttcttcggtttccagccaacgcaccttggcaccttcgtgctgaaggcgaccaccgaagcggactttatagcgggtgttgaaacgctgaaactcccacgggttaccatattccagccagtaatccggggattctttctgctcgccatcgacaatgttctgtttgaacatgccgtaatcatagcggatgccatagccgcgtcctggcatgcccagcgtcgccagagaatccaggaagcaggcagccaggcggcctaaaccaccgttacccagcccaggatcgttctcttcttccatcagctcggccagatcgagacccatttcgtccagcgccatattgagatcgtcgtagatccccatggccaacagcgcattgcccagtgtgcggcccatcaggaattccatcgacagataataaacctgacgaacgtcctgagaaagttgagcgcggttagaacgcagccagcgctcgaccatgcgatcgcgcacggcaagcagcgcagcattcagccactcatgtttgttagcaattgaagggtctttaccaatggtgaacatcagcttgtaagcaattgagtgctttaaagcatcaaccgtcaacgtaggtgaagcgtaagtgaatggtgtcgtcattttctgtttcccagtccgttacaacaaacgttggtaaagatcgcggtaggcttgtgcggcgacctgccagctaaagtccatgcccatcgcctgacgctgcacatagcgccagagtgaaggacgagaccacaatacgaacgcgcgacgaattgccctcaacagtgaccaggcattactgtcttcgaaactgaagccgctggcaatgccatccgccagattttctaatgagctgtcgttaaccgtatcagccagtccgccggtccggcgaaccaagggcaacgtaccatatttcagtccatacagttgtgtcagaccgcagggttcaaagcggctcggcaccataatgacgtcggcgccgccaacaatacggtgagaaaaggcttcgtgatagccaatctgtacgcctacgctgccgggatgttccgccgccgcggccagaaagccttgctgcagctcggcatcgccctgccctaacagcaccaactgtccgccctgcgccagtaaacccggcagcgcttccagcaccaaatccaatcctttttgccgggtcagacggctgataacggcaaataccggtgctttgtcatcgaccttcaggcccatcgcaacctgtaactggcgcttgttttctgctttcgcttccagcgtatcccggttgtaacgggagctcagcaggagatcgtgtgaagggtcccaaatcgccggatcgaccccgttcagaaccccactcagccggccttcgcgcatgcgctgtgccagcagcgtttccatgccatagccatactctggcgtggtgatttcatgtgcgtaggtcgggctgaccgccgtcacgtgatcggcgtaaaataagccggctttcaggtaagagatctgaccgaagaactcaaggccaaacatattaaaaaaggcgcgcggcagttgaatctcgtccagatggtgcgctgagaacagtccctgataagccaggttatggacggtgaagacagatttggccggtcggccgcgtgcctccagataagcacaggtcaggccggcatgccagtcgtgcgcatgaacgatatctggccgccagtagctatccagcccgcagcccagctcacagcccatccatcccagtaaagcaaaccgtaaatagttgtcgacgtaggcaaactgcgattcatcatggtaagggcttcccggccgatcgtagagatcgggggcgtcgataagatagatgcccaccccatcgaagcgcccaaaaagcaggcgaaccggaccggcaaaggtttgcagctccgcgaccacctgagtatccggtattcctttacgcaatgcaggaaacgcgggcaataacacacgcgtatctgttccacccgcaatttgtgcctgaggtaatgctccgactacatcagccagcccgcccgttttcagcagcgggaaaagttctgaacagacatgtaaaacctgcatcctcgacctcattaagttaccaggcacgatcctcgtgccgattgggtgtgtgccgcttgtcgtttatgatcccgcactatttaatttggcaagcatggtgcgggtgaccagtacaatgccttcttctgaacggaaaaaacggcggctgtcttcatcagggttttcaccaatcaccatcccttctggcagcacacaagcacggtcaatgacacagcggcgcagacgacaggatcggccaactaccacatcaggcagcagtaccgttgaatcaatattgcaaaatgagttcacccgcacgcgggaaaacatgaccgaattcaccaccaccgagcccgagataatacagcccccagacaccagtgaattcatcgtcataccatggctaccagagcggtcctggacaaactttgccggtggcaaaggttccatgtgcgtacgaatcggccaggtgctgtcgtacatatccagttcaggggtcactgaagccaaatcaaggttggcgcgccagtaggcttccagcgtcccaacatcccgccagtaaggcggtgcctcgtgatcgttttgcacacaagagatcgcaaacgaatgggcgtaaccctcaccactcgcgaccactttgggcagaatatctttgccgaagtcgtggcttgaacccgcctcgttcagatcgtcttccagtaagccatacaggtaatcggcgtcgaacacataaatccccatactggccagcgattttgtgtcgtcacccggcatggtcggtggcttcggcggtttctccacgaaatcgattactttattgttttcgtctacggccatcacgccaaatgcggtcgcctcatgcaccggtacgggcaggcaggcaatggtgcaccgggcttcattcagcacgtgatccaacaacatccttgaataatccatcttgtagatatgatcgccggcaaggatcaccacgtactgtgcgccatagcgccgaataacgtcgaggttctgtgtgacggcatcggctgtaccgcgataccactgctcagtggaaaagcgctgctgagccggtagcagatcgacaaattcattcatctcttcgttgaagatagaccaaccgcgctgaatatgttgggttaacgtatgagattgatactgcgtaatgaccccaatacggcgaatgcctgagttaacacagttggaaagggcaaagtcgataatacggaatttaccaccaaagtgaacggcgggcttggcacgcttagcggtaagatccaccagacgcgtaccgcgtccaccagccagtacaagggcaacagtttgtgtagggagctggcgcgccagcataagatgttctgctctttctaatttgaccatgtctgactccttatcattgcttttggaacacacacacagcgtgtgcgggaccatgccagacagttaaccggatggggtaactttccccggtgaaaggaggaaggacttgccattctccgtctggtaaggcgatatcacatatcgaatctgtcgcatttattgttattaaccagtggcctgagagcagaatttgcaacctgcgcacgcgctgcttccagccatcttcttctataggtttaccctggtcgtccagccactgaacgttgccgtcatcgttctgccaccagcgatccgaggtaagtgccgggatgcgcttacgcagttgaatcagcgatgcagtaaaatcgaccagtcctctttcttcttcatcccagttgagccagctcagcgggttatcctggcaataggcattgttattaccgtgctgactttgaccgcgttcgtcccctgccagcaacatgggcgttccctgtgaaagcagcaacgtcgtcagcagcccttccatgctgcgcctacggcgttgtgccacctcagcactgctctccagaccttctgtaccatgattgtgactatagttgttaccgtgcccgtcacggttttcttcaccgttagcttcattatgtttgccattgaagctcaccaggtcgcgcagcgtaaaaccatcatgggcggtgatcagattgatggtcgcgtgcggcttgcgatcgtcatgctggaaaagatcgcttgaagcggcaaaccggcaggcaaaatcaccgttagtgacatcgccatgcaaccaggcacgccgggctgtatcacggaactgatcgttccactctgcaaaaggcgaagggaaatttcccacctgataaccaccagggccgatatcccagggttccgcgatcagtttgaccgttgacaggattgggcaggcgcgaatggcctcaaataaggcagcgtcacggtgatagtcaggttcgcgtcccagtacgggagcaaggtcaaaacgaaaaccatcaacgtggcaggtgcgtacccagtaacgcagcgcctccagtatccagttcatgacctgcggatgactgagattcaaggtattgccgcagccggtccagttctgataagcgccttgatcgtccagccagtaatagctggcgttatcaatgccgcgaaaggaaagggttggcccggtgtcatccagttctgccgtatggttaaacaccacatccagcagcacctcaataccggcagcgtgcaggcgtttgaccgcctgttggaactcctgcagcggagacaagccgttctgaccagacgcataacggggatcgacagcccagagcgcaaaagggttatagccccagtagttggtcagccccaaacgcagcaggcggggttcgctggcgaagtgggcgatgggcagtagctcaatggcggtaatgcccatcttaagcagataatccaccatcaccggatggccaagcgccgcataggtgccgcgcaacgctgttggaatgccgggatgctgctgcgtcagaccgcgtacgtgcgcttcgtaaatgacactgcggccccatgacgtgcgtggcggcacatcgccttgccagtcgaaatcatccgtcaccaccacacatttcggtgccagtgcggcgttgtcgcgactgtcaggttcagtgtagccacagtgaaaacgcgggtcatcgggcacatcgccctgcaccgctctggcacagggatcgactaacagtttggcaggattaaaaaagtgtccctgctggggcgcccaaggcccgtgtacccggtagccataacgctgtccgggtttgagtccgggaagatagccgtgccagatatcgccgctccggtcagtgagttcaacgcgctgctcaatgccgttctcatcgaacaggcacagttcaacgcgctcagcatggtgggagaacagcgtaaagttgacgcccttcccgtcatagctcgcacccagcggttggggatgtccggcacctaatgtcattccccctcccgcacgaaccatactgtagagagcggtggtaaattcaggctcagtgactgcgggcgaccgtggctttcctgttgatcggtgtgcaccaggtgattacgcacgtcactgccgtggtactcatgttggtcggtattgagcacctcgcgccagctgccagcctgattaacgccaaagcgataagcagggcgcggcacaggcgtaaagttgctgacaacgatcacttcgttgccgtcgcggtcacgacgaacaaaagcaaagaccgaatgttcagcatcgtccaccaccaaccattcaaatcctgacggatcaaaatcaagctgatggagcggcgtgtaatattgataggtgtggttcaggtcgcgtaccagacgctgcacgccgtgatgccagttgtcctcgccttccagcaggtgccagtcaagactgacatcgtgattccactctctgccctgggcgaactcattgcccataaacagcagttttttacctgggaaagcccacatccacccgtaataggcacgcaggttggcaaatttctgccaggcatcgcctggcatgcggtcaaggatagatcgtttaccgtgcaccacttcatcgtgcgacagcggtaatacgaagttttcgctgtagttatacatgatgccgaagctcatcagattatgatgatagcggcgatgtattgggtcgagcttcatgtagtcgagcgtgtcatgcatccaacccaggttccacttataccagaaccccagaccgccaccttccgggggccgtgagacgccaggatagtccgtcgactcctcagccatggttacggagccaggtgcgacatgccccagcgtgcggttggtatagcgcaggaaattgatggcttcgagattttcccgaccgccgtactgattgggaatccactcaccctcggcgcggctgtaatcgcggtaaatcattgaggccaccgcatcgacacgcaggccatcaataccaaaacgttccatccagtaaagcgcgttgcccgccaggaagttactgacttcacggcggccaaagttgtaaatcagcgtattccagtcctgatgataaccttcgcgcggatcgctgtgctcatacagttcggtgccatcaaacttcgccaggccaaagtcatcgctggggaaatggcccggcacccagtccagtagcacattcaaccccgccgcatgggcactttcgataaagtagcggaaatcatcacgggtgccgaaacgtcgtgttggcgcatacatacccagcggctgatagccccagctgccgtcaaacggatgttcgttgatggggagcagttcgatgtgggtaaaccccatctctttgacgtagggcacgagctgctcagccagctctttgtagctgagccagaagttatcgtcggtatgacgacgccatgatcccaaatgaacttcataaatggagatgggtttatcaaacgcattcgccgctctgcgcgaggccggcatctccaccttttctggcaggccgcaaatcattgaggcggtttgaggacgcatttgggcttcaaacgctaagggatcggccttgatgcgtaactggccatgcgcatcgatgatttcaaatttatagagttgcccgttaatggcaccgggaacaaacagctcccagacgcccatctcctgacgcagacgcatcggatggcggcggccatcccaaaagttgaaatcaccgacaacggagacgcggcgtgcgttgggtgcccagacagaaaaacgcgtaccaatgacaccatcgatcacatcgccgtgcgcacctaaggtttcataaggtcgcaggtgagtgccttcccccaataaccacaaatccatctcttgtaacaacgggccaaaacgataagcatcatcaatcagattttgctggccatgccagttaaccgccagttgatagcgaaaaggatttttacggcgaggcaccacgccactgaaaaagccacgggaatcatcgcacttcagttggacaagtttgcgccctgttgaggtttcaatgacccagacttcaagtgcttcaggaagcagcgcccgcacttcgagtccgttgtctgttttgtgcatccctagtagtgaaaaggggtcggaataattacccgcaaaaagggcattgatcgcctggcgatcgggtagctctgacatgactttcttcctgtgatagttggcaggcgaaaagaccacgatgcagatttatcgcgagtctcgtgcgctgctcttcattgagccatgagtacagcggcgtgggtgccagaacgaaacgcctgtcaccacgcgcctccttgaatcacaaccagttcgcattaagcctgtctgcttgatgcaaggcccgaagttgcgccagacacttgtccggcaacgacccagaccttaaatgatattcacgcgacgtctcaggcggatgccggctaccttaaacgtgatttgcccacttgtgctgcttgcattccgtccggtttgaggttgaaaactcttcaccgtcgtttctgcgcgaatcgggtacaccattaaaggatatttatgtatagcggatctgcgtttcacattctttaataaaatacggcgtttttctcctgcaaggataaatcagcacgtttaccgcatcatttttgccaggagaggccagactgagagaggaacgtttcactgcccgccagtctgccgtgctgaggccttctgcctcataagcatttcacccgtcagtttcagcgcagagtaaaacagtcacagtagttggtgttctgccagcgagagacgctttttgtcgcctcgcgtgaccgatgcacgttgctaaaaacggcaccacatcatgtcttgtcaacgtctctttacccactacgccaaccctgtcgttgataaaacaaaatccttaactcacgttacgcctttgttaaaggatagcttgatggcggacgttatcagtgcagaaaagcaaaaatttatttctaaacaggcaaaaaggggaagcggatcacttcgtgatcgtaacgatagaagggtttgcagtgatttgtgggaaaaagaccgggaaagcccggtcttataggtaattcagatttagtcgatcagcaggcgcaacatacgacgcagtggctcagccgcgccccaaagcaactggtcgcccacggtaaaggcagaaaggtattctggccccatattcagtttgcgcagacgaccgaccggcgtgctcaacgtgccggtaacggcggcaggcgtgagttcacgcatcgtgatctcacggtcattaggcaccactttcacccattcattatgggcggccagcagttgctcgatttccgccagcggcagatcctttttaagcttcagcgtaaaggcctggctatggcagcgcagcgcacccacgcggacgcacagcccgtcgacaggaatcacgcgttgggttgccagaatcttgttggtttcagcctggcctttccactcttcgcggctctgaccgttttcgagttgcttatcgatccagggaatcaggctgcccgctaacggcacgccgaagttatccgtcggcaatgtgccggagcgggtgaaatccgttacgctacgctcgatatccagaatcgctgaagccggattttgcagagaggtggcgacgtgatcgtgcaacatacccatttgcgttaacagttcgcgcatatgacgcgcaccgccgccagaggccgcctgatacgttgccacggacgcccactccaccagatcctgcgcaaacaggccgcccagcgacattaacatcaggctgacggtgcagttgccgcccacaaaggtcttcacgccgctgtcgatgccctgacggataacctggtggttaaccgggtccagaataatgatggcatcgtctttcatgcgtaatgtggaggccgcatcaatccagtaaccgttccagccgctggaacgcagctttggatagacctcagaggtatagtcgccgccctggcaggtaataatgatatccagcgccttcaacgcctcaatatcaaaagcgtcctgcaatgtcccctgctgtttaccggcaaatgccggggccgcctcaccgtgctgtgaagtggagaagaagaccggattgatcacatcaaaatcacgctcttcgctcatgcgggacatcagcactgagccaaccattccgcgccaaccaactaaacctacattcttcatgtcatgtccgtttcaggatgatctacacctgactttcttatcgaagggaaaagtgtcgtggtactctcacgccactctgcgtaataatcagcattgcctgtgttgattaactctacaaaatgcagcttttctggcaagtgaattaatgtaatcaggccaactttttcagcaacagtgctaataacctgactttatctataacgagaagacctaaaacgaatgactgaaatgatctcggcaacaatattattgttgttaataatggatccattaggcaatttgccgatttttatgtcggttttaaagcatctggaaccgaaacgtcggcgagttgtgctcattcgcgaaatgttgattgcgctcattatcatgttgctgtttttgtttaccggcgagcgaatcctggcctttctaaacctgcgcaccgaaaccgtgtctatttccggtggcgttatcctgtttttaatcgccatcaaaatgattttcccgtcccctgaaagcagcagcacaggcttgcctgccggagaggaaccttttctggtgccgctggcgattcccctggtcgccggcccctccctgttggcaaccctgatgctgctgtcgcatcagtatccccatcaaatgtcgcatctggtgggggcactgctgattgcctggggcgtgacggtcatgattctgctgttatcggggctgtttcttcgcctgctgggagataaaggcgtaaacgcgctggagcgcctgatgggattgattctgatcatgctggcaacgcagatgtttttagatgggattcgcgtgtatctgaagttatagcgatgaccggtttcaaccgggcagccctgcccggttgaaacgcatcaggaaagcagcgtgaaggcgatcatgcccacgacggcaccgacggtgcccaaaatggtttccatgagcgtccatgtctttaaggtttccccttctgtcgccccggtaaatcgcccaaacagccagaagcctgcatcgttaacgtggctgataataatggaaccgccaccaatacaaatggataaggctgccagctgcgcgccgttataatgcagcggctcaatcacaggcatgattaaccctaccgtcgtcagacaggcaaccgttgccgatccctgaatcacacgcaccgcgcctgacagaataaaacaggccagcgcaacgggcagaccagcaccggtcagggcattccccagcaccggcccgacgccagaatcgaccagcacctgtttaaagacgccgcccgcaccaatcaccagcaaaataatgcccgcaggctgcagggcgctgccgcatatctgcatcactttctctttgtccatgccctgacgataagccaggccgtaaatggcaaccaggcaggccagcagaatggcgatgaaaggatgtccgatgaactccagccactggtaaagcgtggagccttcgcgggtgaagcgcgcgccaatggttttgagtccaaccagcaccaaaggaaacaggattaaggccaggctgaaaccaaaagagggtagcttgttttcatcaatatcgggctgatgatcttcaggtggcgcgctgaacgacacgcgcttagcaataaaattaccaaacagcggtcctgcaatcagcatcccaggcagggcggcacacaggccgattaaaatcatccagccgaaatctgcatgcatttgcgaggctaacagcatgggcgccggtcccggcagcagaaaggccgcggcggccgccacaccggcaaacagcggaatcaccagcttcaccagattgtcgcccgtgcgtcgcgcaacggcgaaagcgatgctgatgagcagcaccacggcgacttcaaagaagagcggtaaggcgcagattaacccggcgatgcccatggcaaagtgagcgcggttttcgccaaaggttttcagcatgcgaatggcaatctggtcaacggccccggtttcatgcaggattttgccaaacatcgcgcccagcgccaccacgatagccagaaagcccagcgtaccgcccatccctttctgcatggtttctgcaattttctccagtggcataccggataacagcccggccccgaccgataccaccatcagggcgagaaaggcatgcatacgggctttcatcaccagaaaaagcagcagcaggacagagcctgctgcggtcaaaataagtgtcgcggtattcatggcctagccttgattgatagcgtccttgatagtcgcaaccgtagccgccacaacctcgtccagcgggttcgcgatatccacgaccagcacatctgtctcgtcactgcccggctcttccagggtggcaaactgtgttaccagcatttgcggcttaaagaagtggcctttgcgcgctttcaggcgggattcgatggtatcgaaatcccctttcagatagacaaaacgcaggttgtcattgccctggcgcagaatatcgcggtaatgctttttcaatgcagaacagacgatgatcgagatggcctgagtccgctgcatggcgaaagccgcatcgttcagcgcctgtaaccatggcaaacggtcatcatcattcagcggatgaccttctgccatcttcagaatattggcgcgcggatggaggaaatcaccatccagaaaagcggtatttaactggtgggaaacctggttggcgacaacggatttaccgctgcctgaaacacccatcagaataaagacgtgatgtggcgtggattgcgttgtcattttttcactccggcaagttcagcttgccatgttaccgataacaatgatggatgacattgtcctggcggtattacacgctggcaacctttttacttcacaaagcgttaaagtgtgagctgactcataaaatcgtgttaatcagatactgccaccttccagaatctcaaatccgatatccagcggttgggtgacgctgtgttcaccggcgatacgcgccagtaacaacgcggcagactcacgtcccattcggtcacgtggcgttaatacggtcgccagctgtggcgtcacaacctgactaatatcatggccgtggaagccagcaatcgccatctgagaaggcaccttaaggccctgtcgctggcactcaaacatcgcgccaaccgccaaatcatcattggtgcagaacaggctgtctgtttggggataacggcgctgcgcttcacgcaggagatcgccacccgcactaaaagaagaggcttcttccatcatcacgctgcgcggcgttaagccggcttcacgcattgcggcttcataaccacgttgcttttgcagcgtacgctcatccaggcgcgcgcccagataaacggtgtgccgatgacctttgtttaaaatcgccagcgtcatttgccgggccgcttcgacattgtcaaagcccaccgccatatcaagacagggggtgacgctgtccatcatttcaataaccggaataccggccacttccagcatgcgcaacgttcccggcgtatgggtacgctccgtgagaataacgccgtcgatgttccagcccagcagcgaacggagctggcgctcctctttttccgggttatagccaaagtgcgccaccagcgtctggtaaccggcttcatcggtaacggcttcaatgccacgcagtacgtcggcgaaaacctgattggtcagggaaggcagtaacacgccaatggcccggctggtcgcattcgaaagcatatcaggggcacgattcgggatgtaacccagttcatccagcgccacggcaatcttttcccccagcgcaacagacacttgatcgggattgcgcagataacgactgacagtcattttggtgataccgatacgatcggcaacgtcctgtaaaaccggtcttttcttcttcatcgtaagcgcctgggtagacctgaaagcaaattacgacgagtctatcacttttttacggccagattgccagtggggcgagatatgcccgccccacacagccttacaccggcggcagatcaaacagcagaacttctgcgtcgctgtcggcctcaagcacaagacggctttcatcccagacggcaaaggcatcgctgtttgaagctggctgaccattcactttcacctcgcccttcacgacctggacccagatacggcggcccgcatcaagagtcacgctgtcgctatcacccgcagcaaacacccagcgcgacaatgtcatgtcctgccagactttgagcgagccgtcacgcgcgtccggcgtcagaataaactgacggccctgtacgtccgggaagcgacgctgagcgtagcgcggctcaataccggtgcgctctggaataatccagatttgataaaggtgcaggggttcggttttgctggcgttatattctgaatgacgcacgcccgtaccggcactcataatctgaaattcgcccgccggaatctgctctttattccccatgctgtcctgatgttcaaccgtacccgacaacacataggtcaaaatttccatatctttatggggatgcgtaccaaagccctggcccgggtcgatcacgtcttcgttaatgacgcgcaacgccgagaagcccataaaattcgcgtcgtgatagttggcaaatgaaaaagtatgccagctgtccagccagccatgattcgcgtgaccacgttcttcagctttacgtaaatagatcatgttcaaatctcctcaatgttttttatagtgtggtatcaggtggaaaagattgatagctgaaaaacttcacctctctgttcaaaaattatgaacattgaatgaagggttgttgaaaggcgctgaagaaggtgtcgcggagagtgggcaaaaaaaagccagcacgtggctggctaaataatactggaagcaatgtgagcaatgtcgtgctttctaaagtgtcgctgacaccggagaacgcatagcaataataatcattatcattcgcgtctgtaaagtctttttgcgcattattttcattgacgtccaacgtgaattccttgatgtttaaagggtttatcgcgccacccacaaggaaaatagccatgagcccagtgaccatccgtcatgccattcccacggatgcgcccgcattaacgcgcctctatagtcagccggagacccaggcggcgacgctgcacttgccctatccatcgcccacgctgtgggagcaaaaacttagccatccgcgcgcgggcgtacatatgctcgtggcgtgtctcgatgagcaggttgttgggcaactgacgcttgaggccatgacggctgcgcggcgtcggcactgtgccaccctaggaatgggcgtcgatccggcgtttcatcgtcggggcattggcaaagctctgatggcggccatgatcgatctgtgcgacaactggctacagattacgcgtattgaactctcggtatttaccgacaatgacaaagcgatagcgctctatcacgcgttcggtttccggattgaaggcaccgcgcaaggctatgccatgcgcgacggtgccatgattgatacacattatatggcgagactgaaagtatagcgtgacgggcaaccccaaggttgcccttttaaatcaatatcctgcactcagatcgtctacagagcgcggatcagaagccccgtagagcgttccgtcaggtccaatcataatactttgtgtactgcccatcgacggcagaactttcacatgctgacctttggcttccagcaaccgcaaggtatccgggctgaaccccttctcaacccgcagttgatcgggcagccactggtgatggaagcgtggagcattggttgcctctgccacgttcataccgtaatcaatgctgtttaccaccatctgtaataccgtcgtgataatgcggctaccgccagggctgcccgttaccagccaggttttcccgtctttcgccacgatagtcggtgacatcgaagagagcggacgtttcttggcctgcacggcattggcttcgccaccgactaacccataaacatttggcgtacccggcttggctgagaaatcatccatctggttattcatcagaatgccgctgttaccggcgacgataccgctgccgaagtaggtgttaagcgtataggtgacagcgaccgcattgccacttttgtccacaaccgaaaaatgggtggtttggttgctttcatacggagccagtttacccggcttgatgtcgctggacgggcgggctttggcaatatcaatctgctgcgccagggacttcgcataggctttactggtcagcgcctgccacggcaccttaacgaaatccgggtcgccgagatattctgaacggtccgcgtaggcatatttctccgcttccgccataacctgcatcgcgtccgcactgccgaagcccattttgcccaggtcaaaattttccaggatattgaggatctgcacaatatgaataccgcccgatgaaggcggtggcatggagaacacctcatagccacgataggtgccgctgacaggcttgcgttcaaccgcgtgataggctgctaaatcggctttattgattaacccaccatgctgggccatttcggcagcgatttgatcggcaattttccctttatagaaggcatccgggccttgctgagcaatcaactgtaagctgtgggccagatttttttgtaccagacggtcgccctttatccacggcgtgccatctggcttatagaaaatggctttgctgttgggatgcgtgatcagcacttcctttccgtaggttttcagatcatcagccagcgcatcgttgacgacaaaaccgtcacgcgccagtttaatggcgggagccagcagcttgctgagcggcagcgtgccatatttgttgacggctaaagcaaaacccgccacggtgccgggcgtacctgaggccagatgtgaagtgagtgaaagcttgctatcggcatttccctgcttatccaggaacatgtcgcgtgaagccgccgccggggccatttcacggaaatcgatggccgtggtctgtcctgatgccgtgcgcagcagcataaagcccccaccgcccaggttgcccgcctgcggatgcgtcaccgctagcgcaaaacctaccgcaacggcggcatccaccgcgttaccgccctggcgcaggatatcaacgccaacctgggttgccagcgcatccactgaggccaccataccgttatgcgccttaaccggatgaaacgtatcgctgtcgataccataagagactggcggtgcctgaaccggcgcggcacccgccccggtcacaacagtaaaactcatcaataatgaccagcccagctggcgaagtttgccttgcatcatcatgttgtttccactctccacttttatttacatttctttattctttatgtaactgactacaaacacagtcgaatatcaagaagtaacgcaaattcagcgcactcctggagcagtaatttgaagtcgtgcataaacttatctgcacgaccccgtgacccgattcgggcatgcgcacacagcatccggtcgtttactggaggataaaaatgaaaaagtggcttatggttttcgccgccctgttgccgttaaccggcatggcaaacatgttgaataacaccaacaatcctaatcaacctggctataaccccagccagcagcgaatgcaaacgcagatgctcaatcagtcgcagcaacagcagaataaactgcagcaggaccagcagcgtcagaaccaggatttacagcggaaattgcaggaacagcgggacagtgcccagcagcgcgtaattaaatcgcagccgggccagcagcagaatcaacagactcaacagaattcgtattaactaaaatcggggccaatcaggtcgatgctgtcggtacagatggcatcgacgccccatttcagcagcgttctggcccggtcagggctgttgacggtgtaaaccagaatacgcagatcggcctcttttagctctgccacccgcgcttcggttaaaaccttgtgattcagatgaattgaggtgcaatccagcgcgccagttttctctttccatgccgtatcccaactgtgagataacagcccacgcggtagctgaggctcagcctgcatagcggcttccagcgccgcatacgaaaaagaagaaagcagcggcaaggtttgcccctgccacagcgttgccgctgcctgagcgatagcgcgcccggtttccgcgtccgttcctgttgtgggtttaatttcgatgtttgccatcatgccatgctgacggcagcgttctgccacctcatccagccgggccagtttttcgccctggaagacgtcactaaaccagctgccagcatcgagttgcgacagcttgtcccatggcagctcaccggcaacgccccagccgttactggtgcgatctaacgtatcgtcatgcagcaggaagatgtgcgcatcggccgacaatttggcgtcaaattcaatcatcagatggccatattttgcccccacatcaatcgccgcaagggtattttccggggcgagtttgccaccgccacgatgggcgacgatcgacggataaggccacagttttttgctcattccagacgtttcccgtgcgttgaatcgaagaaatgtagcgaccctacaggcagatgtaaccataaggtactgcctgcttcagggcgctcgctgtgtggcaagcgtaccactaaacgcgcctcaccgatgcggccgtgtgccagattatccgcgcccaacatttccagggtttccacccggaacggaatgccgccctgctcctggctggtgatctgaatatgttcgggtcggacgcccagtaccacaggacgattggcccacttcgctttcccctcgccaacagcgatgccgtgagaggcatcaaccgtaaagcgtgagccatcctggctgatattgccatggatcagattcatggccggtgaacccataaatgaagccacaaactggcttgctggtcgttcatagacctcaaccggtgtgccgatctgctcaagaatccctttattcatgaccataacgcgctgggccagcgtcatcgcctctacctgatcgtgcgtcacgtataagctcgtggtctgcaaacgacgatgcaactgctgaagctccaggcgcatctgaacacgcaggcgggcatcaaggttagagagtggctcatcaaacagaaagacggctggctcacgcacaatggcgcgtcccatggcaacgcgttggcgctgcccaccggataactcgcgtggacggcgcgtcagcagatgatccagctccaggctccgcgcggcttccagcacccgttgacgaacctgttctttgctcatgccgcgaattttcaggccataggccatgttctcttcaacggacatatggggatagagcgcatagttttggaacaccatggcaatgccgcgatctttcggctcttcatgggtcacgcgtttatcggctatatagatatcaccagaggttacccgttcgagtccggcgaccatacgcaacagcgtggatttgccgcagccggaggggccaaccataaccataaactcaccgtcattaatcgtgacgttgagcggttggatgatctgatttttaccgtcgtaagacttggtcaccgcctgaagggttacgcctgccatctctatttctcgctctcaaccagaccacgcacaaaggcgcgctgcataacaaataccaccaccaccggtggaatcagggttaataacattgccgccatcacttcgttccactgggtcggcgaaccactggtggagatcatgcttttgatcccggccacggcggtgcccaggtttgcgttatcgataattaacagcggccagagatactggttccagccgtagataaaggtgataacgaacagcgccgccaggttggttttcgacaggggcagcacaatgtcccagaaaaaacgcatcgcgctggcaccgtcaatgcgcgccgcttcgattaactcatccggcagcgacataaaaaactgccgaaacagaaaggtagcggtggccgaggccatcagtggcagagtcagcccgctgtagctgtccagcaggttgagatcggcaataacctgcactgtcgggaaaatacgcacttcgaccggcagcatcagggtgataaagatcatccagaagaacagggagcgcagcggaaaacgaaaccacaccagcgcaaaggccgacagaatcgacaccaggattttgccaatggtgatccccagcgccatgatgacgctgttcatcagcatcacactaaaggccgggccgttgccgttcacgccgcgcgtccagatgtgcgaaatgttttcccacaggtgcgtgccgggaatcagcgtcatcgggacgttatacacggcgtcgttatccagggttgccgccacaaaggcgacatagagcggaaacaggatggtcaggatgccgagcaccagcaccacatggctgaaaatgtccagcccgcgacgattttcaatcattggtattgcaccttacgctcaacgaagcggaactgaatgaccgtcaggccaataaccagcagcattaacaccacggactgtgccgctgaagaggagagatccaggccggtaaaaccttcccgataaattttatagataagcgtcgtcgtcgcctgtaccgggccaccgcctgtcgcggcatcaatgaccgggaaggtatcgaagaaggcataaatcaggttgaccaccagcagaaagaaactcacgggcgtgatcaacggcagcgaaatcgagaagaagcgacgcaccgggcctgcaccatcaatggcggcggcttcaaccagtgacttcggtatcgactgtaatgcggcgaaaaagaacaggaagttgtagctcatctgttgccacaccgaggccagcaccaccagaaacatggcctgtccgctgttctgagcaaagttccagttataacccatgtggttaagcagatagcttaataaacccagaccggggctgaacaggaacatccacaacacggcagcaataaccggcgccaccgcgtagggcagcaacagcagcatctgatagagcttacgcaggcgcaccacgtagtccaccagcgcggccagcagtaacgatgacaccatgccaaagaaagccaccatgccgctaaacttgatggtggtccagaaggtatccagataaagaccgtcggcaaacagccgtttgaagttgtccagcccgacaaaggtactggagataccgaagggatcaagattttgcagggaataccacagggcttcaccggccggccagacaaagaaaatagcggtgatcaagagctgcggcagcaccagaaaatagggtaacagtcgattgcgaaacaccgggcgagagggagacatagcgttctctgacttttaaggaaaaaaggccagccgcagctggccctgcagaacggattacttattctgttgctcgaaacgacgcagcagttcgttaccacgcttcactgcactatccagcgcggcctgcggcgactgcttgccggtccagacgccttccagctcttcatccagaatggtacggatctgcggcatattccccagacgcatgcctttggtataaggcaatggcggcttgttcatcatctggcgaatcgcaatatcggcacctgggtttttctcgtagaagccttctttcttcgtcagctcataagcggcagtggtaatcggcaggtagccggttttctgatgccattccgccgcaatttttggctcggtgaggaatttcataaattccgctgcgcctttgtaggtattggcatctttgcccttcatgacccacaagctggcgccgccgataatggcgttctgcggtgcattcgggatatccgcatcgtaaggcatcatgccgacgccgtagttaaatttggcgtaatggcgaatatccgccagcgagcccgatgaggccgtggtcatgccgcagtcaccgttatagaacttggcggtcgattcgtctttacgaccaaaataggtgaagtcccctttcttgttcatatcttccagtagctggatatgacgaacctgagccggtttgttgaactccagtaccgcatcggtgccgtcgaaaccgttatttttggtggcaaccggcaggccgttccaggcgctgaagttttcaatctgaatccagccctgccagccgctggcataaccgcaactcatgccggatttacgcagtgcagccgcatccttagccagttcctgccaggttttgggggcctggtccggattcaaacctgcttttttaaacgcatctttgttgtagtacagcaccggcgtggagctgttgaagggctgagagatcagctgaccttgtgcgttgctgtagtagccagcgaccgcagggacaaactgcttctcatccattgggatgccagcatctttgaacacctggtacaccggcacgatggctttggaggccatcatcgtggcggtacccacttcataaacctgtaacagagccggggcttttcctgtgcggaccgcagcgatacctgccgccagactttgttcgtagttccctttgtacaccgggacgattttgtaatccgggtgttcctggttaaaacgttgcgccagtgagtcaacctctttgcctaactcgccttccattgagtgccagaaagggatctcagtagcggccattgcattaccactgatcgccagaccgagcagtgcgctcatcaggctacgacgaaaagtaacaacggacatagaattttcctgttcaggtaggtacgcgcgttatcacgcattttttgctcgcgaagtaacatgacacgctgaaatgacggaaaaataacagtcagatgacggaaaaatgacagcggaatgtcagaagatgacagggataagcgggattaatgcatgaggacgatacgacgagggcaggaaaggtgagccagataactgaagtgtgacagcgccccaccctcgaaacccaaaaaagcgataacgagagtgagcgctgcccgacatgcgcctggcctgagagccaggcctgccacctatgcgcccagatatgcgctgcgcacggcctcattggaaagtaacgcctcgccgctgtcctccagcaccacgtgaccgttttccagcacgtaaccccgatcggccagcttcagagcctggttagcattctgctctaccaggaaaatcgtcatgccttcgctgcgtaactgctcaatcgtatcgaatatttgctgaataataatcggcgccaggcccagggaaggctcatccagtaacaacaggcgcggttgactcatcagtgcccggccaatcgccagcatctgctgttcgccacccgacatggtgcctgcccgctgaattttacgctcagccagacgcggaaacagcgtatacacccgttcgatgcgttgcagatactgctggcggctggcaaaaaaaccgcccattgccagattctcttccacggtcatgcgtgaaaacacgcggcgtccttcgggcacgatggcaatggcttcgcgcataatccgcgccgtttgccagtcggtgatggctttaccgtcaaaggtgatggtgccgctggtcgcacgcggttcaccgcatagcgtacccagcagcgtggttttgcccgccccgtttgcaccaatcagggtcacaatttcaccctggtcaatatgcaggctaacgccgtgcagggcctggatttttccgtaatgcgcactgacgttatcaatggttaacatggccatattacgcctctcctaaataggcacggatcacatccgggttattacgaatctcttccggtgtgccgttagccagcggcgttccctgattcaccacatagatacgatcggaaatccccatgaccagcttcatatcgtgttcaatcaacaacacggaaaccttatgctcaccacgtagctcggcaatcaactcatccagctcgtgcgtctctcgcgggttaagcccggcagccggctcatccagcattaaaatctccgggcgcgtcaccatgcagcgggcaatctccagtcggcgctgctgaccataggccagattaccggcctgacgattggccatgtccagcaagccgacgcgctcaagccaggtggcagcacgatccagcgcgtcgccttcactgcggcgaaaagcaggcgttttaatcagacctgaaaagacgccgcttttcagatgctgatgctgcgcgaccagcagattttcaatcaccgtcatttcgcggaacagacgtacgtgctggaacgtacgcacaatccccatgcgggcgatcttctgcccggataaaccggccagattcttgtcacgcagcgtaatgctgccgccagtgggcttgtagaagccggtcagacagttgaagacggtggttttacccgcgccgtttggcccgataagcgacacgatttcctggggccgcagttccagctttacgttgttcacggctaacagaccgccgaagcgcatcatcaggccttcaacggctaacaaaggctgactcatgcctgctctccttgtttaccctgcctgagtttcaggtgcggacgcttcatgggcagtaagccctgtggacgccagatcatcatcagcaccatcaatccacccaataccagcatgctgtactcattgagatcgcgcatcagttcacgtgaaaccaccagcaaaatggcggccagaataacggcgaactgcgatcccatcccgcccagcacgacgatggctaaaacaaaagcagattcgacgaaggtaaaagattccgggctgacaaatccctgacgggcagcaaacagcgtaccggcaaaccccgcaaaggcagcactgatggtaaaggccgtgagtttaatacgggtcgggcttaagcccagcgagcgacaggcaatctcatcttcacgcaatgcttcccaggcccggccgagcggcatacgcagcaggcggttaatcacaaacagcgtcagcaccaccaacagtaatgccaccagatacaggaaaatcaccctgtcactgggatcgtatttcatgccaaagacgtcgtgaaacgtgccccatccaccttcactgacgcggcggccaaactccaggccgaagaacgtgggtttgggaatctgggcaataccgttcggcccaccggtaatcgcggtgttattcagcagcaggatacggacgatttcgccgaagccgagcgtcacaatcgccagataatcaccacgcaaccgcaacaccgggaaccccagcagcagaccaaacgcggcagccactaaaccagccagcggcaggctctgccagaaaccgaaaccatagtaatgattgagcagggcaaaggtataagcgcctatcgcgtagaacccgccgtaacccagaaccagcagccctgacagcccaaccaccacgttcaaccccaggcccagcatgatgtagatgagcgtcagcgtcgcgatatcaacgctgccgcgcgagaccaggaacggccagataacggcggcggcgatcatcaatgccatgacgagcttttgctttggcgtggaaccatcaaaaccgggcagcaccaggccgccgctgcgtttcagcttgccctgaaacagcgggcgcagcagctggaacaggaacaccaccgcacaaccgataaatatccagttccagcgcacgctaccggcattcaccacctgcagcttcgtaccattcagatcgaggcgcattcccataaagaacgcggccagaaccagcagcatgaccgtagagatcagtgcattgaccagaccaaggcgtttcatactttctctacctccggacggcccagaataccggtcggcatcaccagcagcaccacaatcagtaaggcaaacgacaccacatctttatattcggttgagagataagccgaggtcagggcttcagcaatgcccagcaccagaccgccgatcatcgcgccgggaatactaccaatgccgcccagtaccgctgcggtaaaggctttcatgcctgccataaagccgataaacgggttgatcgagccataaaactggcctaacagcacaccggccactgccgccatcgccgcaccaatcacgaaggtgagcgatatcacgcggtccgtgttaatccccagcagactggccattttcaggtcttcagcacaggcccggcaggcgcggcccatgcgggaatagcgaataaacaaggtcagcgccagcatggtcaggaacgtcaccacccagatcaccacctgcatggtcgacagcgtggccgcaaaaccattgctttctcccagcgtccactggccggtaatgagactcggcagcgcaagatcgcgtgagccctgggtcaggctgacatagttttgcaggaagatagacatcccgatggcggagatcagggcaatgaggcgcttggaggagcggaccggccggtaagccacccgctcaatgctccagccataggcgctggaaataatcaccgccatcacaaaaccggcggcaatcatcagccatgtggtatcaatgcccatcatcatcagggcggcaatcacgataaaagagacatagctgccgatcatatagacctcgccgtgggcgaagttgatcatgccaataatgccgtaaaccatggtgtagccaatggcgatcagcgcgtaggtgctcccgagggttaccccgttgaacatctgctgaatgaaatagagaaactgctcggacatagtgaggacctactcaggaaccagaaaacccctctcctgccagcagaagagggttagcaaggcgaaggcggcccgacagcatgcgcatggccttcgcctgcttccccgatcaccggtcacggggaagagtcattgccttatttaacagcggtagacgaaccgtctttgtgccatttgaagacaccaaattcaaagcccttcagatcgcctttctgatcccagctcaggtcgcccatgaccgttggaacaggtgcgccggttttcaggttcttcgcaatcgcatcgggttcatcgctcttgctgcgctcaatgccggtgaccagagactggatagccgcataggtggtccagacgaaaggtccggtaggatctttacggttagacgcggtgttggctttaatggcttcaacaatcgccttgttctgtggcagctggtcgtaacgttttggtaatgtgacgtacagcccttcagacgcatcgcccgcgatgttagacagcgaggcattgcccacgccttctggtcccataaagccggccttcaggcctgcggctttagcctggcgcagaatctggcccagctccgggtagtaaccgccgtaataaacgaaatccacgttttctttcttcagacgggcaaccagggtagagaaatctttatcgcctgcggtgatcccttcaaacatcaccacgttgccacctttggctttcagggttttctggacggattccgccaggccctgtccgtactgctgtttgtcatgcacaacagcgatacgttttggtttaatcacgtccaggatgtagttcgctgcggttgggccctgatcagaatccagaccggtggtgcgcatcacgtctgcataaccccgtgcggtcagttcaggtgccgtggcggccggggtaatcatcagcacgccttcatcattgtagatgtctgaagcaggctgcgttgaggaagaacacaggtgtccgatgacatatttaatgccgtcgttaatcaccttgttggccactgcaaccgcttgttttgggtcacaggcatcgtcatattccacaccgaccagtttgtcgccgtttacgccacctttggcattaatatctttaatcgcctgtgcagcgccggtaaattccatatcaccatactgcgcgaccgggccagtagcggcacctacgatagctattttaatatctttcgccattgccgcatggctcatcgccaatgcaacgcatcctgccagtaacgcgcgacctgtcattttcatgcgaactaccccatcagttatgtcgtgtttgttgtgagtggtgttattttctgccagataaagtggaaaactgatttaacaataatgagttagcacgcttttctggcttttattagtaataaggctttatatttcagactattaaacaggaagtatattctgtaaagcaactgacatattcatgattcgcactgttaagcagcataatcatctggaggcaatgcacagcttttgcttaccaggccagcgcgttatgctgtctttaaaatcggaatacctgtttatcactattatcctggcactcggtcgcggttttgacctgttttattgcttaaaatgtgtcggggttccggttacgggaattgactacattatcggctttttacacatacaggtgtttgttatgaagctcaccattatgcgtctgacctcgctgacgcagcaggaccggacagacctggggaagatctggcctgaaagggatatcgcgcagttggaggcgtcgttaaatgaaagccatcgtctttacgccgcgcgcttcaacgatcgtttgctggcggcattgcagttagaaatttcagggattcatggcaaggtgcatcatctgacggtaagagaggccaccaaacggcgtggtgtcggtcagtatctcctggaagaaacgatgcagcagaatccatcgctgaacgactggtggattgccgatgacggcagtgacgatcaacgcatccgggcggcgtttatgcaggcgtgtggttttcgtgcgcaggttgacggctgggtgaaataacgcgcaggcagtaaaaagggcgacctgaggtcgccctgtctcgtcaggcttcgatcgccattcggagttttttcatcgcgttcttttcaagctgtcggacgcgctctgcggaaacgccgtaacgatcggccagttcctgcagggtcgttttgttgtcctcatccagccagcgggcacggataatatgctggctgcgctcgtccaggccttccattgcgtatgtcagcttatcggccgcatgggattcccagttatcctcttcaatgccgtcggcaaaatcagaggttttatcctggagatacagcaccggggccatggatttgccttcgccgctttcatcgtcagcggacatatcaaaggtcatatcctgagccgccatgcgcgattccatttctcgcacatctttgctgcttacgcccagctcacgcgcgaccatttccacttcatcctgattaaaccagcccagacgctgcttggttttacgcaggttaaagaacagcttacgctgtgccttggtggtcgccactttcacgatacgccagttacgcagcacgtattcgtgaatttccgctttgatccagtgaacggcaaaggacaccagacggacgccaacttcaggattaaagcgacgaacggctttcatcaagccgatgttaccttcctgaatcaggtcagcctgaggcaggccgtagcctgagtagttacgagcgatatgaacaacaaagcgtaggtgagacaggatcagcgtctttgccgcatccagatcgccctggtaatgcagccgttcagccaacgccttttcctcttctgccgacaacatcggccaggtattggcagcccgaacataagattccaggttgcccagaggagcaatagctaaagtttgcatttctttggtcattcaaaccctcacaaaatcagtggaattgccgcatctttccttaagcgcacgtcacattatgtcaacgtcgcaggaaaaccaaaagcaatctgtgctacttggaaaacaaagttatccacaagttcaattatagcagtgtatattttacacacagatgacagcggggcaacatcctctgcacccattgtcggcagcagaggatgattataacaaaaaaatgttgcagcagtttactggggcgtaaatcggcgtaaatgttgtaccgtcgccagccaggccgcaatccatccgatgatggccgcaatcagcagcagcagtagcgcctcatcccaggaaaacccttccagagagaatgtcgtgccaaacaccgacgcaacatgcgccacgacggactgcagacgcaggaccaacacttcagacagaatcagcgataataccgccccggtgaaacctaataacgccccgccatacaggaacggacgcaggataaacccatcggtggccccgatcagcttctgtacgttgatcgtatcgcgccgggcaaaaatgctcagcctgacgctgttgccaatcaccaggaacaccgccacgatcattaagataccgatcatggaggcaatttgtcccaccagcccggtcagggccgcaagacgggcgaaccaactgtcatccatgcgcacttcgtctacgccctgcacttttgccaccctgtcgcgcagggtttgcagggtgtcggaattctggaagttgagcttaggcgtaataatgacaacggccggcagaggattctgctccagcatatccatcgcgccaccaaagcctgaccagttacggaattcgttcagggcctcttcacgcgtcagatagttgacgtgctccacgccatcgacctgctttagctgggccgtcacattttccgccgcggtgtcgtccagggttttagagagataaaccgtaagctgcggagccggataccattgcgtggcggcctggctgacgtttttccacaccatataacacacgctgggcagcgtcagagaaatggcgataaccatcaccgtcagcaacgtcgccagtggctgacgccacatgtcagacaacgtaccgcgcagcgcatagcgccactgctcctgcatgccgccgcgtaacgctttgcttttcgacggttgcttcgccttcggcgctgtcgcgcgtttattgcgtttattgaccatcgtggcctccgtgcaggcgtcctttgttcagcgtcatcacccgataatttcggcggccgataagcgccacatcatgtgtcgccatcaagaccgtcaccccaacgcggttaaactcttcaaacagccgcagaatgtcttcagacagggcctcatcaaggttacccgtcggttcatccgccagcagtaccgcaggtttattcacgacggcacgcgcaatgccgacgcgctgctgttcaccaccagaaagttgaataggataacttttcgctttgtcgagcaggcccactttgtctaaggccgcagaaacacgacgccggatatcctcaccgctggccccggatatgatcaacggaatcgccacgttgtcgtacacggaacgatccatcagcaggtggtgatcctgaaagatcatcccaatctgacggcgcagaaacggcacctcgctgttacgcagacgtgaaatatcatgcccgctaaaccagatttgtccggcgctgggacgttcaatgccacaaatcagcttcagcaaggtacttttccctgcgccagaatggccggtcagaaacgccatttcaccaggacgcagatgaaaatctactccctgcagcgcctgacgtccgccgagatatgccttactgacctcttcaaagcgaatcatcctaattagtcctctcgggcaaacagtgcctcaataaaatcctcggccttgaagggccgtaaatcttcgatgccttctccaacaccgatataacggataggtatgccaaactgatccgccaccgagaaaatcacgccacctttggccgtgccatccagtttcgtcagggtaatgccggtcagaccgacggcttcattgaacagtttggcctggctgatggcattctgcccggtgctggcatcaattgtcagcatgacttcatgcggcgcctgctcatccagctttttcatcacgcgtgtgattttcttcagctcttccatcaggtgcgatttgttttgcaaacgccccgcggtgtcggcgattaagacgtcaacgccacgggatttggcagcctgaatggcgtcgaaaatcaccgaggcagaatccgcgccggtgtgctgcgccaccacaggaatgttgttgcgctggccccatacctgaagctgttcaacggctgccgcacggaaggtatcgcccgccgccagcatgaccgacttcccttcagcctgatactgacgagccagcttaccgatggtggtggttttacccacaccgtttacaccgaccatcaaaatgacgaacggagttttaccttcaaggttgagcggtgcttcgactttcgccagaatcccggccatctcgcttttcagcaggccataaagcgcctctgcatcgcgaagctgtttacgatcggcctgctgcgtcaggctggtaataatgcggcgcgtcgtttcaacccccacatccgcaatcagcagttgctcttccagctcttcgaaaagctcatcatcgatcttcttgccacgaaacaggccgataaaacccgagcccaggttctggcgggttttcaccaggctacgtttcaggcgggcaaagaagccttctttcgtcggacgatcctgctcctgcgtcactagcggcgcggcggcaaggggaagatcgctgacggtatcggtaggttctgcctgacccgcatggtgaggcgcttcctcaacggcatccgcgcccgctaaagccagcgcggtcagttcatcgtcgctcagcggtgcgtcgtctgccacaggggcaggttctgacgccacagtttcaggttcgtgaggcgcaacctccacgatatccgcatcggccagcgccagcgcggtcagttcgtcatcgctcagcggtgcgtcgtctgcaacaggggcaggttctgacgccacagtttcaggctcgtgaggcgtaacctccacgatatccgcatcggccagcgccagcgcggtcagttcgtcatcgctcagcggtgcgtcgtctgccacaggggcaggttctgacgccacagtttcaggctcgtgaggcgcgacctcaacgatatccgcatcggccagcgccagcgcggccagttcatcgtcgctcagcggtgcatcatcttctgcgggaacgggcgcaagctcagtggttttcgccggtgcaatcccgccctcctgctgagtcaacgcacgttcagcgtctgacgcagggggcgtgggctctactgtggcgccgggagcgagggggcgttgcggttcaacgacgtgttcaggggttgcaacggtctcttccgcatgggttttcgcctgacttattgccggggcttcctgttctggctgctggacttccgattgtgcagtctgtgatgtctgctcttccgttgagggttgtttctcttcttctttgccaaatcccagccaggaaaaaaagcctcgttttttctcttttgccattgtgtaaccacactcctcgatggcttcatcccggtagcacaatgtacccagggttaaaaacagtaatgggtgataaacgccagatgagcgtcaaaccgcagaattatgcataacagcagcaacgctgtagtctaacactttccagccagctcaccacagcacccttttttaacgtttcttctcatcgtttcgcccgttaaactacgcaacaaattatgaagatttgtgagcaaaatgataaaacctctccgtaagactggtggtgcaggccaaatccgcatcattggcggacagtggcgcggccgcaaattgccggtgccggacagcgccgggctccggccgactaccgacagagtgcgcgaaaccctgtttaactggctggcgccctctattcaacaggccgactgcctggactgctttgccggtagcggcgcgctggggctggaagccttgtcgcgttttgccgcatcggcaaccttactggagctggaacgcccggtggcgcagcagctgtcaaaaaatttacagacgctacaggctgctaacggcaaggttgtgcagacaaacaccctcacctggctggctcaggacggtaaaccctttcatatcgtgtttatcgatcccccctttcgccagggcctgctggaacaaacgctgcaactgctggagaataacggctggctgactgctgatgcactcatctacgttgaaagtgaagtcgagcgcggcgcaccgccggttccggcgcactggaatctttaccgcgaaaaaattgccggccaggtggcctatcgcttatatcagcgccaacaggagacacacgatgttacttaatttaggacgcctgctgatgctgtgcgtgtggggttttttactgtttaacctgattcatccttatccaaagccattgacctggtttatcaatgtggccctgatatttatgattctgatgcatggtttgcagttggttttgctgcgcaccacacaaggcaaagatgcaccgccgatcgatcgtgtcacccagataaaggtctttttgtttggcgttttcgaactggttgcgtggcagaaaaaaaatttcccacgcaagtaatatcagtaacatcgtcacggcgggcaccagacccgccgttaacgctgggtgggcgtaaaacgaataaaacgcgtgccctgcagggtaagctccccttccgtgcccttgtccatcaaatggtagtcgccctcgctcacccgcattttgatatcgctttcgccgttcagcggatgaaaccaggcttcatagcgcatttcgtctccggcgatgacttcacgctcacgcgaccggcggctggaaaccgaaaactcacgtttggttttcacttcgaccgccagcgtacgtaccggcgaagcatcgttaacggcggcctcacgccgctgcctgatgaactggcgggtcgctaaaaccgcaataacagccagtacaataataaaaaggagcggtggtttcatactatcccagctttatcaggttacagagggtgcaggtgacgtgctaaagcatacaaccagacttcaccgattgtcacatcgtgctggcgtaacctagactgataggagtttttcaggaactgtcaccatttttggtaaaaagggagaagcaatgctctggtcctttctcgctgtacttttctccggctggctgtatgtggatgcctcttaccgggggccgcaatggcaacgctggttattcaaaccggtcaccttactgctgttagtcgggctggcctggcaagcgccgacgcgtagcacctctgactatctgattgtggccggactggtcgccaccctgatcggcgacacgttgacgctgctgccacggcagcaaacgctctatgcgctgggggcgtttttcctgtcgcatctgctctatacgctgtgctttgccgccaacatgaccatgagtttctactggcctattccgctgacctttttgattatcggggttgccgtgattggtgtgctgtggagtaagctggaaacgctacgctggccggtctgtacgcttatcggtatgacgctggtcatgaactggatggcaacagagcagtattttttccgcccgagcgattacagcttctcgattcttgtcggttctgctctgcttctgctggccaatattgtgtggtttatcagccattaccgccgccgctttagcgcggacagcgccatcgtcgccgcctgctattttgccggtcactttatgattgtccgttccctgtggatcgcctaagaaaccgtcacaataaatctggagatggatgaaaccgtcgggtgtaagataagccgtgggcatgttgcccacgacttccggaggttatatgcatcaacatcatgcttgtggctgcggtaagccctgcggcacacaccgtgccgcgaaaccgctttgtgcgattcgccctgtccgttccggcactctctctattattgctgcgacgcccgaaaccgctgacggtaacggtggtggtagtgactgcccgtgtgctggctcatccggcagcgaagccgatgacgaaggtgaccgacgacgatcctctgatgcctttcagttcagttggctggtcagcggtatggactgccccagttgcgcccgctccatcgaaaccgccgttcgccaactgcctgacgttactcaggcccgcgtgctgttcaccagcgaaaaactggtcgttgacgcccgtgcgccggttcagtctgcaatagaagacgccgtcagaaaagccggcttccagctctcctcaacattggtttccgccccggtgccatccccatggcaaacctgtttccccctgatactgcttgccgggttgatgctagccagtacggcgctcagccaggtcagtgctgtgtggggcgatcgattatttattctgaccacgctggttggtctgattccggtagcgcgtaaggcatggcaacgcctgcgaacgggttccgcctttactattgaaaccctgatgaccctggcatcggcaggggcgctgttgattggcgctcatgcggaagcggccatggtcctgctgctgtttcaactgggtgaacgactggaagcctatgcggcaacccgcgcacgcagtggtgtgagccagctgatggcgctgcgccccgaatcagccgtgcgcctgcaaaatggcattcgcactgaggttccactggcggcgctgcagcccggcgaccggattgagattgccgccggtggtcgtctgccggtagatggatgtttagtcgctgaaagcgccagtttcgatgaaagcgccttaaccggggagtcgttgccggttctgcgctcgcggggcgaaaaggtgctggcaggcgccaccagcgtggatcgcctggtggaactggacgtggtgtcaaaacccggcgagagtgccattgaccgcatcttgcaactgattgaggaagcggaaacccatcgcgcgccggtggaacgttttattgaccatttcagtcgactttacacgccagcgattatgctgttggccctgctggtcatggtgttaccgcccctgttcggcgcgggcccctggctgccatggatctataaaggcctgacgttactcctgattggttgtccctgtgcgttggtgatctcaacgcccgccgctattacctccggcctggcggcggcggcacgtcgtggcgcactcatcaaaggtggcgcggcactggagcgcctgagtacggtgcagacgattgcgttcgacaaaaccggtacgctgacagaaggtaaaccgcagctaacccaaattttgccgttcggcgatctcactgaagaacaaatactgctgctgggcgcagccgtggagcagggttcaacgcatccgctggcgacggccatcgtggccgccgcacaggcccgaggcttgactatcccgtcagccactcaccaacaggcgatggccggaagcggtatcagggccgagattgaaggccagcgcgttgaactgctggcaccggcgcacgtcagccttctggacccgcagcaacaacgcctgattagtgagcaggaagcgcaaggcgacacgctcgttatcctgctgcgtgagggcaaagcgctgggtgcgctggcattgcgcgatcgcctgcgcagtgaaacccctgccgctttgcaggcgttaaaagcgcttggcatcaacagtattatgctgacaggggataacccacgcgcggcagccgtggtagcgcagcaactggatatcgcatggcacgcgggcttgttacctgccgacaaagttgagaaggttcgccagctcagtcagcagcaggtcgtcgcgatggtgggtgacggcatcaatgatgcgcccgccatgaaggcggcaacgctgggcattgcgatgggcaacggcaccgatgtcgcgctggaagcggccgatgcggctttaacgcgcaatcagcttagccacctggccccgatgatcaggctggcacgtcgtacccggggcattattcgccagaatattggtattgcactggggcttaaggcactgtttctggtcacgacgctgctcggtctgaccggattgtggctggcggtactggctgattcaggtgccaccgcgctggtcacggcgaacgcgttgcggctgttgcgctcgcgggattaacactctgacggcggcaaacgccgccgttattcacccatccctttcttgatcaaaaactgatagggcagcgtttccgtttgcgcggccagcaggcgatgttccataaaacggcaaaaaccgggaatatcccgcgtggttgccggatcgtcagcgacgatcagcagcgtttccccctcctgcatgccgcgtacggttttgcgcaccatcatgaccggttcgggacagcgcaggcctttggcatccagttgatggtcggcggaagaaaatacatcactcatgacgatctcaattcaggttggcgggcgcctattctagcgcgtcgaccctctgacgcaaggcggtaacgattgcgttaaaattagccattgcattaatagcacaacagggtaagatgcggccgttttttgttcatgaaaccgccgggcgctgaatcctctacgcacggcaatgggttccctcaccccaccattaaaaaggcttattatgctcgcatttacaccgcgtcagcgcacctacgcgcttctttggctgtccctgtttcacctgttggtgattacctccagtaattatctggtgcagttgcccgtttccctgttcggcttccataccacctggggcgcgtttagcttcccgtttattttcctggcaaccgatctgaccgttcgcatttttggtgcgccgcttgcacgacgaattattctggcggtgatggttcctgccctgtttatctcctataccatttccagcctgttttatcagggcgagtggcaaggctggcaggcactgcaacaggtgaatctgtttgtcgcccgtatcgcctgtgccagctttatggcttatgcgctgggccagattttggatgtgcacgtatttaatcgcctgcgccgtttgccgcagtggtgggtagcgccgggctgcgccatgtttttaggaaatatcagcgatacgctggcgttcttttttatcgccttttacaaaagctccgacccgtttatggcgcagcactgggtggaaatcgccctggtggattacagcttcaaggtgctgatctgcatggtgttcttcctgcccgcctacggcgtgttgctgaatgcggcgctgaaacgtctggccgaacgccaggctcagccacagatacatttcggctaaccggccattcagcctttcctgacaatccgctaaaatcttctgacaatactcaggttgcgtttgcaacctgattcctgttgtataaacgcctgagcggaaatttaaaaagggattctgatgcgtaatttagtgaaatatgcgggaattggtttgctggtcctcggcctcgcggcctgtgaccaaaagaaagatgaagcggcaaacgacaacggcgcatctgccagtcagtcggcacaaaccgtgacgctgatggatggcaagttaagcttctccttaccaccgggcatgtccgacaagagcggcaagctgggttcacaaagtaccaacatgcacgtttatgctgatgagagcggcgcgcgggcaattatcgtgattgcgggtgatcccaccaacgaaggtctggatgttttatctcaacgtatggaacagcagcagcgtaaccgcgatccgcagctacaggttgtctcgaacaaagcggtgacgctgggcggcgaacccgcacagcagctggatacggtgatttcagctaacaaccagacttcatggtcttcggtcgtactggccaaggtggacggtaagctgatgaccatgcagattacactgccgggccagaatcagcagcaggcacaaagtgatgctgaaacggtagtgaagagcattgcactgaaataatcgcggacgggcgcttgcccgccctgcgcgttattgcctgttcctgaacgctaagccacgcaccgtgcggaagatatcactccgcacggtgcgctcatcatcctgcctgctttggctatcgcacctgctcgcgtgccatgcgccagtattcaatcaaacgcagataattctcttttaccgccgtcaccagcgcgtcgtcaccgatctcatcctgcaaccactggcgtgaaggctgagcaaagatagtgcgtcccaccgcgaaaccttttacccatggcgcttgcgcagcctcggcaaaaccggctttcagcttctcttctggcgcatccagcccaagtaacaggatgccgcgacagtgagggtcctgctcctcaatcagggtgccaatggcctgccagcttgccgtcgacagagggggtaatttccaccagtccggcttaatccccaggccataaaagtggctcatcagcatcagataaaaggcttcattatgatccggctggctgtctggcagaatcacctcaagcagcagttcgtgcccgcttttgttgcagcttctccagacatccagtaacagggcatcctgctcttcccgcagttctgcactgtcgtgaggatgatagaacaccagacatttcaccacgtgctctaacggccagctaataagctgggtgccgatattgccgtgttcaagacgcagggggcgcgatcccggtaactctattggccgcccgatccatctgttcttgccggtaatggcgttaagcgccctttgaccaaaggttgtatcggccagaatcccgcttttcgtctctatgcccgcctgctttaccgcctgctctgcggcctgcaacagcagaagcttgagctgcgaaatgcggctaacgtcagcgcccgcggccagggccatatcgaccagttgcttgcgatggtcaaaggcgaaaatattgagctcaggccaggcttgctgccgggacgttacccggtgcaggtgggtcagttggctatccagatccgggcgttttactgccttttcacggctcaggaaatcgtccagttcctctcgggttggcatcgccggggcgcaaccgtggcgtgaaaccaccaacgcaccacaggcgttggcataacgacaggcctgctcccagccctcatcgtttagccagccacgcagcagacccgacataaacgcgtctccggcccccaacacatttaacacctcgacgcgtacgccgctgtgcagcttaacctgatcccagctttccggaatctcgttttcaaagacaacgcatcccattgcgccccgtttgcagaccagcgtggcacggctgacctcgcgcacctgtctgagtgccgtcagcgtgtcagtgctgccgcccgcaatatgaaactcttcttcggtgccgacgataagatcgaagtaatggacgacctcctgcagttgcgccgtcacctcggacgaggcaatgaaacgtgtttcaccatcacccagcgaggttaatccccacagcaccgggcgatagtcgatatccagcgccgtgcgcagaccgtttttgcgggcaaaatccaacgctttcagcacggcggcacgcgtttgaggatgcgataagtgagtgccggtgaccgccactgagcgtgaagaagcaataaaggcctcatcaatgtcctctggcaccagccccatatcggcgcagttatcgcgataaaagatcaggggaaaggtctcttcatctttaatgccgagaatgaccagtgcggtcaggcgctttttatcggttatcaacgcatccgtattgcagcccacacgttgcaggctctcacgtaaaaaccggccattatgctcatcgccaacgcgcgccagcatggccgatcgcaacccctgaatggccgtgccgtaagcgacattacccgacgaaccaccaagatatttggcgaaggacgtagtgtcctccagccgtgcgccaatttgctgaccatagaagtcgacggcgatgcgtccaatacaaatcacatcaagacgcttctgttgtgtactcatacttctggtttccttctgtgatgagcagacactgcggacaggttggggatcgaggtctgaaggtgtctggttaacgataaatgcagtatgaggaacaaatattccaaattcaattcaaaatgaaacttacaatgcgattatgtgaaccagttaaaaatctattattccctgacgaccgatcgtacagccaggcaacttatctcgcgatgcccgtgccacaaggcgagcggctttgcgctcgctttcgtgacgcgacagcggggatgaaatgaaacgccataaaaatatgtaactattactaaacattccagttacccctgttatctgattcgccacagatgattcaggaatgtaaatttgatcccactcgcaaaatgaaatatttcttctgtaatggtgttttatgaaaaatgcatttgtttataatccactgatatttcagttttccagatcgcgttctccgttccgcctcacccgttgcagcggatgggcataaaccgccgggcaagaacgagcacggcatgtggcatacgcatctggcgcaggccaaaaaagcgtgatttccgggccgtttaacggctcatgtgtcttatctccgatttaaccctacaggtgtaattatgacgttgaaacttggtgtgattggaacaggtgcgattggtcaggaacacattcgccgctgcaacaatgtcttacaaggggcaaaggtagtggcggtatccgatatcaacgttgaaggggctaaggctgcgctgcaacgactgaatattgatgcagaagtacaccaggatggctttgacgtgattcactcacccaatgtcgatgcggtgctggtgacctcatgggacccgacccatgaagaatttaccctggcggccattgcggccggtaagccggtgttttgtgagaagccgctggcgatgagcgcagaaggctgtcgtcgggtggtagacgcagaaatccaacacggcacgcggctggttcaggtcgggtttatgcgaccttacgatgccggttaccgtgcgctgaagaaagtgattactgacggtgaaatcggcgagccgctgatgctgcattgcgcgcaccgtaacccgacggtgccggaaaattacaataccgaaatggccatcaccaataccttaattcatgaactcgacgtcctgcgctggctgacaagtgacgattacaaaagcgtgcaggtggtttttccacgcgtcaccgccaaagcccattcgcatctgaaagatccacaaatcgtcctgtttgaaacgcagaaaggcgtgcgcattgacgtagaaatctttgtgaactgtgcctatggctacgatatccagtgtgaggttgtcggtgaggaaggtatcgccagactgccagagccttcatcggtgcagctgcgtaagcaggccaaactgtccaacacgattttagtcgactggaaagaccgctttattgaggcttacgacgtcgagctgcaggcgtttatcaatgacgtgaaagcgggccagttaaccggtccttctgcctgggatggctttgctgcctcggtggctgcggatgcctgtatcaaagcacaaaagagcggtgccattgaacctattgaaatgcccgcccgtccggcattttacaactaatccctatcgccataagcaggtaaccgatgaacaacgataacgttaagctggcgatagcgcccattggctggacaaatgacgatatgccggagctgggcagcgaaaacacctttcagcaaaccgtgagtgaaatggcgctggcaggctttaccggcagtgaagttggcagcaaatacccacgcgatcctgccattttgaaaccgatgctcgacattcgcggcattcagatctgcaacgcctggttcagcactttctttgctcagggtgataaagctgaaacccttgagggattcacggcccacatgaattttctctatgacatgggtgcccgcgtcatcggctgttccgaacagagtaaaagtattcagggcacaacgcttgcggtgctggaccataagcctgtctttaatgacgatgagtggcagcgcacggcggaaggttataacgagctggccgcgctcgcggccgccaaaggtatgcgtgtctgcctgcatcatcatatgggtacggccattcagacgcccgccgaaatcgatcgttttatggcgttaacccatgacgaggtgggcttgctctatgacaccggccacatctactactccgaaggttcacagtacgtcatgctgacggtgctgaaaacctacctgccgcgcatttttcacgttcatctgaaagatgtgcgggatgagattgttgctgaagtacgggacaagcatctgtcatttctggatggggtaaaaaagggcacgtttaccgtaccgggcgatggtgttattgatttcaaaccggttttcaaaattcttgatgactacggctataaaggctggatggtcgttgaggccgagcaggaccccgcgctggccaatccgtttgagtacgcggttaaagccagaaagtatattcgcgagaacaccgggctgtaagccggtatcggtgcctgagcaacgcgttatacggttatcaggctgcgcccaatgttgtctccgggcgcagccttttcacgtcggtagagctgaaaccgccgctttcgccagtgacgacgaatctgtgagtcatttcataaactaatgaaataaattccgcctataaaacaaacaaatgaaattttccaaccatctgatatcatatcgtccattatccagccacgcgttacacaaatgagcagacttcatgagcaataatccttcccaactttcacagctgcaggacgaaattcgccgccgttatgaaacgctgagcaaacggctgaagcaggtggctcgctatattcttgataacagtaacagtattgcttttgataccgtggcctccattgcacagcaggcggatgtaccgccctctactctgattcgctttgccaatgcgtttggctttagcgggttcaacgaaatgaaacaagtttttcgtcagcacctgatggaagaaaccgttaactatactgagcgtgcacggctattccgtcagacggcggccgatgatgccgccaactcacccgaaagcccagccgaaatcctgaatgtgttcaccatggttaacagtcaggcacttcagcagttggcgatgcaggtgagtcctgagcagttaaacaaaaccgtagaactcctgaatcaggccgagaacgtttacgttatcggcctgcgccgttcgtttagcgtcgcctcctatttggtttatgccctgcgccatctggaacgccgtgcttttctgattgacggactgggcggcatgtttactgaacagcttaatcttgtgaccccgaaagatgtggtgatagccatcagctgttcaccttatgccagggaagccgtagaagtggtggaactgggggcgaaacggggggccagcttaattgcgattaccgacagccaggttagcccgcttgcagcgtttagcgacgtctgctttgtggtacgcgaagcccaggtcgacggcttccgttctcaggttgcctcgctgtgcctggcgcagacgctggcagtgtccctggcattggctaacgcccagaccggtcaaatctcctgacaggccgccgtctgcgacggcgtggcttgcctgctatagctgtaccgactgaccccacctgaataaagccgggcgcatcctgccatcgcgcgtacagccttttgcgtcacaaaaaaggcagcccgcaggctgcccgttgctatccgcagtgattaacccgccggatagtgatcgctgttaatccaggcgtgatcgctttcccaactgaatttccacaagcgaaccggccctgccatcacattaagatagtagttgttgtaacccgctatcgtcgccacgggatggtaaccgcgcggcaccgtgaccacatcccggttgtaaacggccatgcacgcatccagcgaacgatcgtccgtgtaaacccgctgcatagcaaagccctgttcgggttcaaagcggtggtaataggtttcttcgagataggtttcgttctcgctgttttcctgatcgtgtttgtgactcggataggaactggtgttgccctcgtcggtaaacacctctaccaccagcaagctgtttgccggttcactgtccggcagaatgttatgcaccaggcgctggttgtgtcctttgccacgccgttcaacgccgacatcttctggcgcaatcaagcgggcgggcagtttgtcgccctggcccggagcctgacacacggccagttccagatcgctgtcagccgttaccgtcacggcatcatcatgcgggacgtacacggaataaggcggtatacgttcaaacggcgacatccgcttgccaagccccggaaaggtcgcatggcgcgtggtgacggaagccaggcctgcgaccagcaccagacaaagttcagtatcgccgctagtgaggttgagcgtttgcccttttttcaacaggtaagactcgaaacctacatagcgccagcccgcactttccggcgtcacctgctgtatgcgcccctggttatcaggctgttttaccttcgagagtaatgacatccgccgtctccttatccgccgtccttcagagtaaacatgctgttagccagcgcccacgatcaggctaactggcccatccacttaacctaacgttggcatactaaattcagaaaccgtttgctgaccgctcggccaacgtacggtagccgttttcatgcgcgtataaaaacgcacgccatctggcccgtggacgttaagcgccccgaataccgaccgcttccagccaccaaaactgtggaacgccatcggcaccggaaccggcacgttgacgccgaccatgccagcttcgacatcctgcacaaactcacgcgcagtgtggccattactggtaaaaatggcgctaccgttaccaaattcgtgactgttaaccagtttcagcgcactgtcgtaatccgccgcgcgcatgatgctcagcaccgggccaaaaatctcttcgcgccaaatcaccatctctggcgtgacattatcgaatagcgtgccgccgacgtagtaaccgtcctcaaaacccgcgactttttggttacgcccatcgacgaccaacgttgccccttcctgctcgccactatcgatatagcccagcacttttttctgatgggcggcagagacgacaggacccatttcattttcgtcgctgcccttgttgatgccgggaccgatgcgtaatgctttaatcagcggcgtcaggcgcgaaatcagtttatccgccgtgtcatcacctaccgccaccaccaccggcagggccatacagcgctcacccgcagagccaaatgcaccgcccatgatggcattcaccgtggcatccagatccgcatctggcatcacaatggcgtggttttttgccgcgccaaatgcctgtacgcgtttaccatgcgcactggccgttttataaatgtgctcagccacacccgacgagccgacaaagctgacggccgcgatacgggaatctttgtagagctgttctgcgttgtcattcgaactgtggacaacgttgaaaacgccgtccggcaagcccgcttccttcagcagctccgccatgcgtaccgcggctgacgggtccagtgccggtggcttaagaatgaacgtgttaccgcaggccagcgcaatagggaacatccacagcggcaccatggcagggaaattgaaaggtgtaattccggcgaccacacccacaggctgcatgagcgagtagctgtctaccccgcctcccacattgggtgagttctcacctttaagcaggtggggaatgccgcaggcgaactcaatcacctcgatgccgcgcgtcagttcgcctaacgcatcggaccagactttaccgtgctcagacacgatcaatgccgccagttcatcacgatgttgttccattaaggctttaaagttgaacatcacccgggcgcgacgcagcggtgaggtttttgaccaggcaggaaaggcagcatgtgccacgtcaatcgcctgggccacttcatctgcgctgctttgggtcagttcacggataaccttgccggtcgccggatcgaacacaggaatggtttcgttgctggcactgaacgtggttttaccgccaataaaatttcctacgatagtcatgatgttgcctctttggtgtgtacggttccagcaggcaaagcacaagaagtggcatgctggctgggcagatgaagccaaaagcatgctatgaagctattacaatgaaacaaatttttcaaataaatgtttttggaaaattactttttagtggagcagatcgcatttcttcattttatccccgatgagccgccagcaaaggctgttctttggctcgccgcagcgtcacctctgccgacgctgcagataacgaaacgcccacctgtcacgctttttatcgatctctcagcgaagatgccggttgcggtcagacagactgaagcgaaaaaacactcttttaaaatttcaaatctaaccaattcgaaataaaagtttcttttagcgccgtatttcttccttatcggtgtgaggagataagcgtgcagcatgccatcgcgctccttatggatcgcctcgtgacgcacttccatggtgcaaaaaaacgtcttaatggcgatttcatgaacccataatttcttacatgcccagtcaggaatcatctgtttcatgtgcatccgggcgtaatgcaccagacagaaccaccctatcctgttgatttactaacgttaaaagcattcagacatgataagtcaaaaagctggcctgctttatgcaacatcgaacaacttccccgcactgagatgagataaccgtgtctgacgaaaaaaacagcggcctgctttacggtctggaccaacgtattccgccacttcaggctttttttagcgcatcacagcatgtgctggccggcctggtcggcatcattacgcccccgttgctgatcggcacggcgctgggtctggacgcgtggctgccgtatttgatcagcatgtcgttgcttgcctccggcatcggcaccttcctgcagtcaaaccgcgtttggggcgtgggtgcgggcatgatatgcatgcagggcaccagcttcgcctttctcggtgtggccatctccggtggcctgtgggtcaaagcgcaaggcggcaagccagaggacattatggcgatgctgtttggcgtcaactttgtggcggcgctggttccggttatcgtcagccgctttatcgacaccttaaagcgggtctttactccggtggtgacgggcagcgttattgcgctcattggtatcagcctgattaaggtcagcgtcataaactggtgcggcggtgaaaaggcaccggatttcgccagcctcagcaaccttgcactcggtgcgttaaccctgggggtgatagtgctgctaagttgcgccagcaaccgttggctgcgactgtcctccatcgtagtgggcatcgtcacgggctgtatcgccgccgcgctgagtggcaaatttcatattcagggtctgggtgacagcaccttccgtttaccgtccctgtttccgtttggcttccacttcagtagcaccattttcatccccgtggtgctggtctcgctggtctgtattattgaggcagtgggcgaccttaccgcgaatagcctgatctccggcaagtcgattaccgatcggaccttcagcgcccgtctcaaagggggcattctggctgacgggctgagctgtatgattgcagcgatgctcagtgcctttcccaataccacatttgcgcaaaataacggcgtgatccagatgaccggcgtagcaagtcgttttgtcggtcgctatgtcggtgtgatgcttatcctgctggggctgtttcccccctttagcgaggcgctgcgacagatccccacgccggtgctgggtggcgcaacgatggtgatgttcggctgtgtggtcacggcaggcatccgcatcctcagccagaccgcgctgacgcgcagggagatgcttattgtcgggctggcttttagtttcggcctggggattgaatccgttcctgcatcgctttcccatctgccgcccatgattgagaacctgtttggttcagcagccaccagcggcggccttgtggccattgtcctgaaccttcttattccgggtggcgaaaccgctgtgcgtgaagaggtaaaacagggtgaatccgcgcagtcgctttaacgccgcatcgcgcacccacggcagcgttgtcgtgggtgcgtcgctgtgcgcgcagaggtcagtgtcataacgcggtgtgcctcactcagcgccgatagcgcgcttttatgcgcaagcgtgaagccaggttagcgtgcccgtagccagccagccgcagcgcctgatctaccgtttccctcaatgaatcagacggttacttttccttcagctacactttcatcagttatttatgcgtagagataaagaatgaacgcgttgcagcaggaaaaaattggacaaaacatcttaattaaactggcgatgctggtgattattcttgcggggatacgagccgcctcagacattctggtgccgctacttctggcggccttttttgccatcgtactgaatccgctcgtgacgatactgatgcggcgcgggctgcgacgcgggatggcgatcgggttggtgattacggtgatttttatcatcattctgctgctgggagccgtgctggccagctccatgagtgagttttccgatctttatcctcaactgcgcaccatcctggaaaagaaaatggtggtggttcagcatctggcggccagcatccatcttaatatctcgactaactccctggttcaacgctttgaccctaacaccgtcatgaacctggccagcgtggcgctgagtgggttttccggtgccatgaccaataccgttttactggtcctcaccgtggtcttcatgctgtttgaggtgcaccatttgccttataaaatgcgtaactcctttgtgaaccccaaaattcgcattgccggattacacaaggcactcaaaggtgtgacgcactacctggcactgaagacgttgatcagcctgatcaccgggatagcggtgtggctgacgctctacctgctggacgtgaagtttgcgttactgtggggcgttgtggcctttattcttaactttattcccaatatcgggccgattatcgccggtattccgcctttcctgcaggcgctgctgctcaacagcgtctttgacgcggcgatggtggcggcgctgttcactgccattcatatggtatttggcaatatgctggagccgcgcattatggggcgcggcctgggtttatcaacgctggtggtgtttttgtcgttgatattctggggctggctgctgggcccggtagggatgttgctatcggttcccctgaccagcatcaccaagattctgatggaaaccacgccgggcggcagccgtctggctatcatgttgggcaccggccggcccaaaccttcgcgactgttaaccaagtaaacgctgctgcacatgttgcagatgatgcctcatcgccgcctgtgcagcctgctcatccccggcaacaatcgcctcagcgatacgctgatggtcggcattcatttcctccgcaaaggtattgtctgcatagtgactttccagtcggcggacatgcgcgctgtcgcgtttgttccacaaattttccatcatctcccgcagcagatcgttgccgctcatctcgctaatcagcagatgaaaccccttgtcctgctcaataaaagccgcgtcgttttcattaaatgcctgcagcgctgcgctgagggacagcagttgctgacgctgggcttcactgccgtttcgcgccgccagcccggccagcatactttcataggcttcgcgcgcctgtagcaggtcctgcaggctgaaactctctgtttctttgccgggtgagggctggggtaaggtctgagcgacaaaaaccccggtgccggtgtaaatgttgacgtagcccgtcatctcaagcgcaatcagcgcttcgcgcaccgacgaccggctgacgccaagctgtttagccagttcccgctccggcggcagcgccccgcccggcacgaaatcgccacgattaatgccgtcaataatggcattggcaatctgccgataaagccgctcagtttttaagaccggtagcgccataaccctctcctgttgtcgacacgcttttaggctttggatgatacgtatttactatgctgcgatccggatcacggccttaatttacgcgctatcttactcttggtccagcggcctgaccactgggccacacgttcaccaaggagtaataatggaacatacatggcgctggtacggcccaaacgaccctgtgtcactcgacgatgctcgccaggcaggtgcaaccgggattgtcacagcacttcaccacatcccgaacggcgaagtatggcctgtcgccgaaatcaaagcacgtcaggcgctgctggcagaaaaaggtctcacctggtctgtcgttgaaagcattcccgttcatgaaaccattaagacgcaacgcggcgattatcagcactatatcgccaactatcagcagtcgattcgcaatctggccgcgtgcgggattgataccgtctgctacaactttatgccggtgctggactggacgcgtaccgatctggcctggtcactgccggacggtgcgaaagcgttacgctttgatgccgatgcgtttgccgcctttgaactgcacttgctacaacgccccggtgcagaaaaagattacagccccgccgagcaaaaagttgccgcagaacggtttgctgcgatgagcgaagaagaaaaagccacgctggtgcgcaatatcatcgctggcttacccggcgcggaagagggttacacgcttgagcagtttcaggctcagttggcccagtatgacggtatcgacaaagccaaactgcgcgaacacatggccacctttttgcgggccatcgtccccgtagcggaagaggtcggcattaagctggccgtccatcctgacgatccaccgcgtccaatccttggcctgccgcgcatcgtctctacccaagaagatatgcagtggctgaaagaaacggtagacagtctgcacaacggattctgtttctgtaccggttcctacggcgtccgtgaagataatgcccttgtcgcaatggcagaagcctgtgccgatcgcattaacttcgtgcacctgcgggcgacaaagcgagaagcgaaccccaacagctttcacgaggcgggccatctgaccggtgatgtggatatggttggcgtcatcaaggtgatccttgccgaggagcagcgtcgtcgccggtcgggcgagcaacgtgccattccgatgcgtcccgatcacggtcatcagatgctggacgatctgcacaagcgcaccaacccgggctactccgcgattgggcggcttaaagggctggcagagctgcgcggcgtggaagtggcactgaagcagatttattttcaggattaacaggtcgttgccccgcgctgttcaggctgtcggggcacacatccgtctgacctcgtttttatttcacggttatcgccttatccgcgcccgttatttacccgattatccgacagcaaccgccctcccgccgtaaaaagacagtgcgcattttaccccgccgggtttgggtttcgctctgtgttgccgccccacagcgaccgtttacaggtcagtcgccgtccgttcttccgccttacgtgatcaccgttttgctgcagccatcaaactaatcgctgaactttcaccaatagtatgaattttgtgtcaattaaatgcccacaaggtcgataattgaccttatcggatgataagggatttccgaccgttcaccagcggcgtgaactggcgtgctatgttgcagtgacccttagcacctcgcaaaacatcataacgattcagaggtttttacggtgccgctaataaaaagaaagcgcgatcacgccagatcgctcatcgtccttgcagggcttctgcccctgcttttgggtttgctatttactgctatcgatgccagaaagaccgttaaagaacaacaagtgaatacggcagcgaccttgctgtctcaggctgaaaaaatcagcgataacgcctggagtatgatcgcttcgcttcgtcaatatgacgatcaatcatgcgatcaggtcgagaatacgctgcgcatcaatggcacccttcatccctattttcgcggtatcggcaggctggaaagcgatatggtcagctgctcttccgcctatggcaacaaacccgcgacccttgaagccatgattggtactacgccgccggtgacgggcaaagaccggtggagtttatccctcaccggttcttacagcgtgccggatcggcctgcggtgatattcgtgcgccagatttctgcggacaaagcactttgggtgatggtggaaggacagtacctgattgattttatgagtgccctgggcagcacccatgagtacagaatcaccatgcgttttaataacggcacgccaatagtgtcaggcaatagcgaaatgccaggcaaccactggcttttaccacagatatacaaggcggcttcctctcgttatcccattagtgtcaccctgattgcgccaagcgccgagcgggtcaagacgtgggcacagttgcttttcgtgtttatgccaatggcggcgattttttccgttctgtttatgattctgacgacatcctggttacgcaggcgcttttcatggggagatgaaatgcgtcgcgctatccgctcccggcaattcagcgtgcattaccaaccaacctacagctgcacactgcaacgctgctccggtgcagaggcactgctgcgctggacgctgcccaatggtgacagcgtgcgccctgacacatttattaccgccgccgaagcggaagggatgattatcccggtgacgcaccatctgatggatctgattgttgaggacacgcaacactggaagcccaatccaggctttcatctggcgattaatgtggcagccgaacatctgcagcacccagacttcgtcaatgacatgctgaactttgctaaaaggatggcgaaaacggagtttaacattactctggaactgacggagcgcagcctgattaaagaagggaacgtggtcgccactaagctggctcagttgcgccaggccgggatgaaagtggcgattgatgactttggcacaggtcattgctcacttagctacctgcaaacctttgcactggactatcttaaaatcgaccagggttttattaacgcaatcgagtcgctggaggaggaaacgccggtgctggatgccattatcagcctgagtcataaactgaagctgcaggtcctgggagaaggcgtggaaacggcattgcagttccgctatttgcagcagcatggcgtcaacttcgtccagggctatttttatgcccgacccatggataatacggcgacgattgcgtggatggcgcagtatggtcatctgcctgttgaggtggataacccctgagccgcaggcgctacacgcagaatcagactgatggcgacggcgttgactggcttattttcgctgcgacgcccgttgtttactcgccgcccgcaatgccaccgccaccgcgtcttcctgttggtcgcaagaggcagcatcagacgcacgcccggcacgctgattcaggcgttgcagcgttggcatcgactgctgtaacagctgctggcacacctcatagtccgagcactgcttgcccgtgaccgtcgacgtttgcagcgtctcgctcaactgcgacagtcgatcaaaccagtatttagcccggcagcttagccatcctgaatggagcggcacgtgagtggcagagtcagtctgccggggagcgcgacccacctcagaagaatccattaattttctttctacactatcgatctgcgccacccaggggctttggcaagtgatggatgctttccttgacattcttcctccaaatcaaggtgaaagagtattgccgaaggcgctccattaggcaagtttcaaaccccaccccgacaaatgcttaaaatttattgataacttaagccaggcggtgactgtcgttcaacatcgaagcgcttatttaccaggcaaacgcgcgggaagcctgactttttttcgcgtcgtttcctgctacaaaccgcaggtgaaactgctcgttttcagttcaaacatgacaaatatcacacaaaaacgttatactcttccgccgataaaccagatgacggcagtattggttgtattggtgagtcgacagagaatgctgttttacggctatgcttaaatttcctcaacgaagcggtctgaacgctattttcggttcgcgccgttgaggactttcatgttccattacagggtaattctatgaaattgcgtaggaagcgtgtaaaaccaattgggatagatgatgtcaccatcattgatgattcccgtttacgtaaagccattaccgccgcctctttgggtaacgccatggagtggttcgattttggtgtttatggctttgtggcttatgccttgggtaaagtgtttttcccggatgtctcgccagggattcaaatgattgccgccctggcaaccttctccgttccattcctgattcgtcctttaggcggcctgttcttcggcatgctgggtgacaagtacggtcgtcagaaaatactgtcgattaccatcgtcattatgtcgatcagtaccttctgtatcggcctgattccctcctatgcctccattggcatctgggcaccgattctgctgctgctggctaaaatggcccagggcttctcggtcggcggggaatacaccggcgcgtctatcttcgtcgccgagtattcgcctgaccgcaagcgcggctttatgggaagctggctggacttcggttcgatcgccggcttcgtgctgggtgccggcgttgtcgtgttgatctcgaccattatcggtgaacaaaacttccttgaatggggatggcgtcttccgttcttcctggcgctgccgctagggattattggcctgtatttgcgccatgccctggaagaaacccccacgttccagcagcacgtggataagctggagcaaggcgaccgcgaaggtctgcgtgacggcccgaaagtctctttcaaagagatcgccaccaaacactggcgtagcctgttagcctgtatcggtctggttattgcaaccaacgtgacctattacatgctgctgacctacatgccaagctacctgtcgcacaacctgcattactccgaagatcacggcgttctgattatcatcgccatcatgataggaatgctgtttgtccagccggtcatggggctgctgagtgaccgctttggccgccgtccgtttgtgattatcggcagcatcgccctgatgatcttcgctattcccgcgttcatgatgatcaacagtggcgtgctgggattgattttcgccggactgctgctgctggccgttatccttaacgcctttaccggcgtgatggcctcatcactgcctgccatgttccccacccatatccgctacagtgcactggccagcgcctttaacatttcggtactggttgccggtctgacaccaaccgcggtagcctggctggttgagaccaccaataacctctacatgccggcctactatctgatggtggtcgcggtgattggcctgattaccggtctttatatgaaagaaacggcgaacaagcccctgaaaggtgccacacctgccgcctctgacatggaagaagcgcgcgaaattcttcaggagcatcacgataacatcgagcagaaaatcgaagatatcgacgaagaaatcgcccgactggaagcgaagcgtaaaaacctggtgcagcagcacccggatatcaacgagtaacctcctcgtctcccgcccctgtggcgggagacacattcactgtctcggcacaccgcacacaaaccttcatcgcctgcccctaatcggagtagactagccgtcttatttaatttggccaggtgagtaacaatgtctgatttttcccttacccaacgtcccagaagattgcgcgccagcgcgtcactgcgagcaatgttccaggagtccagccttaacctgaacgatttggcgctgcccatttttgttgaggaaggtattgatgactataaagacattcaggcgatgcctggcgtaagacgtattccggaaaaacgtctggcctatgaaattgaacgtattgctaaggcgggtatccgctcggtgatgaccttcgggatttcccatcataccgatgcgaccggcagcgatgcgtggaacgaaaacggcctggtggcgcgcatgtcgaaaatttgcaaagacaccgtgcctgaaatgatcgtgatgtcggatacctgcttttgtgagtacaccagccatggtcactgtggcgtgctctgtgatcacggcgtcgataacgatgccactctgatcaacctgggcaaacaggccgttgtcgcggccgcagcgggggcagattttatcgcgccctctgccgcaatggatggtcaggtaaaagcgattcgtcaggcgctggatgccgcaggctttacccaaacggcaatcatgtcctattccaccaagtttgcgtcatctttctatggccctttccgtgaagcagccggcacggcgctgaaaggcgatcgtaaaacctatcagatgaacccgatgaaccgtcgtgaggctattcgcgagtcactgattgacgccgcggaaggtgccgattcgctgatggttaaaccggcgggtgcctatctggatattctgcgcgatattcgtgatcgcactgaactgccgctggcggcctatcaggtcagcggtgagtacgcgatgatcaaattcgccgctcaggcgggtgccattgatgaacgcaacgtcgtgctggaaagtctgggggcgattaagcgtgctggcgcagatctgattttcagctattttgcgcttgagctggctgaaaacaagctgctctagaggctaaatgacgggccttctgcggcggtgcttgcgccagcgcagaaggggttcttcccgtcctgcaaggcaataaattaaccaccctcacaacgctcataatacaataacattacgcctcgcccttcctcatctcagaaacaaaaagcacacatgcggctacctaatataattattctacctatagctccacatggcaggaaataaccattcacttccttaagaatctttacgttcgtaatgttttgagaaacataggataatttacaatcaccttcaaaatttaagggggtgttatgaatgagaataaatacaatgagagcgtgattatttctgttaccgaatggattaataaaaacttggatcagcgtttaagcatcgatgatattgccgaaaaagccggttattcaaaatggtatctgcaaaaattattttcccgttacaacaatgaaactctggcgcgttatattcgcagaaagaaattaattgcctgtattaatgatttaaaatacagccgcgcgcccatcatcagtctggcggtgaaataccatttcgaaagccagcagtcatttacacgttcatttaagcagatgatgggctgtacgccgagcgtatgtcgtaaaagacagctattggacgacagcaatcaggatgcgaatacgcatccttgcagcttatgtagtcgggcggaaaacagcgcaaaaaagaaaggatctggcggaataaaggaaacccgcggtttcgacaatatagcccgcctgctttaacaaaaaccgtcaacgcgcgttgtcgtcaggttgatagtactgtacgccaatctgaatccgctcgcggccactggcgacacgatgacgatttgtatcacgcaaggagtaaacacatccgcaatattcttgctgataaaaactctcacgtttactgatttcaatcatgcgcgccgatcccccgcctttacgccagttaaattcccagtaggtcagatcgggatagtgggcggcagcgcgtacgccacagtcattaatttgctgcatgttcttccagcgggaaatccccagggaactggttatcaccgggaagccattttcgtgggcgtacagcgccgtgcgctcaaaacgcatatcgaagcacatggtacagcgctcacctcgctcgggttcccactccatgcctttggcgcgtttaaaccagtcgtcacgatcgtagtccgcatccacaaagggcacaccaaacttttcggcaaagcgaatgttttcttctttgcgcagctcgtactctttaagcggatgaatattcggattgtaaaagtaaatggtgtactcgatgccggatgccagcatggcctccataacttctcccgaacagggcgcgcagcaggagtgcaacagaactttcttgtgaccgccgggcagcggtagcggttcacgctggtagggctgagacataagcaccttcaatcaatggaatcaaagaggcagtgtaatgccgggacgtaaatgttgcaaaatttcgcataacaacgggctgacatgcgccagcccgccggtcacgcctgagcgatgtgctatcaccactgcagcgttttacctgcatagtcaagatagtgatggccgccatgtccacggtgggtggtcaactgggtaaagatgccgttggcactctcttcaggcgtcagtggtgctgcatcgccgcccatatctgttttgacccagccgggatgcaaggtgattaacgtcccgttctgggcatccaccgttctgaccagcgagcgagtgagcatattcagggccgctttactggcagaataaagcggcgcgtctgcgctgcgattctcattcaggctggcaagttgagaggaggtgagtgcgagtacgccgttttgttggttcagtaacggcagcagaatttccgcactccgaatcggtgccacggcattggtcataaacagctgggccagttcagcgtcgtcgctttccgacagcttttgatgggccgggccataaataccggcattaatcagaatggcgtcaaaaggcggtccgctcagtccaacagcaaaatgcttaaccgcctcggtttgcgtcatatcaagccggtgccagtcaacctgagggatatcaccttgcggtggatgatccccgcgatgggtcgccgtcacctgccagtcatgggcggcaaacgcctttacgacggccagtcctatgccacgtgatgcgccaatcactaagattttcccttgataagccatacggtttcctcgttgatgaagtcagtaatcagagtagatgttgatcgactaacacactgcatcctgaatgcttttttggattaacacagcaatactgacgccgagcattctccctgtgttattcgatttgctgatctggcggtgatgacttgtcaccttcacgactcttctcgacgctctgcggatggtcttcccctattgagagggcggtagcgctggcgggatcgaatagcgagaagctttcaatctggtccaccataatgactttgcggaatgccatcgcattcttcggctcagaatccagcgtaatgccatgctcggcataccagctgctgtaattgtgttccaccgacagcttcagcgtatggctgtcgcggtagccgctcagcatcggaataagcacgatattggctgtgctttcgtattcaaaggtggcggcatgcaccataccgatataaatccgtcgggattttaaggtgatccacgctagctccccctcttccatacactgaaacagcatctgttcgacaccattagatcgagagagtttttgatagagatcttttcggcctgaaacgttcagttgcgcactgcccgcccagtttgatcgataaaggcaaaacaggatggcaaaggccagcataatcaccacaggtgcctggatacccagaaaactccagttcataaacttcatttgcagctgcagatgatcgccgggaaacacatacaggaaattagaaacggttgaaataataaacaagataaaccagataaaggcggtgacgaaaacgccctgaagcacaaaaatacaaccgtaaagtgcgaccagaaaatagacatcccagcctgaagaacggcgcattttaaaacggctggacagatcccggctggtataccagtaaccactcaccatcaataccataaaaattgcggttcccacctcagactccttttaaggtattgacgtgtcgattgaaatcgtctttcacttcatcactgagaatattgacggcagcattgccgttttcatcgataattatgcgttcaccatccgcaatggagtcgtttatgtcctggcggctcattatctggaggaatttatccgggctggcgaacaaagaacgaacaaagctaatcatggtgtgtcacttaacgagttaaaagaacaagtatgtgaccgaatcgtgtttactgccattttatagtcggtaaacattcctaaaagatgattaacgaagcggtaaaaaagcataattattgcggccagtcatttgtgccacattgataaaatcctgctgagaaactccatatttcacccttatttcgatgattgtggcaggcccgtttctgataatcctgaggcgtgcttatctcaacatattcatgagaatcctggcggtttcagcgtagtgccctgccgatttgccttctctacggtcagtcagcggtcaccgtcccgtgcggcctcaacctcaccggctctgcgttacggtgaaaagggccgcgtcggtttatccacctgcatcacatatcctggcgatattgttgcactagtgtgatgcaggttttaaatatgttgcaccccaattgcgcttacctgatgaacgggatatcaacttctcgcaaaccccttcactgaatcatctgacgtgcggcctgtttttatgcacctcagaaagatggcatgcattgtgcttgttacttaactaacaacatggcgatcaatgacagccaggtaacattgaggacgagatgagcgctaacgcagacctgttcaaaaagattgaggccgcttttagcctgcaaacgccaagcgaaaagcggattagttcgtggctgttaagtcatcccgagcaaataccgtttgaaacggccgacagcattgcccagtcaaccgggaccagcggtattaccgtagggcgttacctgcgcaagctgggttttaaaaatcttgatgatgtgaaaaacctgctgcgcgatgtgcctaacacaccctacaagcaatggggcgttattgatcgtcttgactcatgggaacagcaacgcacgctgcccgatccctccagtcagtcgctacaaatggagttagatgctatccgctatgtctatcaactggctcagacagatacgtttcgccatatcagccagcaaatcgcggatgccgaaacggtcatcgtgctgggtattcagtctacccgcggtatcgctaacacctttttcagtcatctggaatatttacgcccgcgcgtgacctacgccgatggcagctcaggcagttggctggagtcgctgaattctgagtctgccaaaccttatgtgattctgacggatacgcgcgcctattccaccgtggcaagacagttttgccgggttgccaccgagcgcaaggttgcaacggcactcgtcaccgatatctggtgtccctgggcacgtgattacccggtggatttgcttcaggtcaaaacggacaccgccaatttttgggactcactcgcgcccctgagttgcctgtttaacctgctgctttccgccgttgttgaacgccttggccccgcgctttctcagcgactggcacaaaaccgactgttacagcaggaatttggtcaatttgaacattaataaaacagggatcaccgcatgatgcaggaaacagagttggtcgatattgcagcagcctttcctgagctcagtatcgacctcaaatatgccaccgccgacaacatcacgggccagcctatctacagcgtcgcccgctgcctgctgcaccctgatgccgtgaaagcgctggagaaaagcatggcgattgcaaaagtggccggattcaccctgctggtgctggatgcctatcgcccgcaaaaagcgcaggagctgctgtggcacgcctgccctgaccagaattatgtcgtgccgttatcgcaaggctccaaccacagccgtggcaccgccattgacgtcacgctggtcgatgcgacaggacagacgctggatatgggcaccgggttcgatgacatgcaggcgctatcccatccttatcatcccgacgtaccgcttgctgcccaacgcaacagactgctgcttaatgccgtgatgtttggcggcggctttactggcattgccacggaatggtggcatttcgaattaccggaagcggcccgttacccgcttctcaacgatgttttcacctgcatatccccagcccagactgacggagtattaccatgaaaatgacgcacacagcccccggctattttcgccctttgttactcgccatcaccctggccgccacaacgacgtccgttttggcggcggtacccaaagatatgttagtgattggtaaagctgccgatcctcagacgcttgatcctgccgtcaccatcgataataacgactggaccattacctaccctgcctatcagcgattgatcaaatacaaaaccgaaggcggtaagggttctacagacgttgaaggcgatctggcggaaagctggcagagcagcgaggagggtaaggtatggacgtttaaattacgcccaggcgctgcgtttgcggacggttcagccgtgaatgctgaggccgttaagctgtcgtttgagcgcctgctgcgtatcaaacagggcccttccgaagccttcccggccgatcttaaagtcgaagtggtagatccgctaaccgtgcgcttcaccctgagtacgccttttgcgcctttcctgtacaccctcgctaacgacggtgcctccatcattaacccggccgtgctcaaggctaacgcgactgacgacgcgcgcagttacctggcggaacatactgcaggctcgggcgcttatatgttgcagcgctggcagaaaggtcagcaacttgtgctggtgcctaacccacactttgccgggccaaaaccggcgtttaaacgggtgtcggtgaagatcatcagtgaaagctcagcccgacgcctgcagttggccaaaggggatgtggatattgctgatgccttgccggtggaccagtttgccgcgctgaaaaagcaaaatgatgtggccgtgatggattatcccgccctgcgggtcacctatctctacctgaacaacagcaaagcgccgctcaatcagccagatttgcgccgggcgatatcctgggccaccgattatcaggggatggtgcaaggcattctgggtggcaacggaaaacagatgcgtggaccgatcccggaaggcatgtggggttacgacgcgaaggccatgcagtacagcttcaatatcgcaaaagccaaagctgaactggacaaggttgccagtaagccacagtcgctgtcgtttctctattctgacagcgacccaaactgggagccgattgccctgtcaatgcaggccaacctgcaggctattgggatcaaggtaaagctggaaaaactggctaacgccaccatgcgcgagcgcatcggcaaggcggactatgacattgcaattggtaactggagcccagacttcgccgacccctatatgtttatgaattactggtttgaatctgacaaaaaagggctgccaggtaaccgctcgttttattccaacccggacgtggatgcgctgctgaaaaaagcggtatcgaccccgaatcaggctgaacggacgaccgactaccagcaagcgcaaaatatcgtgattaaggatgcggcttacgtttatttattccagaagaattatcaggtggcgatgaataaatcggttaaaggctacgtgtttaacccgatgctggagcaaatctttaatatcgccaccatgcacaaagaataacacccctcacgcccgttcatgcagggcctgcccggccctgctgaggaagacatgatgagttactggagtttagtaagacagcgtagctggggactgctgttggtggtcgccggcgtctgcgtcattacgtttattatttcgcatcttattcccggggaccccgccaggcttctggcaggtgaccgcgccagtgatgaaatcgtccagcatatccgtcagcagttgggtctgaatttaccgttatggcaacaatttattcgttatgtggaacagctcttacatggcgatctgggaacctctatccggacaggccgccctgtgttagaggatttacgggcgttttttcccgcaacactggagctggccagttgcgccctgttgatcgccctgctcgttggcgtgccgttgggcgtgctctctgcggtgtatcgtaaccgctggctcgatcatctggtgcgcctgctggcgctgaccgggatttcaaccccggcgttctggctgggcctgggggcgattgtgctgttttatggcaagttaaacctgctgcccggtggcggacggctggatgactggctcgatccccccacgcgcatcaccggtttctatttggttgatgccctgctggaaggcaacatcgaggtcttttttaatgcgcttcagcatctgattctgcctgccaccaccctggcctttgttcatctgggaatcgtggcgcgccagattcgctcggccatgctggaacaactgagcgaagactatattcgcaccgcgctggccagcggcctgccgaaatggacgatcgtcgtgcgttatgccctgcccaatgccctgattccctccgtgacggtcctggggctggcattaggcgacctgctgtatggcgcggtattaaccgaaaccgtgtttgcctggcccggcatgggcgcttatgtggtgtcctctattcaggcgctcgatttcccggcggtgatgggctttgccatcgtggtttcctttgcgtacgtattggtaaacctgttcgtggatcttctttatctgtggattgacccgcgcatgggtcggggagcgtagaacatgatgataacgcaagaacagcctgccgtgcgtcaggtcaaacccggcctgttcgcctggaaacgccgcctgtggatgctgagcaaaagcccactgacgctgctgggtgccgccatcatcattctgatgctggggttaatggtgttttcaccctggattgtcccccacgatcccaatgccatcagtttgaccgatcgcctccaggcacccagtgccgcgcactggttcggtactgatgaagtgggcagggacttgttcagccgggtactggtcggcagccaacagtcggtggcggcaggcctggctgtcgtgctgctggcaggcataagcggttcgttactgggctgcctgtccggtgtgttaggcggtcgcagcgatgcgatgattatgcgcctgatggacatcatgctgtcgattccttcgctggtactgaccatggcgctggctgcggcgttggggccgagcctgtttaacgccatgctggctatcgccattgtgcgcatccccttttatgtccggctggcgcggggtcaaacgttaatcgtcaggcagcataccttcgtggaagcggcaaaaacctttggtgcctcgcgctggcacctgattagctggcatatcctgcgcaatgccctgccgccgctggtggtgcaggcctcgctggatattggcagcgcgattttgatggcggctacgttgggttttattggcctgggcgctcagcaacccacagcggaatggggcgcgatggtggctaacggccgcaactacgttctggatcagtggtggtactgcacctttcccggggccgccattttaatcacggcggtgggattcaatctgtttggcgatggcatccaggacctgctggatccgaaagcgggaggacgtaactgatgcaagagagaatcctgacgattgaggatctacggctgagtttcccggtttttcagggagaggtgaacgtgctgaacagcgtatcgatgcacatcaatcgtggcgaaattgtcggcgtggttggcgaatcgggttcggggaaatccgtcaccgccatgctggcgatgcggctgattccagaacacagctatcacatcaagagcggcaagctggagctggctgggcaggatgtgcttgccgccagtgaagtcgacatgcgcaagctgcgcggcaatcgcgttgccatgatttttcaggagcccatgaccgccctgaatccgacccgccgcatcggcaaacagatggtggatgtgattcgtcagcatcgtcctctgtctgcccgtgaagcaaaagcccgcgcgctcacgctactgggcgatatgcaaatcgcggacgcgaagaacgtcatggagcgctatccttttgaactttcaggcggaatgcgtcagcgcgtcatgattgccctggccttttcctgtgagcctgacctgctgattgcggatgaacccacaaccgcgctggatgttaccgttcagcgccaggtgctgcgcctgctgaaacaaaaagccgaagcgaccggcaccgccgtgctgtttatcagccatgatatggccgtggtttcccaactgtgcgatcggatttacgtcatgtatgccggggccgtcattgaaagcggcgtgactgacaccgtcctgcgttcaccgtgccatccctattccatcggcctgctggcctgctcgccggacgcgattgaaccgcgtgcgccgctggcatcgatttccggaaccgtacccaatctggcctgcttgcccgcaggctgtgcctttcgcgagcgctgttttgcggcgggagaacgctgcagcaacccgccgcgacttcatgccacaggcgacaccgcccagcaggtcgcgtgctggtatccacaacaggagacgcgtcatgtctgatgctctgcttacgctgcaaaacgtgcatgtcaccttccctgccaaaaagaactggcgcggcaaagtgacggaacgggttcatgcgctgaatggcctggatattcaggtccgacagggcgaaacactggggattgttggcgaatccggctgtgggaaaagcaccctggcgaaactgttgatgggcatgctgagtccaacctcaggccagcttgaactggcaacggccccagccggtcatcggggacgtcgtatgcagatggtgtttcaggaccccctctcttcccttgatcctcgcctgcccgtgtggcgcatcatcaccgagccggtctggattcagtcgcgcccatcagaaaaagcgcggcgggcgttggcggaatcactggcaaaccaggtcggtattcgtcccgaatacctggaccggccgccgcatgcgttttccggcgggcagcgtcagcgcatcgccatcgcccgggccctgtcatccgaacccgatattatcgtcctggatgaaccgacctccgcgctggatatttctgttcaggcgcagattctgaatctgctggtggacctgcaaaaacagcaaaacctcacctacatcctgatatcgcataacgtgtcggtggtgcgccatatgagcgatcgcgtcgcggtcatgtatctggggcagattgtggagctgggcgaaacacagcgcgttctggatgcgccccagcatccttatacccagttactgatggagtcggtaccgcgcatcggcgcggcgctggacggcgcgccggtcaacaccgagctaccgggtaaccgtcacctgccgacgggatgctattttcgcgatcgctgtccacaggcaacacgcggctgcgaggcgccccagccactgttattacaggaaaaaggcagtgcggtgagatgttggcaggcgcaaatccccatccaggcctaagccataccgaacacagaccgcgcggacaatgcccgcgtggttgagcgataacgcgttcaggataaatatcaagatgaaaattattgtactcggtagtggtgtcgtgggcgtgacaaccgcctggtatctgcagcaggccgggcatcaggtaaccgtgattgaaaaagaagccggtccggcattaggcaccagcgccgccaatgccgggcagatctcccctggctacgccgcgccctgggccgcgccgggtgtccccttaaaggcggtgaagtggatggtgcaacgccacgcgcccctttccgtgcgtccggacggctcccgctttcagctcgcctggatgatgcaaatgctgaaaaactgcaatccgcaaagctatgccgaaaataaggccaggatggtcaggctggcagagtacagccgcgactgcatcagagcactgcgggccagcacgggcattgaatatgaaggacgtcagggaggcacgctgcagctgtttcgcaccgctcagcagtttgacaatgcggcacgcgatatcgccgtgttgcaagacgccggcgttccttatcaactgctggaagcctcacaactggccgaggttgaaccggcgctggcggcggttaagcataagctgaccggcgggctgcgactgcctaatgacgaaactggagattgccagttatttacccagcagcttgcggcgagggcgcgcgaggctggcgtcgacttccgttatcacaccaacgtcgatgcgctgctgacacagggagacaggataagcgggattgtctgtggcgctgaaacgctgacggcggacggatacgtcatggctttgggttcatactccacgcaattgctccggccgctgctgtctgttccggtttacccactaaaaggctattcactgacgattccgattgtcgatgcgtccggcgcgccggtatccacggtgctggatgaaacctataaaattgccattacgcgttttgataatcgtattcgcgtgggcggtatggcggaaatcgtgggatacagcaaaaccctgctgcccgcccggcggcaaacgctggagatggtcgtcaacgatctctttccacagggcggacaggtgagtcaggcaaccttctggaccggattacgcccaatgacgccggacggcacgcccatcgttggcccgacgcatttcaccaacctgtggctgaataccgggcacggcacgctgggctggacgatggcctgcggctccggccagctgttgagtgatgtgatttcaggcaaaccgccggcgattgcccatgcggactatgccgtgtcgcgctatgcctgagccatacggtgcaaataatccggatgttctaaagcaggaagtactaaaaaagattaattttcaggcaggatcacatagagatcattgttgtaaacgttgatattctggtccgtactcacggaccagagagactttacatgtctgaatatactttgcaggactgcaacattacggtgcccgatgtatttcgcgatcgcaccatgaacctctttacgctcagccatacgaatgccaatgaattcaccttcgtgatttcacgtgcaacagcggctgcagaagacacgcttcagtcagtatcccagaggctgtcatccgaactgcaggctactctgcaggacctctcactcaaccatgcccggcttactgagttaagcggaaggcaggctctggaactgttttacagtttcaaagccggggaaagaattatctttcagaagcaaagggtggtgctgacatctgaaaacagtacggggaaaaagctcctctgtttcattggcacctgcccggatgcgtttgacgattaccatagccggatttatgacagcattacgtttccggacgatgcactcggttcgcccgcacggggcagcaagatcccgccgacagtcatgaaatcttcttcagctttggttgggttaccgcgcttaatgggcaatgataacgtcactaaaattacgacaattgatccgatgactcagtccgaaaaagtcatttttgtgagggataactgatatgaaagtctcaggcaccagttcgcatgtgtaccttgatatggatggccagataatcaaggccgagggtgaaatgattgtgggtggattcgtcgcttacaaaagcacgatgaaattcgagcctccctatgaaaatgaaccggtcactgaagcaatccgtcagaaatacattgatgaagcgttaagagaaacaaaagactcatatatgaagctggaattcgaataatttaccaggccctgaatttaacgtccccctgaaaagaaaaaacaaaataagtcagacgaccagggatattccagggaacaggtcactccagttttcgaaatcctgaaatgacccatgaccccatcattggcgacatggcagagtctaatcagtgtacaaactttttatgcaatctggctcttatgtacaaaggtatattattccagaacagttacagagcctgggcgcaagcccaggccgaactccaggcccactggaaattgtatccccccagccagccggtcacatcgaccacctcgccgatgaaatagagccccggtacgtcgcgcgcttccatggttttggatgaaagctgagtcgtgtcaacgccgccgagggtgacttcggcggtgcggtaaccttccgtgccgtttggctgcacctgccagccgtgcagcgtctgcaccagttctgtctgctgtttgctattgagttgcttcagcgtgacatccggcacgactttcatttcctgcaagacttcgaccaggcgcttaggcagaattttggccaggctgtttttcaggctcagattcggatgcgcctctcgctgaatcgtcaaaaaatcatccagacgggtggccggagagagatccaccgtgaggaactcgccgggctgccagtagctggaaatctgcaacactgccgggccggacagaccgcgatgggtgaacagcatcgcctctttaaatagcgtgccgtcctttgccgcaatggtcgtatccagcgcgacgccagacagcgtctgcagttggtctaatagcggtttgtgcagggtaaaaggcaccaacgccgcgcgcgttggcaacacactaagcccaaactgctcagcaattttatagccgaacggcgatgcgccaaggcccggcatggaaagcccgccgctggcaatcaccagcttctctgcctgcaccgcgctgccgttgagctgcagatggtagcccgcgtcatcccgggatacgctcagaatgtcgctgcgcaggcgaacggtgacgccaccgttgtcacactcggccattaataaatccaccatctgctgggcagaatcatcgcagaacagctgtcccagggttttctcatgccaggcaatgccgtgacgattcaccagatcgataaaatcccattgggtatagcgcgcaagggccgacttacaaaagtggggattattcgacagataggcggcgggttcagtgtagagattggtgaaattgcagcgcccgccgccggacatcaaaatcttgcggcccggcttcttgccgttatccagcagtaatacacggcgaccacgctgtcctgcctgcgcagcacaaaaaagcccggcagcgcctgccccaattacgataacgtcaaactgttccactgcaattgcccacctggtaagagaggggcagattgtagtgatctgctcctgtggatgccagtgtcaaaattttgccgtaaatatgtcacaatgtaactggttaatttatatagactttgtacctgttaaccgggttaattgacatttttagtccaaatcatgactatattttcctttcccagaccgcatgttgtcgcggataatgcgccgcgttcatgtcctccaaaatggcgtaacgtctatgctacatctgtttgctggtctagatcttagcaccggcctgttactgatacttgctctgctgtttgtattgttttacgaagcaattaacggctttcatgatacggccaacgcggttgcgacggtcatctacacacgtgccatgcgtgctcagcttgccgttttgatggcgggggttttcaacttctttggtgtattgctcggcggattaagcgtggcttacgctatcgtgcatatgctgcctaccgatctgctgctgaatgtcggctcggctcacggtctcgccatggtgttttccatgctgctggcggcgattatctggaacctgggcacctggtatttggggcttccggcttccagttcccacaccttaatcggcgcgattatcggcatcggcctgaccaatgcattaatgaacggcacctcggtcgtcgatgcgcttaacattcctaaagtgctgaatatcttcctgtctctgatcctttctcccatcgtcggcctggtgattgcgggcagcttaatctttcttcttcgccgttactggagtaacaccaagaagcgtgcgcgtattcatatgacgcccgcagaccgggagaaaattgatggcaagaaaaagccgcctttctggacgcgtaccgccctgattatctccgccattggcgtcagctattcacacggtgcaaacgacgggcaaaaggggattggcctgatcatgctggttctgattggcgttgcgccagcaggctttgtggtcaatatgaattcatcgggttacgacatcacgcgcacgcgcgatgcggttaaccaccttgagcaatattaccaacagcatcaggcgtcattgacccatatcatccagatggctccgcctaaactgcccacgccagaagaagtcgccccggcaacgtcaaccgagtttcattgcgacagcgcgcgtgcgctgcaggccgtgcagcgtgctcaggtgttgctgaacaatctgcaaagctatggcgatctgtccgtcgatcagcgtagtcagatgcgccgcctgttgctgtgtatttccgataccgccgataaagcggcgaagctgccggaaacctccgctgacgataaacgcttccttggcaagctcaaaggcgatctactgaacaccgttgagtacgcgccggtatggattatcatggcggtggcgctggctttaggcatcggcaccatgattggctggcgtcgtgttgccaccaccatcggtgaaaaaattggtaagaaaggcatgacctatgcgcagggcatgtccgcgcaggtaacagccgccgtatcgataggcattgccagctacaccggcatgccggtctccaccacgcatatcctgtcctcttccgttgccggtacgatgttggtagacggcggtggattgcagagcaaaaccatcaaaaacatcgccatggcgtgggtatttacgctgccggtctgtattttgttgtcgggttcgctctactggattgcgctcaagctcatctgagacagcggcaaatcagggcgacttcggtcgccctttttaatgccagatggccagcgcaatcaggctgatcaccactaatccgcacagcgaactggccaacataaacaagcctctcacccgctcacagcggcgaataaattcgtcatcatgatgatcaagatagcgtcttgcccagatataacgcaccagcctgacctgcttgccgggctgaccatgggcggtgaaaaaccctgcgccgtcaacgtactgatacagcaacggatcgcagccacgcaaaaccaccaacagcgcacgcaacgaagagaaatagcgcgccatattcacaatacataccacacagagagcccaaaaaagcgcgatagtgctgatcatctacccctccttaccggtactgcagaaaagtgctaaacgcgcaccctgctgaacagtccctgcagaattagccaacaaccccattaaatgatttgtagttttatttttgaaatatctgaacagatgcagcaatgtgacgaaggctgctttttcagtttaggagcaatgttcaattttttaccagcaaggattttcgttttatacgagtaaaaatcgttcatcattgatcttattcacaacccagacggcttcagacgcatttgttaacacagatgactatactttcaggtataacaacattatcgcctgtgctgtacgttaaccatttcggtggcgcgcatcgcccgttcgcgcaatggatttcgcagctatgacgcgtctggaaaccgctgccattctgaatctcgtggaaggagttatatcatggcttacaaacatatcctgattgcagtcgatctttcgccagaaagccagttgttagtcgataaagctgtctcgctcgcgcgtccttacgacgcaaaaatttcgttgattcatgtcgatgtaaattactctgatctctataccggcctgattgatgtcaacctgggcgatatgcaaaagcggatttctgaagagacacatcaggcgcttaaaagcctgtcggatgccgcgggctatcctatcaccgaaaccctgagcggcagtggcgatctcggtcaggtgctggtggatgcgattaagaaatacgatgtggacatggtggtgtgcggtcatcatcaggacttctggagcaaactgatgtcgtctgcccgccagttgatcaatacggtgcatatcgacatgctgattgtgccactgcgcgacgaagaggaagaataattcgcctgcgttaagccggtgcggctgacgtgcccaccggcttcacaaaccccgctactcagccagtggcggatagatatcgaagcggtgacttttggtaagcaccgcagactgcgtaacaacccctgccagcggtggcgcgtaatccgggcgtttcaccacgatacgtttctttgccagacggcgagccggtgccaacagagcatcagcgtcctcatccgccccaaccagcgactgaaagacccgcatctcttttttcaccatggcgcttttttgccgatggggatacatcgggtcgagataaaccacatccggctgcggggtgatatcggttaaggcctgaacgctggaggcatgaatcagcgtcaggcgctcacgcagccagccgccaatctctgcatcctgataaccgcgcgtcagcccatcatccagcagtgcggcgaccaccggatgacgctccagcatccgtacccggcaaccgagcgcggccagcacaaaagcatcccggcctaatccggcggtggcatccacgacatcgggcagataatcgcctttgatcccgaccgctttggctaccgcttccccgcggccgccgccaaaacggcgacggtgcgccatcgcgccagagacaaaatccacgaagataccgcccagtttgggctcatcccgtttacgcagttcaagatgtgtggcggttttgaccagcgccagcgtcgcgtcttcacagtgtgtcagttgccagcgcccggctaaaacagttaaggcgccgtcaccggcgcctgtctcatcaagcaaacagatgttcacgtacggcttatccctgaataccgtagtgttccagcatggcatccagctgtggttcacgaccgcggaagcgtttaaacagttccatcggctcttctgaaccgccgcgcgtcagaatgttgtcgaggaaggactgcccggtttcccggttgaaaatcccttcttcttcaaagcgcgaataggcatccgccgccagcacgtcggcccacaggtagctgtaatagcctgccgcataacctccggcaaagatatggctgaaggcatgagggaagcggccccattccgggctgggcacgacggccactttgcttttcacctcgcgcagggtttccagaatctgtgcacctttttccgggttgaactcggtatgcaggcggaagtcgaacaggccgaactccagctgacgcagaataaacagcgccgcctggtagtttttcgccgccagcattttatccagtagcgctttgggcagcggctcaccggtttcgtagtgacccgaaataaacgccagcgcttctggctcccagcaccagttttccatgaactggcttggcagctcaacagcatcccagggcacaccgttgatgccggaaacgcctgccgcttcaatgcgcgtcagcatatggtgcaggccgtgaccgaactcatggaacagcgtgatcacttcgtcatgcgtaaacagcgcaggcttaccacttaccggacgattgaagttacaggtgaggtaagccaccggtttttgcaggctgccgtccgctttacgcatttgcccaacgcagtcgtccatccatgcaccgccgcgtttgtgctcgcgagcatagaggtcgaggtagaaactgccgcgcagctcgccgctttcatcgaacaaatcaaagaagcggacatccggatggtaaacatcgacgtcagtgcgctctttggcggtaataccgtaaatgcgcttcaccacttcaaacaggccggacactgcacgagattcggggaagtaagggcgcaactgctcatcgctgatggtataaagatgctgcttctgcttttcgccgtagtagctgagatcccatgggttcatggtttctacgccaaacgctttttgcgcaaaagcgcgcagctgagccagctctttctcaccctgtggacgggcgcggtcggccagatcgttcaggaaatcgatcacctgtgccgggctctgtgccatcttggtggccagggatttatccgcgaaggagtcgaagcccagcagttgcgccagctcgtgtcgcagcgccagctcttccgccataatcggaccattatcccatttacccgcgttagggccttgatcggaggcgcgggtcgaataggcgcggtacatctcttcacgcagagcggcattatcgcagtaggtcatcaccggcagatagctcgggatatccagcgtcagcaaccagccttcctgccctttggcttccgcctgggctttggctgcggccagcgcgctttccggcatgccggccagctcgctttcgtccgtaatcagcttgctccagcccattgtggcatcaagcacgttgttactgtaggccgaacccagctcggaaaggcgggccgcaatttcgccgtagcgtttctgcttgtctttttccagaccaataccggaaagctcaaaatcacgcagggcgttatcgacggctttctgctttgcctgatccagcgaagcatagtgactgccttctttcagattgcggtaggcctgataaagaccttcgtgctggccaacccaggtgctgtattcagaaagcagcggcaacgtttgttcataggcttcgcgcagttccgggctgtttttgaccgagttcagatggctgaccggcgaaaaaattcggctcaggcgatcgtcggtctccgccagcggctgtaccagattgtcccaggtgtaaggtgcgccttgcgccactactttttccaccattgcacggcattcattcaaaacgtcggtcacggcgggcaccacatgttcaggcttaatcgctgaaaacgggggaagtgtgaacgaggtgagtaacggattggtcatagcgcagtcctttaacaatgtgtggggcgcgatgggtcgcgcaacgcaattcaattaacatgcggtcggataccgcgaaaatcaatggcgcgacttgtcgtgatgtaaacaatggcgcggattatgatcctacagacgatgagatcaagcatagctgaggacaacgcaggctatcactttcctgtcgcggcatggttaacagatgttaacagcctgtgtcagcctcctgattagcgtgtaaagcggactgaacagcgcaggcaggacgcgcggaccacggctgcgcgcgaaatgccagcaattattcctgtctgtcgttataatcgggccaacgttatcatttttagcttcaaccgcggacatccccttttttatgctgagttatcgccacagttttcacgccggcaaccatgccgatgtgcttaagcacaccgtacaaagcctcatcatcaccgccctgaaagagaaagaaaaaccctttctctatcttgatacccatgccggtgcaggccgttatcaactgagcggcgagcatgcagagcgtaccggcgaatatctggaaggcattggccgcgtctggcagcagccggatgcgcccgcattgctgcaaccctattttgacgccattcatgccctgaaccggagcggtacgctgcgttactatccgggctcgccgctgatcgcccgtcatttgctgcgtccagaggataagcttcagcttaccgaactgcactccagtgattaccccctgctgcgaaccgaattcagtaaagacagccgcgcgcgcgttgaaaaggccgatggttatcagcagttaaagtcaaagctgccgccgttgtcacgtcgtggtctggtactgatcgatcccccgtacgaaatgaagagcgactatcaggcggtcgtcaaaggcattcaggaaggccacaagcgctttggcacgggcgtttttgccctgtggtatccggtggttatgcgtcagcaaatcaaacatatgctgcgcgatctgcaggcaaccaacattcgtaatatcctgcaaattgagctggccgtgcgtcctgacagcgatcagcgcggtatgacggcttccgggatgattgtgatcaatccaccgtggaaactggccgatcagatgaatacattgctgccgtggttgcaccagaaactggtgccaaccggtacaggccatttcagcgtaaaccagatcgtaccggaataacgcccttctcagattagcgccaccgcttctggtgcggcggcgttatacctcaggtcatttttatgtggatcatcctggcaggagcactggctgccctgcaaccggcgaaacgcctctcgctgttattactggcactggcaacggcgctgggggtttaccagaacgttctcgactggcctgttaccctcgtttttgctgctgttgccgcactggtcgcgtttcgtatttacgaccgtcggagccaagtgtggcagagcatcagcgaggcgcttctggtgttgattgccctcgcgctaatgctgcatcttattcctggcttcaacaacccacgccagattgatgccgttcgggctggcgcgcacagcctgcccttctctttttcatttaatttcgataaagccctgattcctttcttgctgctggcctgtatgccaacgctgtttaaagccgaggcgcacccaccgcgcacgcctgtgttatggctgctgcccgtagcggcgattccgctgctgttagtcagcgcggtatggctgggtggcctggcgtttgagcgacacgttcctgactggcttggggcctttaccctggcaaacctgttttttgtgtcgctggctgaagaagcgtttttccgcggctacctgcaacagcgcctgcgccagaaatggggcagcacagttgccctgctggtcaccgccttgctgtttggcctggcgcatgcgcccggcggcgtgctgctgatggtctttgccgggctggccgggctgatttatggcctggtctggcactggagcggtcgcttatggctggcaacggcgtgccattttgcgctcaatatggtccacctgctgttttttacctatccggcactggcgcactgaccatcacagcatgaataccgccaggtcctgggccatctccgtttcagggaagatggcctggcactcggccagtaaacgggccatatctctggcaagatagcgcgaactgaaatgggtggcgatcatccgttttgcaccggcctgctttgccacttttgcggcctgcacggtggttgagtgaccgcgtccgttggctttttcagccagtgcatcctccagcgtggtttcgtgtaccatcacatccacattcgcggccagctgtaacgccacctcggtaggtgcggtatcgccaaaaatcgccagcgttttgcctttggtgggcggccccaaatactcagcaccatgaaccgtgcgaccatcctccagcgtgatgctgtcccccagctttagctgttgataccacgggccacgcggcacaccttctgccttcagacgtgcggcatccagaaagccgggcttgtctcgctgttcaatacgatagccaaagcaggcaatggtgtgattcatcggccaggccgtaacacgaaactcgccatcatccagcacctcgcccgcctcgatttcaatcacctccagcggatagtcggtgtacgagctggacagagacagagcgttatcgacaaaggctttcaggcctttggggccataaaccgtcatcggcgtggtaagtcccgccattgaacggctggtaagcaggccgggcagaccaaaaatatggtcaccgtgcagatgcgtaataaagattttatcgagcttgccgggtttaagatcggagcgcataaactgaagctgtgtcccttcaccgcagtcaaacagccaggtgtcgccactgtctgcatgggtaaaggcaatggcagtgacgttacgctgcaagctcggcgcgccaccgcccgtgccaagaaaagtcaggtgcatgctatgcttctctgtaagtagtggaaaacaatggcctgttacaatcataggcgcaatttttgcgacaccctgccctgcggcgttacactctatgtcaatttccatgtaaccggatgatacttcaatgacccgacattatgactatctcgccatcggcggcggcagcggcggtattgcctcgattaaccgtgcagcaagctatggccagaaatgtgccctgatagaagccaaagcactgggcggaacctgcgtcaacgtgggctgtgtgccgaaaaaagtcatgtggcatgccgcgcaaatcgccgaggcgattcatctttacggccccgattatggttttgacaccacggtaaaccgcttcgactggggcacgctggtcaaaaaccgtagcgcctatatcgaccgtattcaccaatcatacgacaatgtgctggggaaaaataaggtcgatgtcatccacggctttgcccgttttattgatgcgcataccgttgaagtcaatggcgaaaccattacggcggaccatattttgatcgccaccggtggacgtccaggccatccctctatccccggtgcggaatacggaattgattcagacggtttctttgaactggacgcgctgccaaaacgcaccgcggtgattggcgccggttatatcgccgtggaactggcgggcgtggtgaacgcactcggctccgaaacccatttattcgttcgtaaacatgccccgctgcgcagctttgatccgttgatcaccgagacgctggttgaagtcatgaacgcggaaggcccgacgctgcacactcaggcgacgccaaaagcggtggtaaaaaatgccgacggcagtctgacgttacagctggaagatggcagcgactacaccgtcgattgcctggtttgggccattggtcgtgtgccggaaaccgacagcctgaatatccaggcggcaggcgttgcgctggatgagaaaggctatatcaaggtcgataaattccagaacaccaatgtgtcaggcgtttatgccgtaggcgataacaccggtgccgttgagctgaccccggtggccgtggcagcaggtcgtcgcctgtctgagcgtttatttaataacaaaccggatgagcatctggattacagtaacattcctaccgtggtgttcagccatccgccgatcggcaccgtgggcctgacggaaccgcaggcgcgcgaacagtacggtgatgatcaggttaaagtctacaagtcgtcctttaccgcgatgtacaccgcagtcacccaacatcgccagccgtgccgcatgaaattagtctgtgtcggcccggaggagaagattgtcggtattcacggcattggtggtggaatggacgagatgctgcagggctttgcagtggcgttgaaaatgggcgcaaccaaaaaagacttcgataataccgtggcgattcacccgaccgcagcggaagagtttgtgacgatgcgttaacagggcaatcctgattcgttcgcgacttaccctgactcactgatccaaaacgggcagtgagtcagggccttaattaaaataggtttcccgcaacggcgttaacgccgcgcccagcgccgaactgtccccttcgatctcgctcagcaggatatccggatattccgcagaaatgtcccagcgtgtacccgaactgacccgtggcatggctaaaaacatctcgcccagcttacgcgggatttccccgcctaatatgatggcgccgggatcgatgaccgcattcaacgcatccattgcccgatgcaggtttggcgttacctcttccacccattgctgagcgatcggccatgccggatcgaattgatgattgagatcgcgaatatctttaatttcaatgccgccgctgcgtagtcgatcgatcaagatccccaatgcaggacgcagcttgccctcttccggcgtaaaaatacggctgatctcccccgcattaccaaaagccccctgaaacggtttaccgttgatcacgatgccgccgccaaaaccgtaattaaaggagaggtagccaaacgtatcgtatttcagcccggcacctaaaaaagcctcagcgtgcgccgccgtggtggcgttattttcaatccataccgggcggtcaaataaccccgtaatttcacgacgcagatcgatgcccatccagctttttaacggttcaggcggattaaaatatttacgcgagtcataaagaaagcccgccatgctgtatcccacaccgcacactttttctggcgaaataccctgttgctttaaggtatccagatagtgatgtttgatatccagtaaggtacgggccggatcgcggggatgcgtatccagcacgctgtattcagtgataccgccacgaaaattaatcaggctggcggcaacgctgtccgaattaattgaaattccataaccgtaacgtgcgtccgcattaagcgataatgacgggctgggcttgcctcttccctgggacggcgattcccccaggctgagaaaaccattttcggtcagcgtatcaacaatgcggtgcacagaagactgattcagaatcgtttgtgaaaccagagaggagcgagaaatcccatcattacggcggacaagttcaagaataagtttttcactgcgattaagttctacttcatgatgacctgaatttccatgaaccacagcattgtcctcaccgtatttaataatgggttctgttaacaccctagcatgcttttatgcatcacgaatagtaaagggaatggcctttacgttttaataaaatgtgctgaatagcggctgattctgaccgacatgcctcgatcataaaatcgtcataatagtgaaacataacagagagacactctaatatcatgcagtaagcattatattaaaggcgatgccttatgtggcgtatttatactcatgctacataaacggatgggtcgcacacccccttcttctttctctttgcatcaggtaaacaatggatacgcgcttaaaagttgctgaacgcatcgcacaagaagctgcactactggccctggattatttcaggcagctgagtgaattagcgatctgcgaaaaaaggccacaggatgtcttcagtgaggcagaccgggaagtagaaaatcgtatacgccagcgtctggaacagcatttcccccaggatcgtgttatcggtgaagaacagggaggcgaactcagcgccagctactggtcagtcgatcccattgacggtacgagcaattttttacgcggctcgtcattgtggggcatttctattggttatgtgcataacggcgagccgctaatcggcgtcatcatccatccagcattaaatatcatggtgagcggcggtaaagaggcgggcgtttatctgaatggcgagccttttgaacggcccgtgatcgctgaggcgcttaaaaccgtcgccattggcgacagtccttcatgggattttacccaccagctctgcattgagaaagcctaccgggatgatggctggaatgtggtgcgctatcgttgcgccacggtcggtttaacctttagcgtgctcggttatgtggacggttatcaggaatgttttagcagcatgtgggacgtttctgcgggttatgcgctctgtaaagcggcaggcctggaagcgcaccttgccggtacacaggaaaaaagcatgacgcatgtcagtgtcggaaccgcagaaatgaaccgcctttctgcccagtttatcccccatccccgctttacccccgcctgaaaaacagactgcccacggcttatctcatcactgcacgttcaggacagcgtttcggcgctgtcctgccctctttttttaattttgccgctcagccacacctcactgcctctgcgctcaatattatccactacgcattaaaatagttagcacgttaaatgtaagaactcaaagtattaacctatctcaatgttaaatatgggttttaaaaacttaacgaattcttaacctgcctgaaattgcttaaattaacatccgacaattattatgcacatcgcattaattgcaaggcacacatgcagactaagacggggcagccatacgtgaacacactcgagatccataatgccatgctgacgttcgacgattttgtcgcactgaacggcatttcacttcaggccaaaaaagggcagtttgtctccctgcttggcccatctggatgtggcaaaaccacgctgcttaaagttattgccggctttcacagtcttgatagtggcgacgtgctgatccatcaacaggacatgcatcatgttaagcctgaacatcgcgacacggcgatgtgctttcagtcctatgcgctttttcctcacctttccgttgctgaaaatatcggttttggcctgaagcagatgaagatggcaaaaacggacatccagcagcgcgtggcgcaaaccgcctctcaggtatcgctcaatgcgcatttgcctaagctgcctgcccagctctccggcggtcagcagcagcgcgttgcgctggccagagcgctggcggtacggccggaaatcgttctgtttgatgagccactgtcgaacctggatgccaaattacgcgacagcgttcggttggagatccgacagctacagcgttcacatggctttaccgctatctatgtcacgcacgatcgtgccgaagccctgtcgatgtctgacgtcgtggtggtcatgaatgcgggaaagattgagcaaaccggcacccctgacgatatctattattcgccagtaaaccgctttgtcgcggggtttgtcggtcaggctaacttcatgaaagcccgcgtactggacggggacagcagcacgggtatttatcgtattgcgtgtgtcatgggcgaaatggaaatacacagtcaccagccgcccgtctcagactctgtctataccttctggcgtcctgaggatgccctgctgagcgaacacagcacggggaaaaacacccgcgctttcgagatcggtgcagtgagttttcttggcaatatttctgaactccaggtccatccgattgggcatgaagaaacggaatatcagtggtgtatccagttggtcggcaaaaaccacatacaggaaggtgaccgggttaacttctccattgcgcctgacagaatccgttttttacaggaaagctgttcatgaaaacgcgcaaccggaacaggctgtgttggctgctggttctgcctgccgtcgcgccggtggtgctcacgctggtgctgattgtcatcatggcgttggcgcagtccgttggcctgtttaattttggcgctccggcccacttcacgcttcagtactggcaaaccatcctgaacgacagtcagctgtggcgcgcgacaggctattcactcaagattggcgtcatcagtgccgttctgtccgtcgcgctggcgctcccgttagcgctgtggctgagaaagccctttcccggctcaatgctgatgggcggtttgctcaaagccccgctgatggtgcacggactggtcgccgcgctgttgttcatcaatctgatctcctggcagggctttattaacctggggttacttaaactggggatcatctctcaccccatcaggatgcagaatgaccgctggggaattggcgtgattattttgcaggtctggaaacagcttccctatgccttgctgattattaccggcagcctgcgcgccattggtgatgaactctttgatgccgcgcgagatttgggtgccggcaacgctgcccggctgttacagatcattctgcctttatccattaaatccgttcaggtgtcgctggtgctgattttcatcggcgcattgggtgacttttcatttcaggtggttgcagggccgaccagcgtcttttccctgtcgcaatacatgctgcgtttccccgaaatcagcgcccagggctggaatcttgcggcggttgtcgcggttattttaatgctggcggcttttgtcggtgcggtcgtgcttgccggtctggcgaaatggctacaacaagccggagaaaacaaataatgcaagccagagagaccttgtccccgctgcgggtcatcatgatgatcctgatcaccgccctgtttatgctgtggctggttattccctttatgttgaccgtactgtggtcactcgtcgacaaaacccatccctgggcatggccagatgccctgccgcccgttctctcgctgggccgttgggtcgaggtatggaccacgaccgcgctacctcaggcactcaggaacagctatctactggcggcaaccgtgtccatctgcaccctggtgctggccctgcctgcggcgtgggcgttcggcagaatgtcattctccggcaagcacctgttacagaatgcaattttactgccgctgatcgtaccagggtttgtcgtcgcgctgtttttttccatgctgttgaacgtcgcgggcatccacacccgatttggcggcattttgctgggacataccattatattaatgccctacgccgtgcgaattctgaccctctctttctctcaaatacgccaggacacgctcgatgcggcacgcgatatgggcgcctctgttattaatcgttttattgtggcttgtttacccaccatccggcccggaatatttgccgcattaattattgtctttacgttatcaatagaagaattcgcgataagttttattgtcggctcacccgattttattaccgtgccgaccattctgtattcctatctgggttacaactttatccgacccaatgcggcggttatttctttaatgctggttgtgccaaatgtcattttaatgttgatagcagaaaaattactgactaaaaaccctgttgcctcctttgcaggaaaaggctgacagccattatcactcgttattggggactattatgttcagactatttgccgcaatgttattgctggccggggctttctgtagccaggctcaggatctgaccacgatgaactggcaacagattgtcgagcaggctaagaaagaagggacattaacctggtatcactggtattaccaggatcgtttaaaagaacaggtcagcctgtttgaaaaacagtatggcattaaggtcacgctctctgaaggcccactgcagggcaatattaataaactcatggctgaccgtggacgtgaagcgggcgatatcgatctgttttccattggcggtggcgccttcggtacggtatcaccacagcagacattttttggtccgattaatacattacttcctgaaggtaaaaccctaaattattcgattgagggaaccgacagcaaaggctatggcgtggcgttttggggcaaccagacgggcctggcttatgattcccgtcgcatgaaagaaagcgagctgcccagaaccctgccgcagataacggccttcctgcaaagtcatccacaggaatttggttttaacgtcgaaaacggtgggtcgggtccggcgtttattgagtcagtcactcgcacgctggtgccgggttttgattttaccaaaggcgatgccgatgtaaaaagcctgacggcgctccagcccgcctggaactggttcaaacagcaacgtcccaattacatcattaccgcgtctaacgccgacagcgttacccgactggtcagcggcgagtttctgctggtgccggcctgggaagattatctggtgggcttagaaaaccacggtgaagtccctaaaaccatcaaactttatattcctgacttcggcatgcccggcggcggaaatatggtggccattcctaaaaacgcacaacacaaagcagcagccttgctgtttatacactggctgacgctgcccaccacccaacggctgtttcagcaggtttatggcatcacgccgcaaaataaagaagtgaatcgcgatgccgggctaatcaacagcaaagagcgcattcatggtacccagttcatgcctaagccgctgggtgatgaagtcagaacagaattttctaatcaggtcttactcaagtagatcggcgatacacccataacagaaggtaaagcgaagaatgtcgaagaaaaaacatcctgtgcgcgtggtgaactcgcacctgattgcccaccgtggcgcgcccctgttagcgccagaaaacacgctgccttcgtttcaggccgccgttgaacacggggcaacgtggatagaggtggatgtcaaactgaccaaagatatgcacccggtcattattcatgatgatgctgtcgaccggaccaccaatggtaaaggctatgtggcgaacttaacgctggatgagatccgctcgctggatgctggcgtgcgttacggtcacatctttaaaggcgtcaaagtgcccacgctggctgaaacagtgggctttgtgctggataaaggcatcgggctgcagctggaaattaagccgacctcaggacaggaaattgaaacggcggagattgcgattacccagttgaagtcgctgtggcccgcaggcgagaagaagttatttattagcagcttctctgaactctcgttacaggttgccgcaaagattatgccggacgtcccacgtggactggcggtgtgcgtgccgccgaaagatcctgcagcgctgctcgccagaacagattgccagatcctgcatttcctgggcgacttcgccacggacgatgacctgcagcgcctgtcccattcagggattgagttcgcgattgccaccattaatgacccggcactggcccgcaaatatatcgacgcgggcgcgcaaacggtgttaagcgatatacccgacttagcattttaataaaaagtattttaataaaaaaccatcagggcattacctgcctgaagggctggcaccagggaaaagcattataaaaaatggccatattatttatggccagataattgattttattgtttcgctattcgacaaaacgaatgtgacgttgaaataaatgccgccctgcgcggttacatcctcacgcttcaatgactagataagggtagatgatatgcacaacaaaataaaaacagtcgcgccgtatgcaatatgttttctggtttcattttctgcatgctccgccgaaatttataataaagacggtaataaactcgacctctacggtaaagtcgatgcgcgccatgtgttttccgataatatcgcggaagatggtgacaactcttatgcacgtctgggctttaaaggtcagacgcaaatcaacgataagcttaccggctatggtcaatgggaatataatttccagttgaatcacagtgaaggcgccaccgacgcccaaacaggtaatgccacgcggttggggtttgccggtctgaagctggatgacttcggttcattcgattatggtcgcagctttggcgcactgtatattgcctctgcctacacagacatggcgccaatctacggttctggcaccatgaccaccaacgataacttcctgtcaaaacgctcgaccggtcttgcgacctggcactccccggactggggcggattaaagttaaccctgcagtaccaagggaaaaatgatcgttcaaccgccaaactggcgaacggggatggctacggtgccggtctgacctacagcatcaccgatggcttgagcattgccgccgcgggcatgaaagcaaaacgtaccctgactcagcaagctgacggccagggagacgaggcgaccgcctgggtaacggcggcgaaatatgatgccaaccaaatctatctggccgccatgtacggtgaagccaacgatgtgacgccttatggacagctggcacaggtcgccgataaaacccataactttgaggcgattgcgcaataccagttcctgaacggcttgcgtccctctgttgggtttgtgacacagcgtggcgaaaacctgcagggcgcggggaattttgccggtggcagccagactatgcagaaatatattgcggtgggcacctactactatttcaacaagaacatgctgacctatgtggattaccgcattaacttgctgaaagaaaatgactttacccgtgcaaccggcattacgacaaaaaacagtatcggtatgggcctgacttatcagttttaacaggcggcccctgcctgcacacgtgctttaacctgtatcgcttcaatcctgagaatcgctactgtcgcgaggccggcgaatgccggctttttttttacgtcagtccgcagagaaaatggctaaagggcggaggtggcagcgtgcctgacgggtgacgtgccctgacccaggttttccagccatttcacgtaagcctgatcccacagggcggcaggcgtgccggctttacctagtccaaaaccatgtccaccgctggaaagctggatcagctgtactggcacacgattgcgacggcaggtgtcacgcattaactgggtattaaagggttttgaggtgtgatcgtcgccggcctgggccagaaatgtgggcggatacagattcgtcacgtagttttgtacggaccaactggcttcttcctgcgggctggcgtcgttgcccaccatcatcaggtgagtattggtatgttgatacggcgcttccagcgtaatcaccggatagatcagccctacgctgtcggcttttggcacttcctgatccagcctgtcaacgggcgtgtatgactgaaactccgggcgtgccgccgccatgcccagtaaatgtccaccggctgaaaagcctaagacatgcactttacgttcaaacgatcgtatcaggcgcagggcacgctgtgcatcctgcaagggcgcaagattacccgcctgccatttctcgcgcggcaaacgatagctcagcacgtaggcggtataaccattggcatttaaccagtgcgcgacgggccaggcttcgcggcccatgccaatccagcgataaccgccaccggccgcgattaataccgcttcgccgttgggattttctggcctgaaacgttgaatcgccgggctgacaatattggaccatgaaccccatgcatcaacatgcagggtgccagacggaccgccgccgccgggcggttcgtccggccagaggggaataatatcatcgcgggcaaacagtttgctggtagccagtgagagcgcaagcgctcctgtgccgaaaataaagcgtcgacgcgtaatcatgatgcctgttaaatcaatgctataaaagttagccgaccttttcggcccgctgcgttgttattatgtatcgcacatttggttaagacgctggcgattatgtacgcaatcggtagtgaaaatccattaaaaaacgcgccattttagcgcgtttattgacgatttaacgacggttaatcttcttgctgaaactgcgtcattaccgtttgctcacactgctgtgaattggtacgcagtttggcgcgttcttcatcgcccagttgtagccatgcactcgccacttcgtttgccagctcttcgtcaaattcaggcttactgacggcagaggaggactgcgatcctgccacgctggctttcattttttcgacatactggtcagctgtcgaaacgcttttttcactgctgacaatatggcacagctggctggcatacacgctttcttcactgttctctgccgccagtgcactgccagaagccagcatgctcagcaacagtatctgagatatcttcatcatctactcctgttatcagttaactcactctcatgactggcgctgtttcgcctccagtcgcgcctggcgccagttgagcagcggcgtcacagaaataccgtggaccacgatgctgcacaccaccagcgtcagcgccatatcaaccattatctttgcctctgccccgaccatgccatggacccaggcaaacgcaatatagttaagactaccaataccacggatacccagccagccaatcagcaaccgctgaggaaccggcatgccagtgcgcagggtcaccagccagacggcaagcggtcgcaccaccgcaaacagcaacagcccaagcaggacgccctgcatgttccagtggtgcgccatggtcacgccaagtaccaccatcatcatggcagccaacaggcgttcgatagtatcgccaaaagagagcgcatcgcctaccactaaaccgaccgatttcaccatgccactgctacgttgctgtaaccgtttgttgggattcaccagcgcctcggcaggcagcagccgatcgtcatcgggcatatcgtctggttggtagcgtttaaagacgcccagctccgcacggcgcaggcccagaccagccgcaaaggtggccagaaagcccgaggcaccgacccattcggccagtgcatagctgagcgcgatcagcgccagcgcgaggaagtcattgggtgccacatcgccgtgggcattgcgcagccgggtggccagcagaccgaccaggcgacccagtccaaatcccaacaggatgccgccgccaatggcccacacgacatcgacagcagcccagtgcgccaccatgcccgtgcccaggctttcgccgttaaacagcagcagcgccagaatcagtaagggcagtgcggaaccatcgttcatgcccgcctcactggaaatggctacgcgcagggcatcatcatcctgagcatcgctcacggagatcagactcgccagcacaggatcggtgggcgcaacaatcgcgccaaacgccagggcaatgggccacgacagccccaccagccagtgagacagcagcgtcatggcagcgaccgtcatcaacatcgccgggaacgccagtaagccgccagcgcgccagctccgggccttaagcggcaggcgcagctttaggccggtaatgaacaacgacgcggccatggtgatttcagtaatgtgcgtgacgagttccgcatggcgaaggatatcgatttcgataacatcaaatacccacggcccgcaggctatcccggctaacaagaaaagaccaaaagaggtcaccgggccacggtgtatccaccctgatgccagcgacattaataacagaagacagcccgtcgcagctgtccaggcaataaagttcataacgcaccgttttaattgagtttatgactaagcctggcacatttgctgacgggcggaaggatcagtccttgaggtggcgactggcgagacgcacgatcaggctgacagccgcggccagcgtcgacaagaccacaacgccattccagccccagtgagcaagcgccaggctgcccagcgccgcaccgctcgccatgccgataaacacgatggtaaacagcagggcattcagtcggctacgcgcgtcgggcaccaggccataaatcagggtttgatgcgcgaccagcgtggcttgcacgcctaaatcaaagccaatggtgcagataatgattaataccagctgaccggggagcggcagcagcggcagcaaaaacatcagggcgaaagagaacgtgaccagagcggcaccaaactgggtgacgcgcgccgggccgatacgatcggcgacgttacctgccagcggcgcggccagtgcacctgctgcccccgccaggccaaaggcaccggcgatagcactgtcaaagtgaaaacgttcgctgagcatgatcgccagtgtggaccagaaggcgctgaagctcacagagagcagcccctgagccagcgcggctcgtcgcagggtttgatgttcacgccacagctgcaccagcgataaaagcagacgcggatagctcactgacgtgccaggcgtaaagcgtggcagcacgcgccacaaggtcaggctgatcagcaatacggccatggccgctatcatgtacatcgtgcgccagccaaaatactccgccaccacgccgctcacgacccgggataataaaatccccaccagtaaccccgtcattaccgtgccaacgattttaccccgacgttgtgccggagccagcgcggccgaggccggaacaatgtcctgcgccacggtcgccgtcagcccggtcacaaagctggcgatgagcagcgcgctgatgccgccggagaacccacataacagcagcgccatcaccagcagcaatcccttaactaaaatgatggtgcgccgatcgtggcgatcgccaagcggggccagcagcagaatgcctaaggcataaccggcctgcgttaacatcggcaccatgccaacagtaccgacgctgatctggaactgcttactgatgatatccagcatcggctgactgtagtaaatcgaggcgacgctcaggcccgcgccggcagccagcgtaaagaccaggggcgcgggcagacgttcggtggcaggtggggtgatattgtttaccgctgacatggtggcatcctcaaaaaatagtgtgacaagtaaagcctgtttttgacatacgcggtagactcataaaagacaaaacggttatacgtgggacgcatgagcaatttcaataacagcgatcgtatcgaattgatgcacacttttattcgcattgtcgagagcggcagtttgaccgcagccgcgttacaactgggcattacgcaaccgacaatcagccgccgcttgcagtctcttgagcaggggcttgggctgaagctgattctgcgcaccacgcatgcgctgaagctcaccgatgatggggaacgttgctatgctcaggcccggcagctcatggcgacctggcacgcgctggaggatgaactgaccggcgcgggcagtgatccggtcgggatattgcgggtgcgggcgcctcatgcattcggtcaggatcaactggtcgcaccgctggtgacttttatgcgccgctatccccgtttacgcattgaatggatgctgaacgacaggacgccagacttcgtcgccgagaacgtggactgtgcgattcaggttggcgcaccgaccgatccttctgtggtggctgtgctgctggctgaagtgccacgcattgtcgttgccgcgcccgcgctactcttgcagcatccgccggtcaggcaggtggaacagctgggggatttgccctggctggcgttgaccagcttctaccgtaacgagatagcgttacagaatcaggacagggatgaaccggtgaatctgcccatcgttcccgtgctcagtagcgacagcctgtatgccgtgcgcaaggccgccctggcgggcctgggtgcggctattatgtcgacatgggtcatacaggaggatttggcgcagggcaatctggttcagttgatgccggaatggcaggctcccccgttgccggtgtggctgacctatccctgggcgagctactatcctgccaggctgaccgcgttttttgccatgatcaaagcggtatttccgcacctgacgggcgcgcgccccgcgtcaggctgaaccgggcttcccccacaagggaagccgtataaccggacggcgttcggcgatgttgcggttggtcagacgtttttcttttccgctcgcgacatgttgtccagccagcccatcacgaaggccgacaggacaaaggtcagatggatgatgacgtaccacatcagcttttcattttcgacattgcgcgcatccataaatacccgcagcaggtggatggaggaaatcgccacaatcgaggccgcgactttatttttcagcgagccggaatccattttacccagccagctcagcttctctttgccctcgtcaatgtcgagtttggacacaaagttttcatagcctgacagcatgaccatcaccagcagcccgcccaccagcgtcatatccaccagcgacagcagcagcaaaatcagatcgttttctgcgatgctaaaaatgttgggcaacaggtgaaaaatttcctggaaaaatttgacggtgagcgccagcaatcccagcgaaagtccaatgtaaaccggagccaacaaccagcgcgatgcatacatcaggttttcggtaaaacgttccataatttcccaatcataatcagtaaggtcgcgcattataaccgatcatctgtgaagttatttcaagccttcaggagaaatttcaggaaccggtggcagcggtaaagagaggcggaagcaggcaccgccttccgggcgattttccgcccagatctggccgccatggctctcgataatcgttttacagatcgccagccccaggccgacgcccggcaccgccgattctttatcaccgcgcgaaaatttgtcgaaaattcgcgtcaggtcattgtcggctatgcctgggccaccatcccagatggcgatttccagccgcgtattttcacaccaggcccgaatgccacgaggcgcgcagttgcctgcgtacttcaggctgttttcaatcaggttggtaaatacccgctccaggagcgtgctgtcgcctttaatcaaaacgatatccgtaggcagatcgagctcaacctcccgtcctttgagcgacggagccatgctgctgagcgcgccgccaatcacctcttccagcgccagccactcttcgcgcaaattcagaccacccgactggatacgcgccatatccagcatgttactgaccaggcgaatggtactcagggtttgttcacgaatctggctggcctgcggtacatactttgagtcatcactggccaggtccagcatcagcatttcggcctgaccaaacagcaccgtcagcggcgtgcgtaaatcatgggacagggctgacaacaaggcattacgcagctgttcccgttccgcagacagtcgcgaagccgcctcactttgcgacagcgccatccgctccagggcgttggcaatcaggacggtgaaggtttccagcagccgctgctgttccggcaccatcagctgacgcacattttgcggttcaacgaccagcaatccgcgacacaaatcgcccacttttaacggaagaatttggtaaggcaccgccggtaaggtatccgtgcctgcaccagcaggctggcccttactgaagctccatttcgcaattgcccgatccggttcattgcccggcagcgcattgcccagggtttgcagttcaccctgttcatcgggcaacagcagcaggcagcgcgcctgtaacgtcgcctccagcacccgctggctggttgcggcgatatcttcgggcgtcaggccgcttcccagtgacttagccatttcgtacagatgccgcgtgcgctgctcacggtaacgcgcaacccgcgcctgatagcggacaccggccgtcagattacccacaatcacccccaccgccagcatgacgccaaaggtcactaaatattgcagatccgacaccgcgaccgtgccggttggcgcgacgaaaaacaggtcaaaggcaatgatgttcatcaccgtggcaatgaccgacggccagcgcccatagcgcaacgcgacgatcaccaccgccagcaggtagatcatcacgcagttggccggatcgaagctgatcagcaccgactgccctgcggcggtgaccagaatacacagcaccagcgccatcaaaacgccgcgcagctgcagccgccatttatcgctgttaacccgatcctcggctaacggatggggcgcatcctgaatcggctcattcagcgccaccaccagcagatccagatcgggccccagttgccccagacgttcggcaaagctgtcacgacgccagcgccgcacagggcgtcgccccgtcacgatcttaccgaggttgtgttcacgtgcgtaacgcaggaccgcctgcgcctcatccgggtcggagagcgtcgccgtttcggcccccatatcctgcgccagcttcagcgtgcgtaaaatagcccgacgccgcgcttccggcagccggttgaggcgaggcgtttccacgtaaaccgcatgccactcgctgcccagtctggcggccagccgcgccgccgtccgcaccagtttttcactgccggtgtcatcaccaatacacagcagaatggcatcacgcgtatgccagacacgatcccgtccctggctgtcacgccaggcgcgcatctggtcatctacccgatcggccgtgcggcgcagcgccagctcacgcagggcaaacagattgcctttacgaaagaaattttcgatggcccgttcggcacgatcgccaatgtacaccttgccctctttcaggcgttggcggaggtcgtcggggggaaggtcgaccagcaccacttcgtcggcaccgtcgaaaaagggatcgggtacggtttcgcgtacctgaatgccggtgacgccaccgacaacatcattcaggctttccagatgctgaacgttcactgtagtcaggacatcaatgccggcctccagcagttcttcaatatcctgccagcgtttgggatgacgtgatcctttcacgttggtgtgcgccagctcatccatcagaatgaccgccggatggcgtgccagcgcggcatcaaggtcgaactctgcgtgccgcgaacggccagtggcgcggcgcggcaacagcaccagtccattaagaagctgggccgtttccgggcggtcgtgcgtttccaccacgcccaccagcacatccagtccctgggcacgcagccgctgcgcttcctgcaacatggcataggttttccctacgcccgcgcaggcaccaaaatagattttcagtttgccgcgatggctgtcactgctggcctgcagcagggcatccggatcggggcgcagcggttcgtggttcatagcttccttagacttatttgaggtcattcagcgccaggttaagctgcagcacgttcacagtaggttcaccgatgaagggcaacagcggacgttgcgtcatgctgtctaccagtgcgtcaactttcgccagcggtaactgacgtgccgccgcaatgcgcggggcctgccacagcgcggcttcaggcgaaatctccgggtccagcccactggcggatgtggtaaccagttccacgggtaccgcgccgttggcctgcggattcgccgcccgtaacgccgctacgcgttctgccaccgctttatccagcgccggattgctggcggccagattactgccgctggatgccagcggattgtaaggtttatcaccggttgcagaaggccgcccccagaaattaccgggttggctaaaattctgaccaatcagcgcagaaccccgttcttcgccatccacttttaacaacgacccgttggcctgccagggaaacagccactgcgacaggccagtggtgagcaaaggataaaccacgccgcacacaatcgttagcaacaaaagcaggaaaaccgccggacgtaactgactcattttattctcctcaggccataccagacagcacgagcaacatatcaatcgccttgatgcccacaaacggcaccagcagcccacctaatccataaatcagtaaattacggcgcaacagcgacgcggcactcaaggggcgatagctgacacctttaagcgctaaagggatcaggaacacaatcaccagggcgttaaagataacggccgacaggatggctgatgcgggtgagtgcagatgcatcacattgagcatatttaactgtggataggtcgccgcaaacgccgccgggatgatggcgaaatatttggcgacgtcattggcgatactgaaggtggtcagagaaccgcgcgtcatcagcatctgtttaccaatgtgtaccacttccagcagtttggtggggttcgagtccagatcgaccatgttccccgcttctttagccgcctgagtaccggagttcatggcaaccgccacatccgcctgtgccagtgccggcgcatcattggtgccgtcgccggtcatcgcgaccaggcgcccttccgcctgatactgacgaatcagcgccagcttggcttccggcgtcgcttctgacaaaaagtcatccacgcccgcctctgccgcaatggcggccgccgttagtgggttatcaccggtgatcatcacggtcttaatgcccatcttgcgcagttctgcgaaacgctctttgataccgcctttcacaatgtctttcagcgcaaccacgcccagcacttttgcgccctcggccaccaccagcggtgtgccaccggcccgcgccacctcttcaacccgggcgtttacttctgccggaaaggcaccgtggctggcttcaatatgacggcgcaccgcatcgaccgcacctttacggatcagacggtcctgtacgttgacgccgctcatgcgggtttgggcagagaagggaataaagctggcgcccatgctgctcagatcgcgttcacgcaggttaaacttttgctttgccagtaccacaatactgcgcccttccggggtttcatccgccagtgacgccagttgcgcagcatctgccagctgctcttccgttacgccgggtgccggtaaaaactgcgttgcctgacggttacccagggtgatggtgccggttttatccagcatcagcacatctacgtcccctgcggcttcgactgcccggccactggtggcaatcacgttagcgcccagcatacggctcatcccggccacaccgatggcggacagcaggccgccaatggtggttgggatcaggcacaccagcaacgccaccagcaccgtgatggtaaccggcgtgccgccccaggctgaaaaaggccacagcgtcacagtggctaacagaaacacgatggtgagcgacaccagcagaatagtcagggcaatctcgttcggggttttacggcgctgcgcgccttcgaccatggcgatcatccggtccaggaaggtttcccctgggttggcgctacaggtgatgaccagccagtcggacagaatgcgtgtcccgccagtcaccgaggcaaaatccccccccgactcacggatcaccggtgccgattcgccggtgatcgcgctttcgtccaccgatgcgcccccttcaacgacctcgccatcacaggggatgacatcaccggcttccaccagcaccgcatcacctttgcgcagttggtcagccgcaacctgctgccatttttcgccgtagtgcgcagcagacagttttttggcgaagctggtctttttaacccctttcaggctgtttgcctgggctttactgcgcccttccgccagcgcttctgccatgttggcaaacagcacggtgaaccataaccacagggcaatggcaccggtaaaactggcgctaccgctctggtgtccggtaaacatcattaaggccagaatcgtagtcaggatgctgcccaggtaaaccacaaacatgaccggattgcgaaactgcacgcggggatcgagtttttttacggcatcgatcgctgaggcacgtaacagcgctgcgtcaaacacctgttgttgacgactcatgatgattgtccctgaataagttgcagatgctcggccaccggacccagcgccagagcaggaataaaggtcagcgcgccgaccagcaagacggtaccgattaacagggcgataaacagaggcccgtgcgtaggcagcgtaccgttaccgaccggttgcacttttttcaccgccatggcaccggcaattgccatgaccggaatgatgatgccgaagcgtcccagcagcatgcacaccgccagcagcaggttccagaatggcgtatttgcgctcaggcccgcaaaggcgctaccgttgttattggcagccgacgagacggcgtacagcacttcactaaagccatgcgttcccgggtttgccatgccggcgcgtcccgcatcggtcatcatcgcgatcgccgtgccaatcagcaccagcgcgggggtgaccagaatcgccagggcggtcattttcatttcccacacgtcgattttcttgccgagaaactctggcgtgcggccaatcatcaacccggcaataaacaccgccagcaagacaaacagcagcatgccgtacagaccggcaccgactccgccaaacaccacttcgcccagttgcatcagcaacatgggcaccatgccgcccagtgcggtaaacgagtcgtgcatggcgttcactgcgccacaggaagccgccgtcgtaatcaccgcatacaggctggagttaaggatgccgaagcgcgtctctttgccttccatattgatagcgctgtcagcgccgagcgtcaggaagtgcggattaccatgcagttcggcccacatcaccagcgccgcggccaccacgaacatcaacgtcattgaccacagcaacatatttccctgacgacgatctttgacgctttcgccaaaggcaaagcagagagccgccggaataaggaagatacttaacatctggacaaaattggtgagtgcggtgggattctcaaacggatgggcggagttgacgttgaagaaaccgccgccgttggtccccagcattttgattgcttcctgagaggcaaccggccccattgccagcgtttgctgtgccccttccagactggtgaggttgtgataaggcaggaagttctggatgctgccctggctgacaaaaaacagcgccatcagcaggctaatcggcagcagaacgtagagcgtcacgcgcgtcaaatcacgccaggcattgcccagcgtggcgatagatcgattcgcaaaaccacgaatcaatgcaaacgcgatggcaataccggtggcagcggacacgaagttctgcaccgtcagtccgaccatctgactgaaatagcttaaggtgctttcgcccgcataagactgccagttggtgttggtgacaaaactgatggacgtgttcagcgccagatcccagctcagtccgggcagatgctgcggattaaggggcaactgtccctgaaacatcaacatggccaacagcacagccatgcccagcagattgaacaccaggatcgccagcaagtattgctgccagcgcatatcgccttgttgggttcctgagatgcgccacagaaaggcttctgcacgcgtaaacaggggcttgtccgcgactaacgcggccagcccgcgccccagcggctgcgccatcaccatcagtaacagcagataaaccgctatcagtaaaaacgcattcgccgccatcagaaggcctccgcatttaacagggcataaatcagatagcccagtaacaacaccaccagcacaatgccggttattacgcctgcgctcacagcaacctccagaggattggatttgctgagtagcttgcgcctgggcacataaagaaagggttaaaaagcgggtcggggatataaaaaatgtataaaaatagccgtaatatcaggcggcttccagctgccagatgcgcctcagatccacgccgtcccagccaccgttatcttcggcacagacaatactgtcagtacagaaactgtcgcccagatccagtacctcaggtttaatttcccgttgcgcatgcagtgaccagaaaacatgcaccttgggtcgctgtaatgacttatcgccgcccttcaccaccaacgcgatgcggcctgatgccaggcggaccagcgaaccgacaggatacagaccgatggtactgacaaaagcgtgcagtaaggtggtgtcaaaatgcccctgccagctcaacatcatctgcagcgttttggcgggcgtccagcctttacggtagggccgcgttgaggtcagcgcatcataaacgtcgcagatggtcgtcatgcgggaatacacgctaatctcatggcccttcaggccatagggatagccagtgccgtcatatttttcatgatgatgcagcgctatatcgaccagatcgtcgcccgcatgggcatccatcagcatctgcgcaccggcaatcggatgttcacacatcacctgaaactcatcgtcgctgagcttatcgggtttattgagaatagagagcggcaccgccgccttacccaaatcatgcagtaatccgcccatgccgacccgttgcagttgctgagcatccagccccagctttttaccaaaggcgatcatgagcccacataccgccatagagtgcagataggtgtaattgtcatgatctttaagctgcgccacacgtaacagcgccgaaggctcacgttcgatggaaccggcaatctgatcgacaatcgcaatcatatcgctgagattcaggccatagcccaggcgtgcctcgttgaacatggccagcacctttggcttgccctgttcaaagatatgctgtgcctgctccatttcctgagagaacggcgcgcggatgcctgaatcgacttttttcggcgcagatggtgtcaatgaaatcgatttctccatatcgatccataaacgcgcgatgccttcatgacgaaacatcaaaacctgacgttgatcggtgatcaacatctggttgcgaatgcgtttgtctttaaaccaccagacttcgagtttgtggacgaacatacccggtttcagttcgtcgattgttatgagtttaatcacaatctccctccagagtatcagcgggtgatatcgtgatatcggcaggcacgcggttttatgcaggtcattttgtgcgaactgtggtgcagcacaaattttagacgccagagagagagttttcccgttcaccggtaaaagaaaacgggcgtggttacgctttctcagtgagcaatattgccatcatcaccacatcgtgaagtttaccttcacgcagcgatgcctgacgacggacgccctcacgctcaaagcccagtcgttcatagagcgctaacgcccgatgattatcgtggaacacttccagctccatgcgggtgatgcccagccagttacgggcataatccatggcgttacgaattaaatgcgcgccgatgccgcgaccggaaaaggcaggattgacgccaataccgaaactgatgcagtgccgggtacgcggattatgattagtgaacagcgtgagttcgcccaccatttcaccgtcaacttcggcgataaaattgataaagccttccgcatccatctttgcaaacttcttctcccaggtggctacgctgggaaaaggcaactgtagcgtccagggataaacgtccggatgaccgtaaagacgttgataagccgccgcatcgtgcggctcacggccgcgcagagtgatatccatatttaatcctttttaatcgggcatacacatgcactaagctgtaactcttatcgaacggaaagagtgactctatgttgtatcgtcgtttcgaacgttttatcaatatttttcaggatgcaccgaccgacatgccgccctcgcgggtttggccgttttatttttactatctgcgccaggtatggccgagctttgccgcgttgctggtggtgggattaatcggcgcgctgattgaggtagcgctgttcagttatctgagccgcattattgatttggtgaaccactctacgccggccacgttgttccgggataactggcaaacgttgttgtggatgggctgtgttgcgctgatactgcggccggtttttattgcgctgcacgatatgctggttcatcagagcatcaaccccggcatgaccagtatgatccgctggcagcatcataattatgtcctgcggcagagcatgaacttttttcagaacgactttgccgggcggattgcgcaacgtattttgcaaaccggtaactcgctgcgcgactctgcggtgcaactggtggatgcgatctggcatgtgctgatctatgccgcaacggcgctggtactgtttgcagaagccgactggcgcctgatgattccattgattatctggattgtggcctacgttgccgcgctgcgctatttcgtgccacgggttaaatcccgttcggtggtgtcgtcagaggcccgctcgaagctgatgggcaccattgttgacggctataccaacatcgccaccattaagctgttcgcgcacagcgatctggaacgtcagtacgcccgcgaagcgattcaggagcagacggataagacgcagcaggctaaccggatggtgaccagcatggatctgacgctgtcgacgctgaacgggatgttgattgtctcaacctctggcctggcactgtggctgtggagcgaatcgctgattagcgtaggggcgattgccctggcaaccggccttgtgatccgcctggtcaacatgtccggctgggtgatgtgggtcgtcaacggtatttttgaaaacatcggcatggtgcaggacggactcaacaccatttcacagccgctcagcgtgcaggacgctcccaaagcaacccagctaaaggtggcgcaaggtgagattcgttttcaggacatccgttttgactacggtgggggccgtccggtcattgatggcctgaatctgaccatcaaacccggtgaaaagattggcctgattgggccttccggtgcgggtaaatccaccctggtgaacctgttgctgcgcctgtacgacctcaacggcggtcgtatcctgattgacggtcagaatattgctgaggtgacgcaggagagcctgcgcagccagatcgggatgatcacccaggatacctcactgctgcaccgttccatccgcgaaaacctgctgtacggacgaccaaatgccagtgaagaggcgcttcagttagccatccagcgcgcccgcgccgatgagtttatcccgttgctgtccgattcacagggccgttttggcctggatgcccatgtgggcgaacgcggcgtgaaactgtcaggcggtcagcgccagcgcgtggccatcgcccgtgtgctgctgaaagatgcgccgatcctgattatggatgaagcgacgtccgcgctcgactcggaagtggaagccgcgattcaggaaagcctggaatccttgatgaagggtaaaaccgtgattgccattgctcaccgtctgtccaccatcgccaaaatggatcgtctggtggtgctggaaaaaggccagattgtggaaatcggtagccatcatgagctactggcacaaaacggcctttatgcccgtctgtggcagcaccagacggggggatttgtgggcgcagattaatcgccgcgtcgatagggcaaggcgtcacgggcttcatcggcccacaggtggacgccttgccgctcctgctgcaaaaaatcctctacggcggcgcgcaggccgggatggcacagatagtgccaggagtgggtaatctgaggctcaaaaccccgcaccagcttgtgctcgccctgcgcgccagcatcaaagcgttgcagcccttccgctatggcgaaatccatcccctgataaaagcaggtttcaaagtggagccggtcaaattccgccaggcatccccagtagcggccatacaggctttcgccatctttaagatagaaggccatcgccgcaggttgctgctgtaaacgggcgatcacgacgcgaatattgtccggcatcctctcagccagcaggctgaagaaggcacgggtcagatagggacgctgaccgcgcaccgcatacgtattggcatagcaggtatagacaaaatcccactgatcctcacgcagttgatcgccgcgataccagtcaaatgcaaaaccgctctgtacgacctgctcgcgctctttacgcaactgtttgcgtttacgcgacatcagcgtatccagaaagtcctgaaagtcgcgatagccccgattgtgccagtgatactggcagcccagtcgtgccagccagtcaggttgcgccgccagcaaggcgttcgcttgcggatcggtgaagttgatatgcgcaccatttaacccctgctccgccagcgcgtccggtaacgcagcaagaagccgggcggcggcgtccggtgcaccaagcacgcgtgcgccagtaaccgggctgaaaggaatcgcgcccagccattttgggtagtaaggaatgccggcacgctggcaggcatcggcccaggcgtgatcgaacacgtattcaccctgagaatggaatttttgatagccgggaagagcggcgcgaagctcgcctgcctcacgccagaggagatgatcggactgccagcccctttctggcctgacgctgccgctttcctccaggctcagtaaaaatgcgtgacgtaaaaagggctgttgatcggtcaacagggcatcccattcagcggcaggaatgtctgaaagcgaactcaggtgaaacaacgacatgcataactccagacggcaaccggtgacacagtagtcaagcaggttttaggtttcagggaaagaaggagggcacggaatgcttcatgcagaccctgctcaggcgcacgcgctacctgaagcgtagtttggttttgacgttaatcccgtcacctgttcaaatgcctgcagaatctgacaaaaaacagcgaaggaacgggcatggctaaagcattggtgatctttctacacggcgtgggcagtaacggagacgatctggccccgattggcgactactggaccaccctgctcccggatgtcgcctttgcgtcaccggatgcgccttacgcctttgaacatggcgcgggctatcagtggttcagcctggccgatattacgccagaaaatcgtccgggtcgggtgcgtgaggcccgcgaggcctttgacagcgttatccgtcatctgatgtctcagaacgggatggcagaccgctgggaaaacgtcatcctggtgggcttttcccaggggtcaattatggcgctggacctgctggcttccgggcgttatcccctggcgggcgtggtggcgttttcggggcgactggcctttgacggcccgatcacgccacaggctcacacgccagccctgttgattcacggccgggctgatacggtgataccggccagtgaaagtgagtcggcggcgactcgcctgaaagcggtgggcgtcccggtcgaagcggtgtttgaacctcagaccggccacaccatctcagcccagggtgcaatgcatgccgccgggtttattgcccagtgcttacaggactaaacacgctttcaccaccgcaggcaggccggtttcgccgctgcgttagcccaacaggttaacgagcgcgaaaccggcaaagcacatcagcaatgagccaatgacatggaccagtgcactgctcattgcccacaggtatttgccagactgcaacaatgtcattaactccgccgaaaacgtcgagaacgtggtgagtccgccacataagccggtggtaattaataatttccaggccgggtcgagctggggatgcctgacgaaccaggccatggcaccgccaatcacaaatccaccaatcaggttcactaacagcgtgcccggcggcagattgggaaataacgcgttaaaccgcatggcgaaccaccagcgcaacacacagccaatactgccgcccagaatcacagcgaatagcggttttaacatcacagactccatttcaggattggcgcagaagacggtggagggcaagaaaaaagcatacacctgacacaccgactcccgcgaaaggattaaggataatgtcaggcgtcatcagccgcaggttacgcctgcaggcggttgggaaaggtggaacgccatcaccttatgcgggccatcatacgatgcctttttctggctggcaaccgtggttgagcggagagaatcgttacgtgaactgacgtcagcgcagcaccttgtgccgccgcaaagcagaaggtccaggcgggcatgattcaggtttccccggttgccgttttgcgcttaaatgtttatccggcagcggcgttgtagagccgttgaatgcctttcgccagcggcgaaggggtaaactctcttctggagcgtcctgtgcgaactgtcatttttgatactgatatcggtgtagacgatgcctttgccctggcttatgccgcccgcacccaacatttgctgggcataaccaccgtgtttggcaacgttgccgtcggacaggccgtgagaaacgccaggctgttttgccagaaaatggcgattgatgtgccggtttaccgtggctgttcccgtccactggcccaggcacccagtgcgcccgcccgactgcacggcgaagatggcctgggcgatgcctttgataatcccttcagcgacgaggcacccggtgcggtgcagtttattatcgacagcgtgcgggccaacccaggtgcggtcacccttgtcgccattggtccgctgaccaatatcgccagcgcaatcaatcaggcacccgatatcattccgttggtaaaagagttagtcgtgatgggcggcgcatttggcacggacgggcactgcggaaatgtgacgccctttagcgaatttaatatctggaaagatccgcacgccgccgatcaggttctttcctccgccttaccgatcgtggtgatcccgcttgatgtgacccataaagtattgatccacagtgaagaggtggatcggcttaatcagccggtgctgcgtgccatctgtcgcccttatctggcctacagtcttgagaaagaaggattttctggcatggcgctgcacgacacgctgaccctctcctggctctgcctgccagacgcgttcacgctggtggaaagcccgcttcgggtcattacggaaggcattgcccgcggtcagacggtgcgtcaacagagtacgctggcttcccggcataatcccttccgcgatcttccccggcagcgcatcgcattaggcgtcgacgcggaggcggtgcgacaacacttttttcaggcactcagtcgataaacctggcggccaccgttagcgatcaaaatcgataacgcctttaatcaactcacgattgttaatgaccgcttcctcaaactgctctgccagcgtcgagaaggcgaaacgccggttgagcatcatttctgcacgcagtttccctgcggccatgagttcacgcacccggtcaaaatcttcgcgcgtggcattccggctgcccattagcgtgctctcttttttgtggaattcgctgtcagggatgaccaaatcgcctttatgcaggcccacataaaccaccgtgccgccgtgacgaatcaggctaaccgccgcgttcatcgctgccggattacctgtggcatcgatcacggttaacgccagttgcccgttaaacccggcacgcagtgcggcaataaaatcagcttccgccggattcagcgcaaggaggccgagctgctgactgacgtgctggcgacggtaatcactggtgtcggccacgatcacctgcgcgccattggctgcggcgatagccgctgcacccaggccaatgggaccggcgcccaccaccagcacctgatcgccctgtgccaccgctgcacgccgtaccgcatgggcgctgatcgcaaagggttcgatcaatgctgccgcctcgggtgccaactcatccaccgccagcaggtttgcggcgggcacgctgagatagtcgcaaaagccgccatcctgatgcacgccaatcaccgaaatgttttcacagcagttggttttaccgctttggcaggcatcgcactcatagcaggagaggtaaggaatcagcgccacccgctgaccgacggcaaaaccctgcacggcgctgcccgtttcaacaatgtctgcacagagttcatgcccgagtacgcgtggatagctaaaaaaaggttggtttcctgcccaggcgtggatatcggtgccgcaaatgccggcactgacgagtttaatcagcgcctccgcaggcgcaggacgggggacgtcgcgcgtggtccagaccatgttgcgtggttcggtgatgactactgctctcattgttgtcatggtaattctcccgttagcgttagcgttagcgttagcgttagcgttagcgcagttatggcgaatcttgccgcaataacggttttcctttgctcaatctgtgaagcgtgacggtttttttgggacttcaatggtttttaatgcttaaaaaaccggagccgctcatgagccgtagccagaatttacgccataacgtgattaaccatatgctggagagcattgcccagggccacatccagtcgccacttccgccccaggccgcgctggctgagatgttcaacatcagccgtaccacggtgcgccatgctttgcgctatctgcatgagcgtggcgttctggaaacagtgaatgagagctgggttatcgtacgcgagcctgaagcagaagacggcctcagcgccgttgcccccgccattgagcagcaggccagccaggtggaaaaacgcttttttgatatgatcaatcagcggctgctgcagcccggcgataccttcagtgaattacagctggccaggcaggccaacgtcagcccggtggcggttcgcgaattcctgctgcattttatgcgctataacctgctggagccggtaaaacgcggtcactggcagatgaaaaagttttcgcaagagtacgctgaaaagttatttgaactacgtgaaatgctggaaacccatgcgcttacccgcttcctgaatttgcccagggaggatgagcgctggattcaggcgcgagatctgctggatcggcatcgatcgatgcgcgaaaccatcgccagcaactatcgccattttgctgcactggataaagagctgcactggctgattctgtcggccgccaataaccccttctttaatcagtcgctggagattatttcggtgattttccattcgcattatcagtgggatgaaagcgatcttaagcagcgaaatatcgtcgcgctggaagagcatatggcgattctgtctgccttgattggccgccgggatgtggatgcgctgtgcgcgttgcataaccatctggcgaccgccaagcgttcaatggtgcggagcattaatcagtacaattaaaacccgattaaaaaccacaaagcattagctcccgcacgattttgaaacaactttacaacatctcgcttttattccccttactctcagcgcaacgcaccgacggccctgtgccgttgggcgacattgctactcatcataatgataaatcgcctgtccagggagattgccatggaacacagatcggttgttgatcacgcgaatccgcccgacacctcgcccggcgagacgtttgtgccgttgcgcagtgatatcgtgcgctcgccgcgcattcgtaaagtccagattaccgccatgctgctactgctgtttgctgccatcattaactacctggatcgcagctcactgtctgtggccaacatgactattcggggtgaaatgggactcagcgccaccgagatcggcgtgctgctgtcggcgttctcgctggcttatgggctggcgcagctgcccgcgggtgccctgctggatcgtaaagggccgcgcattatgctggccctgggaatgtttatctggtcgctgttccaggccgcgtccggtctggtgcataactttacccagtttgtgctggtgcgtattgggctgggcattggtgaagcccccatgaatccttgtggggtaaaggtcatcaacgactggtttaacattaaagatcgcggtatgccgatggggatgtttaacgccgcctccatgattggcttatccatcgcgccgcccatactggctgccatgatgctggttctgggctggcgtggcatgtttgttaccatcggtattctgggtgtgtttcttgccctcggctggtacctggtttatcgcgatcgcgataacaaacagctaagcgctgaagagatccactacctgcaggcaggcagcgtggcatcgcgtaaagagccgatcagttttcgcgaatggcgcggattgtttaaacaacgcaccatgtggggcatgatgattggcttcagcggtattaactataccgcctggctgtacattgcctggctgccgggctatctgcaatcgacctatcatcttgatttgaaaagcaccggtttactggcggcgattcctttcctgtttggtgctgcaggcatgttgctaaacggctatgtggttgatgcgctggtcagacgcggttgggatgcggtaaaaacccgtaaagcctgcattgtgagcggcatgatcctgtcggcaggttttaccgccatcgtgacgcgcgccaccgacaccaccagcgcagtgacgctgatcggtatggcgctgttttgtatccactttgccggtacctcctgctggggcttgatccatgccaacgtcaccgcccgcatgacggcgtccgtgggcagcattcaaaactttgccagctttatctttgcctcttttgcgccagttatcaccggttgggtgctggataccactaaatcattcagcctggcgctgatgatttgtgcctgtgtcaccctggtcggtgcgctggcgtacctgctgctggtgcgcaatcccattaccgacggcacctgattcaggtcagcgcctggagggtgacgccgtggcgcgcaccgtaacgctgaatccccgcaatcacgttatcgacactgagtggcggcgggacaggcagcagcggtgcgcgttcccggagcgccgaatcgaaccgtgaaaaggtggaaaaatcgtgagggaagcgcgtttcatctaccccgacgaatgccccctcttccctggcgaaggttaacagctgtttccagcgatcgatgtccgccaggccgatactgtcagtgccatgggaatagagcatcatgtcgatatggttaaaaggcggctgcttctcaagaaagcgttgcagtgcatccgccgacggcacggacggaaacatcagccagaagggaatcgcgtgctgctgcatgctgcaccaggggtccatcagtaaaaagctgtctaccgtcagccgggctggcagtatgcccgccgccagataccagtcacggtaaatttcggcgaccacaaagctcagcgcttccgggtcatcgtaacgaatctccatcagcgtccagcgctgggcttctgccagttttttcagcggagaaatcaggtagccgtccagcccccactctgcctcagggacatgatcggtgatggcaggtggctcccagcgcgcgcgatccacgcctgcccgcgccaggtattcggcgactctcggcccgccgcgcaaatactcgttttcggttgcaccgccgggtgcgccaaactggaaaaaagagcgatcactggtgcgcgttaccggccactgtcgcgtgcagtgattaatgaacagcgttgctcccgccggtaatccgcccagcagaaactcattgaaggccagcggcatgtcgcgcagcttaaggcggaagtcgtgcattttctccagcaggaggcgatcctgactcggatcttgcatgtgatgtaccgccagcttcggccaggtcgccagcagtgccgccgccacggccttaccttcctcgaatcctgactgggcatcatccgggtcgttctgctgcatgcgtaccggacacagaaaggtttgcggcagccacggcgttcccatcgccgcagccaggtgcaccagggcaccattggtggcacccacaaacgcagccggatagtcgcgttgaggataggtgctgaccatccattcggcgataccttctatatccagctcgctggcctgtttatgactgatgccctcggccagaccgctgaccgcatagccccactcacgcaaccgggtcggtaagcgatcaaacgaaggcaataagcggtctaacatcggtgactggctcgggctggcaaaaggccgatcgtgaagtgcattcgctaaggtcagcaacattgtggcggctgaatcaaaccgggcgatgcccttgggcggtttactcatgctggctctcctgctgaatacgcgctaaaaaaggccggatggcgtggcagaaactccacggataaacgtagtgcagtctgtgcgtcccgccgcgtaaggtgattttttcgctgtgcggtaacagccccgccagctcatccagccagcgcgccgggcagaccggatcgcgtgagcctctcagcagtaaggttggtgcagtgacataggtaagatggtgttcgatgggatcgttcagcatggctcgcatcgtgccaacggcgcgcggcaagccggctttggcccagtcgatccgggccagcgcgcccggcgagcgatgcgcttccatccggctgttacgccagcctcgccacatctgacgtaccaggctgcgcgcatggcgatcggcggtgggcccctgtagcaccagtcccgccaccgcttcagggtatttatccgccagcgccgccagtacctgacagccaaaagcgctgcccacccagattgctcgctgaaaaccgttgtgctgcaaccactgccacaggatatcggccagttcattaaccgacagaacaggggccgatgcgggcaatgcgctgccgccgaagcccggcaggtcgggaaccaggacgtgataatcccgtcccagcgccagtgcgagcggctccattgagcgccccgacatcaccaggccgtggattagtacaacaggcaagccgtggggttcctcaggcgtcacgcgggtaaacatgcgccagtcgccgatctgttgatagtaacccgctaatcctgcgtgatggctgcgtggtgaaacgggtggcgtttgcttcatttgctgccagcgtttcgtgccccatacgaccgccgcgacacctaaaccaatcccggcggctagcgccatgccctgccgctttttacactggatggtacgcctcatcagctgctcctgttcctgggtatccattgagtgtaggacgggaatcgcagagacaggcggttaatgcatgctgtcaggcaatggtgttacgcaggcgaccgattttttcgatctccacttcaatcacatcaccactaaacatgaacagcggcggcgtacgttttttgcccacgccgcccggtgaaccggtaatggtgaaccggtaataatgacatcccctggcgacagcggactaaaggcggaaatgtattcaataattttggcgaccggatgcaccatgttggcggtggtatcgttttgcacttcccgaccattcagcaccgttttaatggttaactgctgtgggtcaggaatgtcgtcggcggtggtcatccagggcccgaagcccccggtctgcggccagttcttgccagcggtaaaccaaataaactgcatagctgcattactgcctcgtcatggctacgggtgataaccctatgttttaaaagaaatcggtgcgcagcgtagcaaaaaacgcgataaaaatcgtacatcgattggcacagtggatatccagatgtatcacgttatgtcagcaggaagtgtgtggataaacgaaagctgaaaaagtcgccattacggcgctatgcaatcaaagcggggaagcgaaaacgggggtgataatcaccggtctgtccctgaccgcgactatcgagggtattcggtgggcgcttagttaagcgcgccgggcggtacgtgtttaaaggtttcaacataagcgtggaacacgtacttaaaaaaacgtttcatacatcatccggttaaaattttgttgaataactacaggaaaagtatagcgcctgctgttttaatcagcaataaattttgaaccagatcacaaaattcacgtttacacccgttactgaaacagggccaaatgctcaataaggatggttgaaccgatagcgatcaggaccagcccgcccaggacttcagcccatttgcctaaaaccggcccgatgaaacggccaatcagcacacccgtggtcgccattacggtggtggcggccccgatagtcagcgccgtggtgacgatattgacctgcagaaacgccagtccgacccctactgccagagcatcaaggctggtcgcgactgcggtggtggccagtaccataaagccatgactttgcggcgcttcgcacggctcggcggcggttttgcggaagccttccatcatcatacgcgcgcccaggaaggccagcaggaaaaaggcgatccagtgatcccatgcggcaacatactggctggcagccagacccagcgcccagccgataaggggcgtcagagcttcaatacaaccgaaaatcagaccggtccgcacggcttctttcaggccagggcgatgcaaggccgcacctttgcccagcgcggcggcaaatgcgtccattgacattccaagagcaagaataagggtggcaataaaggtcatgatttgttcacttgggatgaaaaagcacgacttcatgctgaatccatcacacaaattgctcggtaatttaaaaagtgcgcgcagtctaccacgcgattatcgttataaaaagacaataaaatcagggatttaagtatagccaaggctataactcataacatccgctatgaatgcagctaagttaatgtcatttaagccttttctgcgctgtttcgacataaccatgacaggcacagacatcccgtcattgaaccctggcacggaataccggaaaatatccggctgataaacagggaacactgctcatgaataaccctttcgaatccttaatccttcccggcggcattttgctgctgggctttctgtctgccctgctgctgcccgcaccggcttttagcctgacggtagcgcagcatttgcagcagatgttccatttgcaggatcttagccagctgtacaccctggtattttgcctgtggttcttgttactgggcgcgcttgagttctttgtgatccgctttgtctggcggcgctggttccgcgtgtgaagctgacgcatcccggcacatcggccagctgaacctgcgttctggggtttaaggccctgcgctgttttctcttctgaagaaaatctgaaagtgggatgaaaaccgcatgtcgttcacctcgggacgtaacggtatcgcggcgtcgaggccgcgtccttaggtcacaaaaatgtaacatttgttttacacagacaggcccgttttgcctgcaagtacaaattcatcgacaggaataaaattaaataaagtctatttttcattaatttaaattattccttccgccatgtgacattttcagcctgcaccattacaaagcaatcccgcaacatctcattttatttaacctgctaatctacaaggaaaaatcacttatggcggacttgccattatgattatttcttatgctgaatcatttctgcatttaaaaaataaacaaatgtttaaatcggatgcgagaatgttatatttgagcaacaaagcataacgttcagttaactcgttatcgtcgctttaacccatacctgagtcttaacccggaagtagcgcaacgcgctcatcagaagcgtgactatttcgcctgcaacactgttgagcttcaggtcaacagaagaggagatgtcgcctcatgtgcaaatcagctgtaaatcttgcgctcacaatgagtgttagcggaaaggacaccaccagggcgcaggagcgtaaagacgttgatgtactgcttattggcgcaggcgtcatgagtgctacgttaggaacctggcttcaggatcttgaaccagactggtccattgaaatggtggagcggttggggcatgtcgccgaagagtcctcaaatggctggaacaatgcaggtacaggccatgcggcgctggccgagttgaactatacgccgcagaaagccgatggcagtatcgatatcgcgaaagcggtggcgatcaatgagtcattccaaatctcccgtcagttctgggcttaccacgttcagaaaggcaatctgcacacaccaaaaagctttattcacagcacgccacatatgagctttgtctggggcgatgacaacgtggcgtttctgcgtaagcgctttaatgccttacagaaaagcacgctattccgtggcatggcttactctgaagatccgcagcaaatcgcgcagtggattccactggtgatgaaaggccgggccgacagtcaaaaagtggcggcgacctggacagacatgggcaccgacgtggattttggtgaagtgacgcgccagctgattagctcactggagaaaaaagccaacttccgtttgcgcatgaatcaggaagtccgcgaaatcactcgccttaacgatggtcgttggcaggtgacgcttgtctgcctgacggacgggacgcgccgcacgttgacggccggtaagatttttattggcgcaggcggggcggcgctgccgctgctgcagaaggccggtattccggaggccaacggttacgcgggcttcccggtcggcggttccttcctggtcaccgagaatcccgaggtcgtgaaacagcacatggcgaaggtgtacggcaaagccagcgtgggcgcaccaccgatgtctgtgcctcacgtcgatacgcgcgtgctgaacggcaagcaggttctgctgtttggtccttttgcgaccttctcgaccaaattcctgaagcagggctcgctgctggatatgtttgcctcgctcaacagcaccaacgtgatgccgatgattaaagtcgggctgaaaagctttgacctggtgaaatatctgatggatcaggtactgcaaagtgaccgtgatcgtatggatgcgctacgtgcttatgtgccgcaggcgaaacaggaagactggcgcctggtgacggccggacagcgcgtacagatcatcaagaaagatgagaaagaaggcgcggtgctgcgtttaggtacggaagtggtgtcatccgaagacggctcagtctctgcgttgctgggtgcttcgccaggtgcctccactgcggcacctattatgctggagttgctgcataaggtgtatccagagcagatggcttcgccggagtggcaaaataaaattcgtgccgtggtgccgtcctggggacgcaggctgaatggtgatgtggccctgaccgaaaaagtgctggcagaaaccagccgcatcctgcagcttgagtacacgccggttacgccagtggccgcaaacgatgagggccgtgaaaccgcctttgttatcggcaaataagccgcccttgatacagaaggcctcgcactgcgaggcctttttgtttaccgcttgcctggttgactgccacattctctattagggttaaatctgccttaatgcaggaggacatgtcatggcccaaccgaacactgaacacgaactcgccttgcttgaccgctactggcgcgccgctaactatttgtctgtcgggcagatttatttaatggataatccattattacgcgagccgttaacaccacagcatattaaaccgcgtttactggggcactggggcacaacgcccgggcttaattttatctatgcccatttaaaccgcatcattcgtcagcgcgatctaaacctgatctatatctgtggccccggtcatggcggtccgggcatggtggcgaacacctggctcgaaggcagctacagcgaaatctatccgcatatcagtcaggatgccgcgggcatgcagaaactgtttaaacagttttcctttccgggtggcatccccagccatgccgcgccagaaaccccgggctcgattaatgaagggggtgaactgggctactccctgtcacatgcgtttggtgcagtctttgatcatcccgatctgattgcgccctgcgtgattggcgacggcgaagcagagaccggtccgctggcttccagctggcacggtattaaatttctgaacccgcaacgggacggcgccgtgctgccaatcttacacctgaatggctataagattgccaacccgaccattctgggccgcgccagtgacgacgacctacgccagctgtttcggggctacggctatgagcccctgtttgtctgcggtcatgaacccgagacaatgcacaagctgatggccgacacgctggatcgcgcattttctgagattgcggcgtttcaacaggcggcacgcagcggttcgccgacgcaggcgattccccactggccgatgattattctgcgcagtcccaaaggctggaccggccccaaaacggtcgacggcaagaaggtggaagatttctggcgggcacatcaggtgccggttgccgcctgtcgggaagatgacggtcatcgggacatcctggaaaactggatgcgcagctatcacccggaagacctgtttgacgaacagggacgcctgatgccggaactgcaggcgctggcccctcagggtgaaaaacgcatgggcgcgtccccgttcgcaaacggcggcttactgcgccgtgagcttgccacgcccgacattcgcgaatttgccttcgacacgcagcagcccggctcacaggcaggacaggcaggacaggcgacagaacagtttggccgctaccttaacgtcatattccagcgcaaccaggataattttcggctgtttggcccggatgaaacggcctctaaccggctgacaccggtctttgagaccaccagccgcacctggctcgaaaccattgagccttacgacgagcagttagctgctgatgggcgagtgatggagattctgagtgagcatcagtgtcagggctggctggaaggctatctgcttacgggcaggcacggtttatttaactgctacgaggcctttatccacattattgactccatgttcaaccagcatgccaaatggttgaaggtgacgcgcaaactgggctggcgtaagcccatttcttcccttaactatctgctctcttcccatgtctggcgtcaggatcacaatggttacagccatcaggacccggggtttattgaccacgttgccaataaaaaagccgatattgtgcgtatctacctgccacccgatgccaacaccttgctgtgggtgggcgatcactgcctgcgcacctgggaccgcatcaacgtgattgtggcaggcaagcagccttcgcctcagtggctggatatggacagcgccatcacccattgtgaggccgggatgggtgaatggcgctgggccggaacaacccccgagaacgcagagccggatgtggtcatggcctgtgcgggcgatgtccccaccatggaaaccctggcggcggtagatttactgcgcaccttcctgcctgacctgcgcattcgggtggtaaacgtggtggacctgctggcactgcaaacccagaaacaacatccgcacggtaagtcagaagaggacttcgacgcactgtttaccgccgacaagcccgtgatttttgcctttcacggttaccccagcttgattcatcgcctgacctgtcagcgcaataaccatcgtaatttccatgtgcatggctttaatgaagagggcacgacgaccacacctttcgatatgacggtgcttaacgagctggatcgctatcatcttgcccaagccgctattcgtcacgtcccggggcttgccgaacgtcaccctgagctgctcgacgacctggagcagcgactcgccgggcatcatcgctacgtgcggattcatggcgaagatgtcccggaagtacagaactggaagtggccctcagcgaccgcgtcaggcgcaccggattaaaaggtcctgaaggcatcaaccaacatccagatcgtggttgccaccagcgacagtgccatcaggctgttaaacaactgacgtttccagtgaatttgcaggtgaccgcgcaggcggtcacccagtgcggcccataataaaatgcacggcagattcagcagcatgaaagcgcccatcacggtcagcacgccactgctggcgctgtacagcagtgccacgttgctggccattaaccaggctttgggattgatagcctgaaaacaggcaccgcccactaaggtcatgggctgcggctttacccgggcttcgggtgcattcgcccggaatattttccaggagagccatagcagataaccacatcccaccagcgtcagcggcaaacgcacagaggccatccagtgcagcagaagttccagcgccagccctgcaatcgcggtttgcagcgcacagccgatcagaatgccaaacaccatcggtagcgtacggcgcataccaaaattgacacccgacgtggcaagcaacaggttattcggccccggtgtaatcgacatcacggtgacataactgaagaatgagggatcgagcatagtggcgttcctgataatcgagagaaccctcatgctacgatgagaaaagttatggtaacagagacaagaaatcgctattttgatgggtacaatcacaactgatttcaactgtacctgtcgcgcccggaggcaattgtgtcccctgaaaccccatccgatcaaacgctctaccagcagttggccgacagctttgccgaggcgattcataaaggcacattaaaaccgggaaagcgtttgcccgccatccggcgcgtcgcacagtcacatcaggtgagcgtgaataccgtactgaatgcctggcaactgctggaaaaccgtgggctgattgaggcgcgcccgcaatcgggctactacgtgcgcggcgtgctgccgatggtgacgcgaaatgcacagcactctgcccgggtggtccgcgatcccagtaatgaaaagctggatttgattgataaggtgttcgccgcgcaaaatcaccctgattacaccaatatatcgctggcctgcccgcaggacagcgatctgtttccgtcagccagactggcgcgcattacggcatctttactgcggcgtgatccacaccttattggacgctacgcgcttccgcccggtagtgagcgcttacgggaggagattgcgcgtcgtgcattgcatgccgggcaatcgcttaccgccgacgatatcaccctcacccatggctgtatggaagcgctacaactggcactcagggcggtaacgaagccaggcgattgcgtcggactggaatcccctacctatttctttctgtttcccctgctggcgtccctgggtctgaaggcgctggaaattcctaccgatccccagcgcggtctgtcactggacgcgcttgagatgctgcttcaggaaaaccgtcttcaggcgctggtcgccatgccttcggcgcaaaatccgctgggattttgtatgtcattgcccaacaagaaaaggctcgcgaagttagtgaatacttaccaagtaccactgattgaagacggtctttatgatgagttgcagtttgactggccgctctctcctgcagttaagtcgttcgatcagcatggctgggtgctctactgcaccagctttaccaaaaccgtggcgcccgattttcgcgtcggctggattgcagccggacgctttcacgatgccattgcacgcctgaaagccgtgtcatcgatggcggaatcggcgctgctgtcggaaacgctggcggagttccttgccaacgggggctatgaccatcatctgcgcagcctgcgccgcagctatgccagcaatctggatgaggcgcgcggcttgattgcgcagcatttccctcagggcacccaggccacattaccgcgcggtggctttgtattttgggtcgaactgcccggcaaggtggatacgacggagatgttttcccgtctgttgaaagagcagatttgcgttacgcccggcgcgctgtattcgctgagcgagcgctataaccatgcattgcgcctttcatgctgttatccgtttgatcagcgctacgttcgcgccatcatccgggccggaaaggtggcctgcgaactcgcgggcctgccgccgggtcaggatcagggcgtgccgttacgtccccagatggtatagccatggcgctcggtcaggcgttcgtaataggtgcgcacggcaggcaggtctggatgatcaagcggcgtttcgaaccagcggttgacggccagaccaatcggtatatccgccagactgaagttccgtccggcaacatagcgaccggtatgttcgagctgctgattgagaatacccatggtgtgggaccagcctttgcaggcagcggccaacagccttgggtcctgatgggccggtgaattgcgcaccagcgacatgaacgcatagcgccatgaggtgttaagttctgtcgattgccagtccatccactgatccactggcgcacgtgaacgcggattgtcgggatagagccagtcgccaccgtaggcggtcgccagatagcgcaggatggcattggattcccacataatcaggtcttgatcaatcaataccgggatcatggcattgggattcagcgcgataaattcgggagagtgcgtggatttgtacccttccccccactcttcacgttcgtagagcaggtccagttcgtcacacagccagagtactttgcgcacgttgattgaggaggcgcgtccaagaatttttaacatagcaggctccatccagttgcttaacttattcatagccctgttaactgacataagcaattgcccgggcaagaaaaaacatctttaccttattcaaaaggagtgacaatgaacgttgcgtttaaacaagtggatgtgtttacctcgaccgcgtttaacggtaatccactggcggtcatcatggatgcacaaggcctggacgacagccagatggcggccatcgcacgctggaccaacttatcggaaaccacctttgtcctgccgccgcaggataatcaggctgattaccgcgtgcgtatcttcaccgttgagggcgagctgccttttgccggtcatcccacgctcggtaccgctcatgctttactggaagcgggcttccagacaaaaacgccgggggtgattattcaggaatgcggcgtgggcaacgtgaagataaaaattgccgacgataccaccctggcctttgccgccccgacggccaccttaacgcctttccatgatgcactcattagtgcggcactcaacagtaacgccgtcgatacagcccaggaggccgtcgtggttgatatgggcattcgctggctgctgatccccatggtcagtgcagaggcagtcctgtcgattacgcctgatattgccgatttgcagcgactcatccatcacgctaacgtgagcggcatcatgccatttggtccgctgcctgcaggggaagctgagcactatgaggttcgtggtttgctgattgagcacggaagcctgaccgaagacccgatcaccggcagcgccaatgcctgcctggcacgctacttcgctgctcagggcaagacgcaagattaccgcgtccgtcagggcacccgggtaaaccgagagggacgcgtgacggtggaatatcagggcgatacgatctggatcggtggcaaaaccgtgacggtgatagaaggcacgattcagttgtaactacacattcgtagagggtggcattgggcggcagttgatcgtcgccccctgctttgaataaattttattaaggcacattcaggagtaaaaatcatttcttctctgtttgacgtcctcatagactttttgagcaacatgatcattttctttataagcaatatcctggatgtctatcgttacacttccatccaggcctgggatgcttttcaagtactccagcaaatccgagtgttctaattcgcttatcaggggttttagataattgtctaaggggctatgctgaggctcattcagttcagaggtaagcgcattcaaataatcgtttttatttgtcgcatgccatttaataaggaatccagcacggcggcacaattccgtatgaattaacaacatcgtacggccgttaccgtcaagaaaaggatgaccccaagcaaaaatacccatgaccttccccggttgctgacgaagtagcgcaggcttattagcaatagataatccccattctaccgctttttggcataattcagatgcttcaaattgtacaaccttgcccttgcttatcagacgtcctacgccgagtcttaaccgatctttacctgcccatgggtaaaaatcgccaaaaagaatatggtgaacatgcaaaaaatcctgataagtaatcagtcttttttttgactgcagatagcgcattgcatcttcaatatttgcttcaaaaaaaatatgctcctgacgtttaagaatgtctatatctttaatgcgttcgacattacgaagataacctgccgtttcgaagtcaccaaaaggatcaaacatattattcttccttgagataatttgtcaaaagacgagccatctgtggccccgttatgtaattattctttttcaaactaactagagtcttttccataacatccagctttatatcatctcctgcgagtctggtaatagtttcagcaaaaccatctaatccactactgataggtttaatatgatatttgacggcaagcttttcaataaaatgcttaacattgaccgtagggagtagatcaacatccacacttaaaagcacctcatcataaagctttctagatcgatcctgactcgttttcttatattttacaggtattccatcaacctctatttttcgtgaaacattattcaaaaccggattaaccaaaaagaaacgctcaccactttgtttttttatttgaatgtcactaacaggaatactgagcttcttaaatatggtattcaacaactcaataaggcgattgctatcattttttttaagtgcattctttttagcataaatgcctttccctggacgatgtaaaacatccattctcaccaattcattcaagaacttatttacttgtgaatgtccgccaagggtagaaaactcatcacgtaaaaaaacatcatcgggcgacctgtcaattttttgaatgatacgatctctaatgttcatacatccccctgatagcatcactagtttaatattatattacgtattcctttttcactcaagatttagcttaaaaggtaaacaaaggaatacgtttgacttatattattaatcaatggcttaaaatgaatacaatggccttgataaagtgggtttatcgattttcatacttcaaccttatgctcaggcatcaaatacttttttcacagcgcctgaccgcccgatgcttcgatacgctgcgcggtgatccagccggtttcatcactgagaatggcacaaacggcatcgccgatatcgtcaggcagaccaacccggcccagggcggtaaaggccgcgatggtgtcattaacggctttatcatcgcgcacgcgcccaccgccaaaatcggtctcaatggcgcccggagccagaatattcacgcgaatgcgtcgctcgcccaactctttggcctgatagcgagtgagcacttccatcgcacctttcatcgacgcataggttcctgagccgggataagtcaggcgcgttaatccgctggagatattcagaatgcgcccgccgtctgcgatcgctggcaacagtttctgggtcaggaagtaaggccccttgaaatgcacattcatcagcgcatcaaattcagactcggtggtttcactaaaaagtttatagtgaccctgtccggcattgttcactaaataatcaaacgtctcacgctgccagtgctgctgcagtgcatttttcacctcagaaatgaaacgatcaaactggctcaggtcgcccacatccagctgtagcgccaccgcgcggccgcctgcgcgttcaatttccctgatcacgtcctgcgcttcatgttgatgagtgcggtaagtaaaaataatatcccggcctttagctgccagttttaccgctgcattccggcctaaaccgcgattagcccccgtaatcaagacgattttacgactcatgttggtttcctgttgcaaaattgaacacaggttgaggatattcgttaataattgttctataaacgcctgagaacgtgcagcactgttccacttacaacaacaatcggcaggccatatggataaaattcacgcaatgcaggttttcgtcagagttgcagagatgggcagttttactgcagcagcagaaagtcttgggctcccgaagggaagcgtatcgcggcaaattcaggcgctggaaaatcagatgggcacgcgcctgcttcaccgaaccacccggcgggtgcagctgactcaggatggtttagtgtattacgaccgctgtcttgatttgctggcgatgattggtgatatggacagcctgttccagcacgatcccgccaccttaagcggcaagctgcgggtggatatgtccacagcgatggcgaccgaccttatcctgccccgcctgccggaatttcttcagcactatcccggcgtagaaattgaactcagcagcaacgatcgccaggtggacgttatccgcgaagggtttgactgtgtgattcgcgttggcgagctgaaagattcggggcttatcgcccgccgaatcggtacacataccttgattaactgcgccagccctggctacctttcgcgttttggccggccgattcggcttgaagagctgtcgcagcatgccatggtgcattacagccagcagcttggtcagcctgctcagggctttgaatacttcgatgggaagcagtgccactacgtgcacaccggcggtgtcgtcaccgttaacagcaccgaaacctatcgcgcggcctgcctcgcagggctgggcattattcaggtgccgaccgtgggtattcataaatatctggaaagcggtgagttggtggaggtgcttcatgccttcccggccaggccgatgccgattcatttactttatccccatcgtcgtaatgtggcacggcgcgttcgggtatttatggagtggttaagtcaggtgcttcaagagtatgtcacctgacaggctataatgtgttttttacgtttaacaggaagtgaatgtctatgacagacgagcaggataacgcaaaagacgcaaagtcccccaaacccctgatcgacatcaaaacgggcaacaagtccgtcgatcgttccatcgtgcgcgtttcacgttttgccacctggtttcaggcgatacccgctgtggcccattttatccgcgcacttgagcggtttaacgatcgtctcggcagccagtttggcgctgccattacctatttttcttttttatcgttaatcccgattttaatggtgtcttttgcagccgtgggttttgtgctggcatcgaatcaggatctgctgaccgatatcatcaacaaaatcgtcagcagcatcagcgatcctgccctggcaacgacgctgaaaaatacggtgaatacggctatccagcagcgtgctaccgtcggtatcaccggtttgctgctggcgctttattcgggactgaactggatgggcaatttgcgagaggccattcgcgcccagtcgcgtgatgtctgggagcgacagcccgacgatcaagaaaagttctggaaacgctacattcgcgacttcttatccctgaccggcctgatgctggcgctggtgattaccttgtcactgacctctgtcgcgggctccgcccaggccatgattgtgagtgcgttagggctggatggcattgagtggttacgtcctgcgctcaccattattgcgacctccatttctgtcatggcgaactatctgttgttcctgtggattttctggattctgcctcgccataaaccccgtaagaaggcgctgctacgcggtaccctgctggcggcagtgggttttgaagtgattaaatttgtgatgacgctgaccttgccaaaactggccagctcgccgtcgggcgctgcgtttggatcggtgctggggttaatggctttcttttatttctttgcgcgcctgacgctgttttgcgctgcgtggatcgccaccgcgaagtacaaagacgatccgcgcatgtcggaaaaaggttctctgaccaccagcaaataaaatcacggcgctaaaccagcgaaaaacaccgccctccggttatttattcgtcaatttacaggatgaataactggggggtcacttttcttcagcgctttctcagagtatctcgccatttttgcgccacttcacgctgccattccccaacatttaacacatgacaaaaattttccacttttgacggcgcaacaccactgaccacgcggttttcagccattgaatgccgttatacaggtgcgtaagattccctatctgtcattaaaaataagaaacatttatgcaagcctctgtctctgaaccgcttgatcagcaaaacgatcccacgccagtcaactcacgaagtaaagtggtggtcgcctcgctggtcggcaccgctatcgaattcttcgatttctatatttatgccacggctgccgtgatcgtttttcctcatatcttctttcctcagggtgatgccaccgttgccacactccagtcgctggccacctttgctatcgcgttcatcgcacgcccaatcggctctgccctgtttggtcactttggcgatcgcgtaggccgcaaagctacgttagttgcctcactgctgaccatgggcatctctaccgtggtcatcggtttgttgcccagctaccagagcattggcgtactggcaccgctgctgttggcgctggcgcgctttggtcagggtttaggtctgggcggtgaatggggcggtgcagccctgctggccaccgagaatgcccccgccaaaaagcgtgcgctatatggctccttcccgcagctcggtgcgcccatcggcttcttctttgccaatggcacctttctgttgctctcatggctgctgaccgacgagcagtttatgcagtggggctggcgcgtgccgtttgtcctgtctgccgtgctggtgttgattggtctgtatgtgcgcgtatcgctgcatgaaagcccggtgtttgccaaagtgcagaaagagaagaagcaggtgcgtgtcccgattgcttcgctcctgagtaaacatctgacggcaacgatacttggcaccttcatcatgcttgccacctatacgctgttttacatcatgaccgtgtactccatgagttacggtaccgccgccgcgcctgccggcctggggatctcacgtaacagtatgctgtggatgctgatgatggcggtcattgggtttggcgtgatggtgccgattgcgggcttgctggccgatcgctttggtcgtcgtaagaccatgatcgtcattacgctgatgattattggcttttcgtttctgttcccggtgatgttgggatcgggctcacaggcgctggtgatggctttcctgctgctgggcttgagcattatgggactgacctttggcccgatgggggcgctgctgcctgagctgttcccgacagaagtgcgttataccggtgcatccttctcttataacctgtcgtcgattctgggcgcctcggttgcgccttatatcgccacctggctgaatgcgcattacggcttgtatgccgtcggtttgtatctggcctcgatggcgtttctgacgctgctggcgctgattgcctgcaaagaaacgcggcatcaaacgctgtatgaagtgtaaattccgccagcattgattaaacccggcgcaggccgggtttttttatgggtttcaggtcacgctatttcgctttcagccaggccacaaaatcgtcgataaacacacgggtttttagcggcagcagacggttaggtaaggtgatggcgtaggtggtcattgagagcgtattttcaatccgccagtccggtaacacgcgacgtaactgcccattgagcaaatagccattcgcgataaaggtggggattaacgcaatgcccacgccctgcaatatcgcatcgatcatggcatcgctgttgtttatcatcagccggggcgtaagcatgacgctctccagcgtgtcgtttaaccagaaacgccattccccgcgaaactgtgcgtcgtctgggaagaaaatattatgctgtttgagctcgcccggcatatccggcagtttctgatcatagtgctcggcacacactaaaacataatcaacaggcattaatgcacgcgccaccatattaacaggtggtgtgtccgttacgcgcagtgccaggtcgtacgactcgtgtgtcaggttaaccagatggtcagtcagatttaattcaatattgatttcagcatagcgccgcagaaagccgggcagaaaaggagtcagtaaaattttcccaagcgttgtgggcgcggtaatacgcagcaatcctttaggcgcgtcactgtaactgtctgcctgggaaaacagggatttagttgcggcgataactgataaagcctggtgatatatttcttgtcccgcctcggtcacagcgagcgcgcgcgtcgagcgggtaaagagtaagacatttaaccttttttccagcctgtctatcatacggctcactgaagatggcgtcatggacagcgctcttgcagccgaagaaaaactccccctgtcgactacctgaacaaagaccaccagccccgggagaacgtctgttaattcatttatgttcttcacgcacaactcttttgcgcctgttacgtctagccaggctagcactgtaaagtatgatattcaattattcgatgccattacggcggcttcgcctctgcgcgacaaaaccgtagtgatataagcaagtaagagcgtgtgcttctggttcaatggtatgcgcgaatgcgattagggagtgcgacagcggtggacaagtctgattttagtttaaagcgttttatattttctcgcttcaccggtgcgttgtgcgatcagtttttattgtttgctgtgcctttggcgattttgaaaaccaccggttcgctaacgctttcttctctggcgtttgtggtcgagtggattccccgcgtcctgtttttccctctctcaggttttctggccgatcgactgaaaccgcgctttatcttttttaacgtcgatattgcccgtatggcattgatgattttggcttttatgcttttagcggtttttccagactctacctttgccatcctggccggtatgatgagcttactgtctgtcgcttatgtattaagctttgtcgccgcagatgcgctgctgccgcggcatgtgtcagccgaggcgctacccaaagcccattccctgttacaggggatcgatcaggttacgatggtacttggtccggcgctggcggtcgctatctcggcctggggcggtattcgcggtattcttagtattgccgccgcgctgtttttcctgtcagccatcaacgttctttttttgaaaactcgtgatccccacgtaaccgataaactgcggttacgcaccttactgcaatcgaaccgcacagcgttaagggtgctcagagaaaataaaatcctgctgcatttgtgtgccctgacctgggttgtcaatctggtttacggttcggcactggtagtcagtgctgctgtcatccttaaagaatttcatcttgccgaccattactttggcgcgcttcaaaccgccgccgcgggggtgagtatcgtgatgtttttctttattccacgcttttcacaccgttttggtttatccgcactcggcaccttttcgttttgtgcgatgatcctttcgggtgccgttatgtcacagtcgatggattacgctatgtatctgattggttatgcgttattgatggcgttcgatggggcattcagcgtttatctgcgtacgttacgcagccagattattcccgaggcgcatttggggaaaacgctgggactgatcggcctcatgaatctgtgttccatacccgccagtggggcgttggtatcactgctgtccccacattttatgccgctggacattatcagcatcattctgctgttagcgttatgcacaggcgtgatgttaattatcgctgggcgacagtgcttcggttacaaaagcctgctgccgcctgtgattgcggcaggatcttcctgctaaatgaaaaagggcgcagccagatggctgcgcccttttcacgtctaacgttttgctgaaaacggtgtcgctctgatttagcccgcaaccgcgatacgtttcatatcggtcatgtagccacgcagtttgcggccaacctgctcgataggatgctgacgcacggcttcgttaacatcgcgcaactgggcgttatcaacctgagtgccttcaatcgctttgcccagatcgcctggctgcagcgtggtcatgaactctttcagcaatggcaccgccgcgaaggagaacaggtagttgccgtattcagcggtgtctgagattaccacgttcatttcgtacagacgcttacgcgcaatagtgttcgcaatcagcggcagctcgtgcagtgattcgtagtacgcggactcttcgatgatgcctgcatcaaccatggtttcaaacgccagctcaacgcccgcttttaccatcgcgaccataacaacacctttgtcatagtactcctgctcttcgattttgccgtcgaactgtggtgcggtttcaaacgcggttttgccggtctcttcgcgccaggtcagcagtttcttatcgtcgttagcccagtcagccatcatgccggaagagaactcgccagaaatgatgtcatccatatgtttctggaacagcggtgccatgatggttttcagctgttcagacagcgcgtaagcacgcagttttgccgggttagacagacgatccatcatcagtgtgataccaccaaacttcagggattcggtgatggtttcccagccaaactgaatcagtttttcggtgtacgccgcatcgtgcccttctgccaccagcttgtcgaagcacagcagagaaccggcctgcagcatgccacacaggatggtctgctcgcccatcaggtcagatttaacttcggcaacaaaggacgactccagcacgccagcacgatcgccgccagttgcagaagcccaggctttagcgatggccatgccctcgcctttaggatcgttttccgggtgaaccgcgatcagcgtagggacaccaaaaccgcgtttgtattcttcacgtacttcggtgcccggacacttcggtgcaaccatcacgacggtgatgtctttacgaatcgtttcgcccacttccacgatgttgaaaccgtgtgaatagcccagtgctgcgccatctttcatcagcggctgaacagcctgcacgaccgcagagtgctgtttgtccggcgtcaggttaaccaccagatcggcctgtggaatcagttcttcgtaagtaccaactttaaaaccattttctgttgctttacggaatgaggcacgtttttcagcaatggcttctgcacgcagcgtataggacacatccagacccgaatcgcgcatgttcaggccctggttcagaccctgagcaccgcagccaacgatgacaatcttcttgcctttcaggaagctggcaccgtccgcgaattcgtcacgtcccataaaacgacacttgcccagttgcgccaactggttgcgcagattcaatgtgttgaagtaattagccatgcgaactccggttaaatgttgtgtttgcttttgtttgatgacggcatcaggttcagcgccgcgaatgaccccatcatatgacaggatttctgttgcttaaattgatatattaacaacgttacattgcaataattgcaatgtcgtcctgaggtgagactcacatggatctacgcgatctcaaattgtttcttcatttggcagaaagctgccattttggccgcaccgcacgcgctatgcatgtcagtccttccacgctgtcgcgtcagatccaacggctggaagaagatgtcggtcacgccttgtttctgcgcgataaccgcactgtggcgctcaccgaagcgggcgaaagactcaaactgtttgcacaacaaaccttactgcagtatcagcaattgcgccatgccatggatctcaacggcccctcactcagtggtgaactacggctgttttgctcggtgactgccgcatacagccatcttccgcctattctggaccgttttcgcgccgaacatccgcaggttgaaatcaaactgaccaccggggatgcggcggatgcgattgaaacggtgcagtccggcaatgcggatctggctatcgccggccgccctgaatcgctgcctgccagcatagacttcaccacgctggggctgcttccgctgggcctgattgcgcctgcactgccgtgcccggtgcgcactcaggcaacagaagccgcacctgactggtcacagattccgtttattctgcccgagcaggggcccgttcgtcgggctattgatctgtggttccgtcgtcaccgcatcgtcaacccgttgatttacgctacggtagcgggccatgaagcgatcgtttcgatggtggcgctcggctgtggcattgccttgctgccggatgtggtgctggagaacagccctgagccagtacgaaaccgggtgctgcccctggaaaatgtggagtcggtcgcgccgctggagctgggcgtttgtgtacaaaaaaagcggctcggtgagccgctgattaatgcattctggcatctgctgtaattactgacccgccagaaaaaaacggaaagccgggttatgggtttcgtcatggaaatcataacccaggtcggtaaggtgctcttcaaaacgcggctcatcgttacccagctcaaatgccgttagcacccggccataatcggtgccgtggctacggtaatgaaacaacgagatattccagtgcgtacccagcgtttgcagaaatttgagtaacgcgccgggcgcttccgggaattcaaagctgaacaaacgctcacgcagcggcttggaaggacgcccaccgaccatgtaacgcacatgcagctttgccatttcatcatcagagagatcaaccacctgataaccgttttccgttaactggctgatgatctcagcgcgttcttccatcccacgagtcaggcgcacgccaacgaaaatgcaggccttatcggtatcggcatagcggtagttgaactcagtaatagagcgaccgcccagcgtctgacagaacttgaggaagctgccctgttgttccgggatggtgacggccagaagcgcttcgcgctgttctcccagttcgcagcgttcagatacgtagcgcaagccgtggaagttgacgttagcacctgacaagacgtgcgccagacgctcgcctttgatgtcatgctgctgaacgtatttcttcatgcccgccagcgccagcgcgcctgaaggctctgccacggcccgcacatcttcaaacaggtctttcattgccgcgcagatagcatcgctgtccacggtgacgatatcgtcaaggtattcctggcacagacggaaggtttcatcaccgatgcgttttaccgccacgccttcggcaaataatcccacgcgcggtaagtctaccggctcaccggcatccagcgccgccttcaggcaggctgaatcttcggactctacggcaatcactttaatttgcggcatcagctgcttgatgaggaccgccacgccggccgccagaccgccaccgcccaccgggacaaagacccgatcaagatgggcgtcctgctgcagcagctccattgccagcgtgccctgcccggcgataaccgccggatggtcaaagggtggcacaaaggtgtaaccctgttgcgacgctaactcgatggctttggctttggcttcgtcaaagtttgcaccaaacaggaaggcttctccaccaaatgcgcgtacggcatccaccttaatgtcggcggtagccagcggcatcacgatcagtgacttaatccctagcttcgtggcagataacgccacgccctgagcatggttaccggcagacgcggtgacgacaccgcgggctttctgctcttcattaagtccggcgatcatcgcgtaagcaccgcgcactttaaaactgtgcaccggctggcgatcttctcgctttaccagaatggtgttgcccaggcgcgcagagattttttccatcttctgcagcggcgtaaccagagccacttcgtagaccggtgaacgcaatacagcgcgcaaatactcggcgccgcagggcgcctcgggtagcggttgagcctcagccattttagcctcccagcttactcttatcgcgcactgcacctttgtcggcactggtggcgagcgatgcataggcacgcagtgcaaacgacacttcacgctgacgattcaccggcgtgtaagcgtcgtcgccacgagcctgctgttcttcacggcgcgcgtgcaattcattatccggcacggccaatttgataccgcggttcgggatatcgatttcaatcgtatcgccatctttgaccagagcgatggtgccgccgttcgcggcctccggtgaggcgtggccaattgacaggccggacgtaccgcctgagaagcgaccgtcggtgatcagcgcacagcttttacccagccccattgatttcaggtaggtcgtgggatacaacatttcctgcatgcccggtccgcctttaggcccttcgtagcgaatcaccacaacgtcacccgcaaccactttgccgccgagaatagcttcgactgcatcatcctggctctcatacactttggccgggccgctgaaggtcagaatctctttgtctacgcccgccgttttcacgatacagccatcttcggcgatgttgccgtacagcacagccagaccgccgtcctgcgagtacgcgttttcgcgcgtacggatacagccttcagcacggtcatcatccagcgtgtcccaacggcaattctgtgagaacgcctgtgtggtgcgaataccggccgggcccgcgcggaacatgtccttcactgcctgatcctgggtcagcatgatgtcgtactgatcgatcgtttcacgcatgctttgctgcaggatgttgcgtgcgctggtgtcgataagtccggcacgatccaactcgccgagaataccgatcacgccaccggcacggtgcacatcttccatgtgatatttcggggtactgggtgcgactttgcacagctgaggcactttgcgcgacaggcgatcgatatcagagatattgaagtcgatctcgccttcctgcgcggcagccagcaagtgcaacacggtgttggtggagccgcccatggcgatatccagcgtcatggcattttcaaacgcggccttgttagcgatgttacgcggcagcatgttggcatcgtcctgctcgtaataacgtttagtcaggctaacgatacgcttaccggcgttgataaacagcgttttacggtcggcgtgggtggccagcagagaaccgttacccggttgagacaggcccagcgcttcagtcaggcagttcatggagttcgcagtgaacatgcccgaacaggaaccgcaggtcggacaggcggaacgttcgatctgctcgctgtcggcatcgctgacgttcgggttggcgccctgaatcatcgcatcaaccagatctaacttgatgatctgatcggacagcttggtcttaccggcttccatcgggccaccggacacaaagataaccggaatgttcaggcgcagtgacgccatcaacatgcctggggtgattttgtcgcagtttgagatgcagaccatggcatcggcacagtgtgcattcaccatgtactcgacggagtcagcaatcagttcccgggaaggcagagaatacagcatgccgccatggcccatggcaataccgtcatccaccgcgatcgtattgaactctttggccacgccaccagccgcttcgatttgctcggcaaccagcttacccagatcacgcaggtgaacgtggcccggtacaaactgggtgaaggagttcacgacggcgataatcggtttgccgaaatcatcgtcggtcattcctgttgcgcgccagagggcacgggcaccggccatgttgcggccgtgggtggtggtagcggaacggtacttaggcatgctctttactccagtgaaaataagttcgcggacatccagcgacatccgcgcaggtctggttatgcgttaaccgggtccagccagccccatttgtcttcagtctcgccggtgaacaggccgaagaaggcctgctgaacgcgtttggtcaccggtccacatttgcctgcaccgacctgaatacgatccacgctgcgtactggggtgatttctgctgcggtgccggacataaagacttcgtcggccaggtagagcgattcacgagacagtgcctgttcacgcacttcgatgcccatatcccgcgccagcgtaatgatggcatcgcgggtgatgcccggcagtgcagatgaggtaaacggcggggtgaacagcacaccgtctttcacttcgaacaggttttcgcctgccccttctgagatcaggccattggtatccagcgcgatcccttcctggtagccatggcgacgtgcttcgctgcccactaacagtgaggaaaggtagttgccgcctgctttcgccgcggttggcagcgtgtttggcgcaacacggttccatgaggaaaccatggcgtcgatgccgttttccagcgcttcagcacccagataagcgccccacgggaaggccgcaatgatcacgtcggtcgtaaagccatccggcgggttcacgcccagtcccacatcaccgacgaaagccagcggacggatataggcgcttttcaggttgttgacgcgaatgacttcacggcaggcttccatcagttcatcaacgctgtgtttgattgggaaacggtagattttggcggaatcgtgcaggcgctgcatgtgctcgcggtgacggaatacaaccggccctttatgggagtcatagcagcgaacgccttcaaataccgatgtgccgtagtgcaacgcgtgagacatcacgctgacttttgcctcttcccacttaaccatttcgccgttgaaccaaataaagtctgctttcttcgtgctcattattatttcctatagcgactacgcgcgtatttgttgtgatgtctgttgttgaatctggacgcaggcgacatccatcagttttcttagctgggaagacagtaaatcgacagagcgctggctggcaacggtcatttcgatattaatgttttcagtgttagcgacagtggccatgttcatggaacacacctgaaagccacgatggcgtacaacacgtaaaatacgttccaatatttcaggtcgaaagcgcgcttcgatagacaattgatgctggttcatacggttttctccatcatgttggcgttgctggcaccaggcggtaccaatggccagacgttttcatgctcatcgattgaaacatgcaggaagtaagggccttcactgctcagcagagcatcgagcgcggcgtcgacctgatctttacgggtgatgcgctggccggggatatcaaacgcgctggccagggtaagaaagtcggggttatcggtcaggatggtttcgctgtagcggccatcaaaaaacagctgctgccactggcggaccatacccaggcgttggttatccagcagtaagatttttaccggcagcttaccgcgtttgatcgtacccagctcctggatgttcatcatgattgagccatcgcccgagacgcagatcaccgtatcgttgggacgcgcaacctgcgcaccgatcgccgcgggcaggccaaagcccatggttcctaatccgctggaggtgatgaaatcttcaggcgcgtcacaggagatatgctgggccgcccacatctggtgctgaccgacgtcggtcgtgatcacggtgttggcaggcttgcggtcggacagttgtttcaataacaacggcgcatagatcgcttcgccgggatgatcgtagcgccatgcatgctgtgccttcagtgcggtcacttcgtcacgccatgcctgaatctctaaaggctggctcagggcgggcagaacgtggttaagatcgccttgcagcgagacatgcgcacggcgcagcttgttcagttctgccgggtcgacatcaaggtgaatcacacttgccagcggtgcaaaggtgtccagcttgcctgttacacggtcatcaaaacgtgcgccaaccgcaattaacagatcacaagattgtacagccagattcgcagccttggtgccgtgcatgcccagcatacccagatataaatcgctgtctgcatcaatacttcccagccctttcagcgtggcgaccgcgggtatgccggtttcctgcgccagggcgcgcagtgccggtactgcctgcgccattcccacgccgccgcccacgtataacatcggctttttggcctgagccatcatcgcccgtgcttccactatcgcctgatgcggcatcgacataacttcctcgaccggcatcaactgtggtgaaggctcgccttttgccatctggatatcttttggaatatccactaaaaccgggccggggcgaccggactgagcgatagcaaaggcttcagccatgacggaaggcaactcgtccagcgactcaaccataaaactgtgtttcgtgcaggctaatgacaggccaagaacatcgatttcctgaaaggcatctgtaccgataaacgcggaagagacctgaccggttagcgcgacaaccggaacggagtccatcatggcgtcggcaagcccggtaatcagattcgtcgcgccgggaccggatgttgcaatgcaaacgcccgttttgccggttgaacgggcatagccgatagcggccatgacggcgccctgctcatgacggcacaacaggtgttccacgccgccgtcgtatagcgcatcgtatactggcatgattgcaccgccaggataaccaaatacgatatcaacgccctgtgcgcgtaaagcctgaactacccattgtgcacctgtcatcgctattctcctgtgtccttaggggaacaacagaattttatgctactgttcattgtttgttccttgcagatttactaagtttttgccaggtcaaaaaaaaacccccggacctttcggtgcggggggttttttagagttctggcttgatttttaagcctttcttgctccaagcgttgccccgcacagtgggttaataatcaccaccacgctaatcacgacaaggctaatcactagtagaagggctttcataacgtattcgattatttcactcgttcgaagtaatgcctacagagttatcatagttagcaggctaaatacaacattttttatcaggttttttattccgtcaggctgcactctttcgttatcaatttgttattaaaagagtatttcatcaggtgctgctgctgacaaaaaatgacgctgatcgcatcctcgtcgtttcacagcacgcttctgcaaaataagaaatccaatgtatgacgaagaaaaagtttgcgagggaaggtacatttcgctgttttacccttcgccgtacctgaatcccgcatgcagaattgccgtatttgggagcggcgatgtcattatcaaaggtgctgacgcgggcagccatcggtgttgaagcaccgctggttacgattgaagtgcatatcagtaacgggttgcctgcactgacactggtgggtttacccgaaaccaccgtcaaagaagcgcgtgagcgcgttcgtagcgccatcataaacagcggttttgacttccctgcccggcgcatcaccatcaacttaggcccggcagatttacctaaagaaggcggtcgttatgatttgcccatggctatcgccattctggtggcctctgaacagcttcctgcggacaagctcgaccagcacgagtttctgggtgaactggcccttaacggtgccctgtgcggcgttcagggtgccattccggcggcgttggcggcgattgagggcaaccgacaactcatcctttcggcagaaaaccaggctgatgcgggtttgatccgcaaaggtgcgaccttagtcgctgcgcacttgatcgaagtctgtgcctttttacacggtaagtgtgagttagctgttgcagccgcccatacggaacacgatgaaatcatcacagacgatctccgcgatattgtgggtcaggaacagggtcggcgcgccctggaaattaccgccgcagggggacataacctgatgctgattgggccgccaggaacaggcaaaaccatgctcgccacgcgcttacccggcatcatgccgccgttaagcgatcaggaagccttagagtgcgcagccattgccagcctgagcaatgccggaccctggcatcagcaatggcgtaagcggcctttcagagcgccacatcatagtgcttcactgtatgctctcatcggtggcggtgcgttaccccgtccaggggagatctcgctggcccataatggcgtgctgtttctggatgaattgcctgaattccagcgcagcgttctggatgcattacgtgaacccattgaatccggtgaggtggcgatttcacgggccagggcaaaagttgtttatcccgcacgctttcagttaatcgccgcgatgaatcccagcccaaccgggcactatcaaggccagcataaccgtacgtcgccgcagcagattctgcgctatctcggcaagctttctggtcctttcctcgaccgctttgatctgtctctggaagtgcccttacttcctgccggaatgttgagtcagcaacgtcatgccggggaaagctctgcggaggtgcgtgaacgggtactcgccgcacgtcagatacaaatggcgcgctcaggaaagatcaatgcccagttggcgaatccggatgtactacagtggtgtgagattaccccgccggatgccaaatggcttgagtcggttttaaatcagttgggcttatcggtacgggcgtggcaacgtattctgaaagtggctcgaaccgtggccgatttagcgggtgaagagacgattacgcgtcaccatcttcaggaagccgtcagttatcgtagcattgaccggctgatgatctatcttcataaaagcatgcagtaaaaaggggctttcgccccttctcatcaatcgtcgctttcggtgtagtcttcaacggtgtccatctgtggcttaccgcctgacagcgtgtgaaaacgcttaggacgcttgatacgtgtcatgtatttggaccatacacgttctgcttccgtttgcggctcacgcacgccacgacaaacctcaatgaacaaacgttcttcttctgtcgtcggctcgcgtttagcaagatccaactcattaaaagcaacaccgtggcgttcaagtagctgtgcttctttaatcgtaaagtcaccatgacgcgaaaaaccgcgtgggtaatgtttgttatcaaagaaacgattttccgttgagaagctttccgccatgttacacgctcctgtttctcttatggccgtgcgatttatggcgcggagtattagataggcttgacagagtgtaaaacaaaacatttaaatctatacgacaaacaaattttgggagaacgatgtggatacggaattactgaaaactttcctggaagtgagcagaactcgccatttcgggcgcgctgcagaagcactttacttaacgcagtctgctgtcagttttcgcatccgccagttagaaaaccagctaggggttaatctttttacccgacatcgcaacaatatacgtctgacttctgcaggagagcgcctgctgccctatgccgaaagtctgatgaatacatggctgatggccaagaaagaagtgtcacatacgcagcagcaccatgagctgtctatcggtgccagtgcctcgctatgggaggcctacttaaccccctggcttaagacgctctatgagaaccgtgagagcctgcatctggaagcgcgtgtggcacagcgtcatttgttggttaagcagctacatgagcgtcagctggacttattgattacgactgaagcaccgaagatggatgaattaaccagccagcagatcggtcatatttcactggcgctttttcgctcacggcagacggaaaagcgtgagaaatatgactacattaaagtggaatggggagcagactttcatcagcatcaaagctatctctccggcggagatgatgtgccggtgttaacaacgacatcagcgcaggttacgcgggaattgttgcataccacgggagcctgcgcgttcctgcccgatttctggcaaagcctgtacagcgatctgatggtgatgcctgatacttctgtcgcagtgcgccccctttatgcggtgtggttacaaaacagcgatcagcaaacgtacattcgtcagttgctaaagtttcctgtcgtgccgaactaaaggtatgaggggagaggattaagccagtttctgctggctgattttcttttttagttttcttcaggcaaaaaaaaatcctttgccgaagcaaaggatttttctctttctggcaggggcggagggactcgaacccccaacacccggttttggagaccggtgctctaccaattgaactacgcccctaaaaagggtggcggaacggacggggctcgaacccgcgaccccctgcgtgacaggcaggtattctaaccaactgaactaccgctccaccgattctgtactgacgtcagaaaaacgttctgatatcaggtgtttcgcccttccgcgtcaccggtaaggtcacgaccagcgtactggtcttaatttgatgcctggcagttgatgaatcacgcggtgattcacccttcgggccgctgctctgcagcgttcaaaagcattcgcttttgtcctactctctttgagtagagaactgcccgaagtaacgtgcaggttttcaatttgatgcctggcagttccctactctcgcatggggagaccccacactaccatcggcgctacggcgtttcacttctgagttcggcatggggtcaggtgggaccaccgcgctacagccgccaggcaaattctttgtgcacgaaacgactcttttacgccatgaacgcgttgcattcgctctgccgcaacggtcacatacttcagtatgctcccgctgacgtcatcgctctgcgccttctcatgccgcaaaatctgtcgtttccgcaaattcttttccggtaaacaatgctgaaaatttaatcgtctctcaaccaaaacgcctctggcgttgtaaggttaagcctcacgggtcattagtaccggtaagctcaacgcatcgctgcgcttacacacccggcctatcaacgtcgtcgtcttcaacgtcccttcaggacccttaaagggtcagggagaactcatctcggggcaagtttcgtgcttagatgctttcagcacttatcttttccgcacttagctaccgggcagtgccactggcgtgacaacccggacaccagcggtgcgttcactccggtcctctcgtactaggagcaacccccctcaattctccagcgcccacggcagatagggaccgaactgtctcacgacgttctaaacccagctcgcgtaccactttaaacggcgaacagccgtacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgagccgtcactctcgcagtcaagctggcttatgccattgcactaacctcctgatgtccgaccaggattagccaaccttcgtgctcctccgttactctttaggaggagaccgccccagtcaaactacccaccagacactgtccgcagcccggatcacgggcctacgttagaacatcaaacattaaagggtggtatttcaaggttggctccacgcagactggcgtccacgcttcaaagcctcccacctatcctacacatcaaggctcagtgttcagtgtcaagctgtagtaaaggttcacggggtctttccgtcttgccgcgggtacactgcatcttcacagcgatttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttcagcttgcgcttaaccccatcaattaaccttccggcaccgggcaggcgtcacaccgtatacgtccactttcgtgtttgcacagtgctgtgtttttaataaacagttgcagccagctggtatcttcgactggcttcggctcggggagcaggtcccttcacctacgcgccagcgtgccttctcccgaagttacggcaccattttgcctagttccttcacccgagttctctcaagcgccttggtattctctacctgaccacctgtgtcggtttggggtacgattttgtgttacctgatgcttagaggcttttcctggaagcagggcatttatcacttcagcaccgtagtgcctcgtcgtcacgcctcagtgtaaagtgaaccggatttgcctggaacacacacctacacgcttaaaccgggacaaccgtcgcccggctgatatagccttctccgtccccccttcgcagtaacaccaagtacaggaatattaacctgtttcccatcgactacgcctttcggcctcgccttaggggtcgactcaccctgctccgattaacgttgaacaggaacccttggtcttccggcgacaaggtttttcaccttgtttatcgttacttatgtcagcattcgcacttctgatacctccagcatgcctcacagcacaccttcaacggcttacagaacgctcccctacccaacaacacatagtgtcgctgccgcagcttcggtgcatggtttagccccgttacatcttccgcgcaggccgactcgaccagtgagctattacgctttctttaaatgatggctgcttctaagccaacatcctggctgtctgtgccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagccgggatggccccctagccgaaacagtgctctacccccggagatgagttcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccagttaagactcggtttccctgcggctcccctatacggttaaccttgctacagaatataagtcgctgacccattatacaaaaggtacgcagtcacccccataaagaaggctcccactgcttgtacgtacacggtttcaggttctgtttcactcccctcgccggggttcttttcgcctttccctcacggtactggttcactatcggtcagtcaggagtatttagccttggaggatggtccccccatattcagacaggataccacgtgtcccgccttactcatcgaactcacagcctgtgcacctttgtgtacgggagtatcaccctgtaccctgcgactttccagacgcttccactgatgcacaagctgatgatggttctgggctcctccccgttcgctcgccgctactgggggaatctcggttgatttcttttcctcggggtacttagatgtttcagttcccccggttcgcctcatgcagctatgtattcactgcatgatagtgtgacgagtcacactgggtttccccattcgggtatcgccggttattgcggttcatatcaccttaccggcgcttatcgcagattagcacgcccttcatcgcctctgactgccagggcatccaccgtgtacgcttagtcgcttaacctcacaacccacaggcgttttacgctgcgtgtcatgagcttttgagagactcgaacgcgttgtcctgtgttccttattacggaggaacacgacaatgcgtcgtttcaaattttcagcttgttccggattgttaaagagcaatatcttaaacacgactcgtaagtcatctttaagatatgtgggcaacacctttcacctgtcaccaagcaagtggcgtcccctaggggattcgaacccctgttgccgccgtgaaagggcggagtcctaaccgctagacgaaggggacacggacgtgtctcgacttcgcagccgtcttgcttctttaactttctatcagacaatctgtgtgagcacttcgcgggaaggtatcttcaggtaaggaggtgatccaaccgcaggttcccctacggttaccttgttacgacttcaccccagtcatgaatcacaaagtggtaagcgccctcccggaggttaagctacctacttcttttgcaacccactcccatggtgtgacgggcggtgtgtacaaggcccgggaacgtattcaccgtggcattctgatccacgattactagcgattccgacttcacggagtcgagttgcagactccgatccggactacgacgcactttgtgaggtccgcttgctctcgcgaggtcgcttctctttgtatgcgccattgtagcacgtgtgtagccctactcgtaagggccatgatgacttgacgtcatccccaccttcctccggtttatcaccggcagtctcctttgagttcccgaccgaatcgctggcaacaaaggataagggttgcgctcgttgcgggacttaacccaacatttcacaacacgagctgacgacagccatgcagcacctgtctcacggttcccgaaggcactaaggcatctctgccgaattccgtggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccactcctcaagggaacaacctccaagtcgacatcgtttacggcgtggactaccagggtatctaatcctgtttgctccccacgctttcgcacctgagcgtcagtcttcgtccagggggccgccttcgccaccggtattcctccagatctctacgcatttcaccgctacacctggaattctacccccctctacgagactcaagcctgccagtttcaaatgcagttcccaggttaagcccggggatttcacatctgacttaacagaccgcctgcgtgcgctttacgcccagtaattccgattaacgcttgcaccctccgtattaccgcggctgctggcacggagttagccggtgcttcttctgcgggtaacgtcaatcactgcggttattaaccacaatgccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgggccgttaccccgcctactagctaatcccatctgggttcatccgatagtgagaggcccgaaggtccccctctttggtcttgcgacgtcatgcggtattagccaccgtttccagtggttatccccctctatcgggcagatccccagacattactcacccgtccgccactcgtcacccgagagcaagctctctgtgctaccgtccgacttgcatgtgttaggcctgccgccagcgttcaatctgagccatgatcaaactcttcaatttaagtttgatttgctgaaaccagttcagcggtgctcatctgtaaaacgtcataatgaatttcattatgtgttcactcgtgagacttgatattttttacgtccggagacgctgatatcaatcctgcgagtgcccacacagattgtctgataaattgttaaagagcagtgccacacttctctgtggcgcgggctgcatatattacgctttccgctttatcagtcaagcacttatttttgcttaactgaccggttcgaatcgttctgaaccctacttaacccggcgcttcgtattccgttgtgccgtgtcagtggaggcgcattatagggagttcttttcggctgacaagggctaatttcaattaattttccgagtgctgtttttttcagcgaaaagccgctaaagcgccagtttttcaagcaatgggaagccataacgctgcaaaaccggtgataattgtacggcctcaccatcaagctcggtacaaaacgccacgttttgctgtgacgatcggacttcaggtgcttcattttccagtaaccaggccgtacgtctggcaatggctgccccggaatcaattaaacgcgtgccttccggcaggatgtgctgcagctcatcgcgcagtaaaggaaagtgcgtgcatcctaataccaccgtgtccggcggctcggccatgcgtaaccagggttgcacgatgcgcctgacttcatccagcgacacatcattaccatggagcttggcctcggcaagctcaaccagttcggctgaacccagcatttcaatcttgcaggtgctggcaaactgcgacaccagttcatgcgtgtacgaacgccgaaccgtcgcgcgggttgcaagcagccccaccacaccattacgcgtaagacgtgctgcaggtttaatagccggaacaacaccaacgaccgggaaggcaaagcgctcacgtaatgcgggcaaggttacggtgctggcggtattacaggcgataatgaccagggaaatgggatgccggcgagtaatggcatcaacaatcgcgaccacacgttcgacaataaaggtctcggttttttctccataaggaaaaccggcattatcgaacgcataaagataatgcaggttcggcagtaactgccgaacctcatcatagacagaaagcccccctacgccggagtcaaacaccagcacagtaggacgcaggtcagaagctgtagcttccgttgaggtaatactctcttcctggagtctgatagccatacgctgtctcgtaatctttatcgaacaggttggcgattctaccacgaacggtcagatgtgatgtgaccggatacgataccgcgagatcaactgtgctgtaactcggtaaacgacgttgctcgcttgcgtactggctggtgttattgtcataacgcttgccaaaatactggtaaatgacatcaatatcagcttcataaaccgtgatgcctaactgatatttcatctgttggcgagcacggcgagccaggacttcgtcatcggcatcccgccgggcatcaaggtagcctaaggttatttgatggtgcaggaagccagtatcgaagtcagccgttgcttcgataccttttagcgtgaccgctttttgattgaaatagccgccctggaatgtcaccggatctgaagcatagtcaatcaagtccgtgacgctattacgataagccgcaacgcgccagttaaccggtccgcttaacccttcaagcgcggcttcccactgctttgacttctctggctggagatcgggattagcgctaatgccaaaatgtttttggccatacagctgacccagagtgggtgcctggaagcctgtaccgtaggagagcgaagccttgtagcctggtacaaattcccatcccgccgccgtttgccacgtaccatgacgaccataatcctggttatcgtctccccgtaaagcgccttcaagggtaaccgtgcccaactgctgctgcgtcgtcagataagcgccggtgttatcttgcttatagctgtccgtatctctgggttgaccagaaaaaagctgcccgaccgaactcaacgtttgacgctgccagtccaggccagcacttaccgtgccataacctatcgcgaaagcgttcccccactgcaggttacgctgctccatatcatccagcgtattagaatctgcgtaacgtccgtcagcaccgacatagttataaattttgtacttttggtcactggccaccagctgtgatgaataatcacctttattgaagcgcaagccggtatcgaaggaatggttataaatttgctgctcatccgttccgcctggaaaaccggcatcgtagtcagcattcgcagcgtaaccataaccccgaaagaagccggaaaacaggccattaaacgtgtgctcaacacctgcccagaaagctttgttgcgccagccatcacgatcgcgatcagttggcgatgtcgaatctggctgaatattatagccatttgtcgcctggtaagaccctgcgacggtaagacgagtttgatcggtcacattctggtttacgcttccgctgtactcctggtatcccttcgaacccatccctgctgaaagttcattatgattctctggattttgggtaatgacgttaaccacaccgccaatggcatccgctccgtatactgacgatcgtggcccacgaataaactccacgcgctggataatggagaccggaatctgattgaagtctgccacccctgtaataccaggcttagcaaaagggacgccatcaaccagaatcaatgtctggcgggcttcggagccgcgcacatacattgaagcgctctgcccaataccgccactttgcgcgatatcaacgcctggcaggcgacgaaggacctcgacaaggtttttcgcttgccacagttcaatctcatcccgtgtcaccactgaggtagacgccagcaccgacgaaaccgcttgttgaaaacggttggcggtcacgatttgcgtgtcatcacttccctgcgcaacaccgttttgcgcccagagggaaatcgccgttgcgctgaaggcaaacagcgaggcttttgttttactcatttttatcgcatccaaaagaaaaaggatgccgcaggcatacaatcgatagcacgcgatgactgtacgagtggcgacgtcacaccggcaggtcttcgggctgggaaccatagcaggtgatgacttcccatcccgcaggacagtgtctgcaattgcaatcaccctgacattccttaccgctgcgcgtcagctccagattcacactggattccctattaactcaaggctgaggccggtgccagcagtctacgaagagcgcatgggcaagtccagacctccacacatcgtatctctgcgccagcgcacaagactggacatcggcaggtgaatgcctacaatcgcccggcaagtaagctcttaaccaggattaaacatgacacccgaacatctccctgttgaacagtatgacgcgcagctggcggaaaaagtcagtcggttagaaacgatgatgacgccgtacgctgcgcccgccgtggaggtgtttcgttcacccgtcagtcactaccgcatgcgtgcagaattccgtatctggcacgatggcgatgacctctaccacattatcttcgatcaggagactaagcagcgcatacgcgtcgatcagtttcctgctgccagtgaattgatcaacctggtgatgccaaagatgatggcggccatgcgggataaccgtctgctgcgccacaagctgtttcagatcgactatctgtccacgatgagtgatcaaatcgtgatttccctgctctaccatcgcaagctggatgatgagtggcagcaggccgccagcacattacgcgatcaattacgggctgaaggtatagatgtccagctgattggccgcgcgaccaagaccaaaatctgtctcgatcgggattatgtggatgagcgtttgccggtggccggtaaagagatgatttatcgtcaggtagaaaacagctttactcaacccaacgccgccatgaacattcaaatgctggaatgggcactggacgtcaccacgggttctcgtggggatttactggagctctactgtgggaatggcaacttctcgctggcgctggccagaaattttcgtcgcgtcctggcaacggaaatcgccaaaccttctgtggcttcagcacaatataatattgcggcgaaccagattgataacgtccagattattcgaatggcggccgaagagtttacgcaggcgatgaacggggtgcgccgcttcaaccggctggaagggatcgacctgaacagctatgactgcgagacgatctttgtcgatccgccgcgcagtgggctggatgacgaaaccgttaagatggtgcaggcttaccccgccatcctctacatttcctgcaatccgcaaaccctgtgtgacaatctgctggtgctggcgcaaacgcatgatgtgacacgactggcgctgttcgaccagttcccgtacacccatcatatggaatgcggcgtgctgctgacgcgtaaagcgtaaaaaaacgggaacctgatggttcccgttttcgttattaccgattgcggttgcgcttgtaacgcagggcaatccagaacaccagcccgaccatcaggatggtcgggataaaattagaaccgatttcagggtattcagccctgaccagcgcgctatacaccagaatgcccagcaggaaaaaagcggctgccaggcctggtacgccatccggcatgcttttgttcagatagcgctgatgcaggcaccaggccgacagccccagcgcaatcagtgggaaaatagaaaaagggacaaaagcactaaacagcacggagaacgagccgttcatagcaaggccggtaataaaagccagcaacatcgtgcctttatcacgggagcttgggtgggtcatgtcggggtccttattcataactcttcaggtttatccagggttaccgccagacgttcttgctcccggcgataccagtaataagcgcctttggcgatcatacgtaactgcagtaccaaacgatcttccagcttacgtcgctgttcaatatcgatgtccaccgcttcggcacccgcgctgaaaacgatagtgaccatcgcttcagcctgcgcttcggtaaaactgcgcggcatgcgattttcgacctcaagataatcagccagttcagcaataaaatgttgaatttcacgtgccacggccgcgcgaaaggcagcagaggttccggaacgctcacgcagcagcagacgaaacgcgttagggttattctcaatgaactccatgaacgtcgcgatggaggttttaatgatgctgccgcctttggcgatacgctggcgcgcctggcgcatcagctggcgcaacatcagcccactttcgtcgaccatcgtcagacccagctcatcaacatctttaaaatgccgataaaaagaggtgggtgcgataccggcttcacgggcgacctcacgtaaactcaggctggcaaaactgcgttcggcgctgagctggctgaaagcggcttcgatgagtgtacgccgtgtacgttctttttgttgcgctctgacgcccattctgtctgccttgtgaggttctgaaacagcactataacaaaatattcagcgtacagtcgggcaaactttgtgacggcttgttaaacaccactgaaaggcaaaacgtgatgaaaatcgctgttagaatttagaagtgcgcggcgagatgttagaatctcgttgtaaaaatgtataaataataggacgtatcggtatgcaaaagtcttacgattacgatgtcatagtgattggctcaggaccgggcggcgaaggtgcggcgatgggactggtcaagcaaggcgcacgcatcgcggttatcgaacgctatcacaacattggcggcggctgtactcactggggaaccattccctcaaaagccctccgtcacgccgttagccgcatcatcgaattcaaccagaatcccctctacagcgaccatacccgactgcttcgctcatcctttgccgatatcctcaatcacacagaaagcgtgatcagccagcaaacggcgatgcgtcagggcttttatgagcgcaaccgctgtgaactttttcagggcgatgcccactttgttgatgccaatactgttgaggtggaacatcacgacgggacacgcgaaaaactgaccgccgagaaatttattattgcctgcggttcacgcccttatcatccccatgacgtcgactttacgcatccacgcatttacgactccgattcgattctcaacctgcatcatgaacccggccacgtcattatttatggcgctggcgtgattggctgcgaatatgcgtcaattttccgtgggctcaatgtcaaagttgatctgattaacacccgtgaccggttgctggcgtttcttgatcaggagatgtccgattcgctgtcttatcacttctggaacagcggtgtggtgattcgtcacaacgaagagtttgagaagattgaaggcgttgatgacggcgtgatcatgcaccttaaatcgggcaagaaagtgaaagcggactgcctgctttacgcgaacggtcgtaccggtaataccgactcactgtcgctggaaaatgtcggtctggaagcggacggacgtggcctgctgaaagtgaacagcatgtaccagacagcacagccgcacatctatgcagtgggcgacgtgattggttatccaagcctggcgtcagccgcttacgatcagggccgtattgccgcgcaggcgatcatgaaaggtgaagcctcggcgcatctgatagaagacatcccgaccggtatttataccattccggaaatcagctctgtaggtaaaaccgagcagcagttgaccgcgatgaaagtcccctacgaagtcggtcgggcacagttcaagcatctggcgcgtgcgcaaatcgtcgggatgaatgtgggcagcctgaagattctgttccatcgcgacaccaaagaaatcttagggattcactgctttggggaacgtgcggcggagatcattcacatcggccaggcgattatggaacaaaaaaatggtggcaacacaattgagtactttgtgaataccacctttaactatccgactatggccgaagcctaccgcgttgctgcattaaacggcttaaaccgcctgttttaacgtcgtgtcgaaatagccttgcatgtgcgttcggattgcctctgccagttgttcataacgactgcgcaggggtgaaccgggacggtacaccagcgcgatagtacgttgtggtactggcttgtaacacggcaggtaacaaacaccgtcgcgaatgcgctgctggggcacggctaatgctggcagtagcgtaatcccgcttcccgccgcgaccatattgcgcaatgtttccagactggtggcacggaaatgcgtatcttcgtccgcgcccgcttcaaagcaaaagcccatcgcctgatcgcgcaggcagtgaccgtcttccagcatcagcagtttttcgccggccagatcggacatcggtacgcggtcacgatcacgccatggatgatcctcatagaccgccagcttcatcggctcatcaaacagcggaacttcaataaaggcttcgctctctttgaccagcgccagaatcgcgcaatccagtttaccgctgtcgagttgagccagcagctgctgcgtttgcgcttcatgcagatacatttccagctttggaaaggtctgatgcagcataggaatgatttgcgggagcaaataaggaccggtcgtggggataagcccaatatgcagtggccctgacatcgcttcaccttgctgactggccatctctttcagcactttgacttcacgcagaacggtacgtgcctggtcgaccagcaacaggccagcctgagtaaacagcactttgcggctggtgcgttccagcagcatgacacctaattcgtcttctaatttacggatctgtccgctcaacgtgggctgactgacatggcaggcatccgcagcacgtcggaaatgacgatgttcagcaagcgaaaccagatattcaagatcacggatattcattattaccctccattccacgatagctcgtggcgatagatagaatagcaaccaacgattggccctatcaagagcggatgggaataatgcccgcatcaaattcagaatcatggccacccagggaaatgtatttctgaacgttgaaggcagtgcttatccctgttttcaacgcgcgtgaaaccttctgcaaaacgcaaaaagacagaaagccttatctggctttcatataacaggcagagggtgaacgtaacgaatctgagcatcggccgggagcgccgctgttctgatgatgtgcctaaaataaaagtagtttttgaagctagaggttggcgggcatttgatgcccgctctttttttgcctgccgtttacgctaaacgcgttttggcttctgcaatagcacgggcaacctgttcgggcgaaacgccaccctgcgcattacgcttatccagacaggatttcagggccagaacaggataaacatcgtcttcaatcgcagtgctgaactgcttcaactgcgccagcgtcagtgcttccagtgctacgccctgcttaattgcctcaacgaccgtttcacccacaatatggtgcgcttcacggaaaggcacgcctttggcaaccaggtaatcagccagttcggttgagttggcatagccctgctctgccgcttccttgcagcgtggacgttttacctgcaggccatcgaggaccagtaccgacatatgcaggcagtccagccaggtatcaagcgcatcaaagagcccttctttgtcttcctgcatgtctttgttgtaggcaagtggcagacctttcagcgtcatcatcatgccggttaatgcgccctgaacacgaccacacttgccgcggatcagctccagcgcatcgggatttttcttctgtggcatcagggatgaacctgaggtgactttatccgcgagttcgataaagccagcttcgcccgtgttgaagaaaatcatgtcttccgcaaagcgcgacagatgtaccataccgattgacgcatcagagagcagctccagaacatggtcgcgatcggacaccgtatccaggctgttacgggtggcagaggcaaagcctaaccagccagctaactgctcacggtcaatatcataagcggttccggccagcgcgccacaacccagcggactgacgtcaaggcgctttagcgtatcctgcaaacggctttcatcgcgcgccagcatttcaacataggcgaggcaccagtgagcaaaggtcaccggctgcgcacgctgcagatgcgtatagcccggcatcaccgcatcctggttcacttccgcggtggccaccagcgcctgctgcagttcacgcgtagcgcccaataacgcggcaacctgctctttacaccacagtttcaggtcagtcgccacctggtcattacgactccgaccggtatgcagttttttgcctaacgcgccgactttatcgatcaactggccttcaacccagctgtgaatatcttcggcatcgctttgcagaatttgctcaggattagcacgtacttcttccagtaacgcgttgagcgccgcttccagctgctgctgctcatcacgggtcagtacgttgacggtcaccagcgctttggaccaggccacagagccaatgatgtcctgctcagccaggcgataatcaaagcgcagcgagtcgttgaactgtttgaaacgttgatctgctgcctgggtaaagcgtccaccccaaagtgccatgtgaatctccttcaagtcgttaaaccaggggcggcataatagccgcccctgatgtcataccgagaggcgaggcgatcctcgcctgcttattacttcttctgctcgttcagtgcgcggatgcgtgaagagagcgagaacagacggataaagccgcctgcatgacgatgatcgtacacttcatcttcgccgaaggtcgcgaactcttcagaatacaggctgttggctgaacgtttctgggtcgcggtagcctggcctttgtagagttgcagtaccacttcgccgttcacctcttctgccaacgactctgccgccgcctgaatagacttacgcagcggtgcaaaccagcgaccatcgtaaaccacatacgacatttcatggcccagttgctcacgccatttaaagctgtcacgatccagaaccagctgttcaaccgcacgcagcgcgttaaccataatggtgccgcccggggtttcgtaacagccgcgtgatttaatgcccaccagacggttctcaacgatatcaatacgacccacaccgtgtttagcgcccagcacgttcagtttttccaggcactggaacggactcagtttctcgccgttcaccgcgactacgcggcctttttcaacggtcacggtcacgtcttctggctgatcgggggcttccagtggatcaacggtccagacccagcaatctttgtttggtgcattagacgggctttccagcacgccaccttcggtagaaatatgccaggcattttcatcacggctgtagattttttccagcgaggcggtggtagggatattgcgctctttcagataatccagcagcgcttcacgtgaacgcaggttccactcacgccatggcgcaacgactttcagctggggagccagtgcggtataggtggtttcaaaacggacctggtcattgcctttaccggtcgcaccgtggcacagggcgtccgcacccactttcagcgccagctcaacctgcgctttagcaatgataggacgcgccattgaggtgcccagcaggtaagttccttcatacagcgcaccggtctgcagcaccggataaacgtactcgctgataaactcttcacgcagatcaacaacgtgacattctgatgcacccgactgcagcgctttcttctcaacgccttccagatcgctacgttcctgaccgatatcagccacaaacgcgaccacttcacagccgccatagttttctttcagccatggaataatggcggaagtatccagaccaccagagtaagccagaacgatttttttgatgttttgcgtttgcatttcgtaatccttgaatctgagtcgttaagcgagaatccgggtgccaatggacacaccgttgaaaaggtcaggcagttgctcggcatgacgccaactggcgatatcgaccgggcggcccagtgtgcgcgcagcatccagcgcggcgttcactttcacaatcatgccatcggtaatgatgccctgcgcaatcagctgctctgctttgtcagcggtcatttcttcaatgcgctggcctttaccgtcaagaatgccactgacatccgataacaagactaaatcagcacccagcgtagatgccagcgccgttgcggcctgatcggcattgacgttcattaactggccgtcatcggtgatgccgattgagctgaccacaggcatatatcccgcagccagcagcgtgttgaccaacgcaggattacccggtgtggcatgaccgacatggcccagcgcttcatccagctgcgtcacattcaccaggcccgcatcacccaggcaaaggccaaccgcatgaatgccatatttttttgcccatgccagcagggttttgtttgccgtacccgccagcgcaccggtaatgatgtcaatctggtcggcaggcgtcacgcgtaagccgttctttttttgcactggcagcgccagttttttcatcagttcatcaaccaggcagccgccgccgtgaacgacgatcagtgggcgctgatgcgctgagcgataggccagcaacgcgtcaaataaacgggccagcgcttcttcgctgtctaacagcacgccgcccagcttgataatcaatggattggtcatggtttactcgtccgttaaatcagtgactgcgtttcagggaaaccgaaacgaatattaaggcactgcaccgcctgggaggccgcccctttgagcaggttatcttctgcagccacgacaatcagatgttcgccctgaacggcaaaaccgatatcgcagtacggcagtccgaccactgccttcagtgccggcacgccctgttcgtaaacgcgtaccagcggcttatcgtggtaggcattgtgaaaagcttcagccacatcatcacggcttacaccagccttcaaacggcaggtgaccgtcgccagaatcccacgcgggaaactgcccaaatgcggcgtaaaaatcaccggtgtgcccaggtgcgccacaatttcaggataatgacgatgattaaaaataccgtaaggttgcaggctgacttcgcagaagctggtgccgatgttggctttacgtcccgcaccactcacgccgctggtggcgttaatcaccggccactgcgcgtcattcagcaaacccgcatctaacacgggcttcagcgccagctgggaggcggttgggtagcagcccggcacggccaccagttgggcttctttgattttttcctgctggaactctgcaagtccgtaaacggctttatccagccagtcaccatgctggtgagtgaagccataaaactgcgtgtaaaagtcgccatcgttgacgcgaaacgcgcctgacagatcgaacaccacacagccagctttgagaaattcaggggccagatcgtgactgacttcgtgggcggtcgccagaaacaccacatccactttgtctgcccattcggcggcattgctcaacggctgcagtggcaaatccaccacgcctttcagctgtggatgaagatcagacaggcgcttacccgcatcgggactttgcgcagacaccgccaaagcggttatgttgatatgtggatggcgattaaggaaggtggcaagctctacgccagcataaccactggcaccaacgatcagcgtattcaacatcaggctgtatacctttattacagtcacacgttccgggtcgcggccttgccccgttgcccacgatgtcgtttgcagcgatttaaggttcacatgcacacgacgttaatgtatttttattcactattaatgcatgaatattgatacatcctaactcaaggaccgtcaacagtgaagacaaaattaccgccttttatcgaactataccgccagttgatcgcaacgccgtcaatcagcgcaaccgatgccgcgctcgatcagagcaatgaaactttaatcaatttactggcgggctggttccgcgacctgggttttactgtggacgtgcagcccgtaccgggaacgcgtcataaatttaatatgctggcccgtacgggaagcggtgcgggcggcctgctgcttgccggacataccgatacggttccgtttgatgatggtcgctggacccgcgatccttttaccctgaccgagcacgacaataagctgtacggtctgggcaccgccgatatgaaaggcttctttgcgtttattctggacacactccgtgatgtggatgtgacaaccctgagtaagccgctctatattttggcgaccgcagatgaagaaacgacgatggcgggcgcaaaatactttgcagaatccacacagctccgtcccgactgcgccatcattggtgagccgacctcgctgaagccggtacgggcgcacaaaggccacatttctaatgcgattcgtattcaggggcaatcaggccattcgagcgatcccggacgcggcgtcaatgccattgagctgatgcatgagtcgatcaccgaacttatgcagttgcgtaatacgctcaaatcacgttatcaccacgatggctttgcgatcccctacccaaccatgaactttggtcatattcacggcggcgatgcggcaaaccgtatttgtgcctgctgcgagttgcatatggatatccgaccgctaccgggactgaccctgagcgatctcgagggcctgttaaatgaggcactggctcccgttagcgaacgctggccgggacggattaccattgaagagctgcatccaccgatccccggctacgagtgccctgctgaccataaactggtcaaggtcgtcgaaacactgctgggtatccagacggaagtggtcaattactgcaccgaagcgccttttattcagcaactctgtccgacgctggtgctgggcccgggttcgatcaatcaggcccatcagccagatgaatttatcgataccgcatttattaagccaacacgcgcactgataagccaggttgtgcagcatttctgtcactaattgtcatcaatcggggcatttcactgaattaacagcaaaatgccccgccattctgcgggatttaataataagaataacttatcccacttctcccccatcaaattccatgaatttccggcagttagctgcacgtttccttcactttaagtcaattgacgaacggaagattacgtggctagataaaagacgatgttatacccgcagggcaatcatcccactttattcagcttgcgacaggcagcaactgaagaacctcggtcagagccgagaggacaacgttgctggcttttgtgctgcctgaaaaggccgggtatagaggtttatcaagacgataagggtgtcagggtcacatgaacgaacaatattccgcaatgcgaagtaatgtcagtatgctcggcaaactgctcggggatacgatcaaggatgcgctgggagagaatatcctggaccaggtggaaaccatccgtaagctctctaaatcatcccgtgcaggcaatgacactcatcgtaaggagttgctgaacacactgcaaaacctgtcaaacgacgagttattgcccgtggcacgtgcattcagtcagttccttaacctcactaacgtggcggagcagtatcaaaccatttcccgcagcggcgacggcgcaaaccatcccgaactgttgaaaaagacctttgaaacgctcaaacaaaacaatctcagtgaaagtgccattcacgccgcgattgaatcactgtcactggagttggtgctgaccgcccatcctaccgaaatcacccgtcgtacgctgattcataaactgggtgaggtaaacagctgtcttgaacaactcgaccacagcgatatttctgattacgaacgtaaccagattatgcgccgcctgcgccagttggttgctcaggcctggcatacggatgagatccgtaaatatcgcccaacgcccgtggatgaagccaaatggggctttgccgtggttgaaaacagcctgtgggaaggcgtacctgcgtttttacgtgagctgaatgagcaggtcgaagagacatttggcattaagctgccggtggatttcgtgccagtgcagttcacctcctggatgggcggtgaccgtgacggcaacccaaatgttaccgcatccattacccgccatgtgatgcagctcagccgctggaaagccactgacctgttcctgcgtgacattggcgtcttaatttcagaactgtcgatgtctgaatgcagtcaggaagtggccgatctcagtggcgatcctgaagcactggaaccatatcgggtgattttaaagcgtctgcgtagccagttgatgaccacacaggcttacctggagcgccgcctcaaaggcgaacgtttaccgcgccctgctgacttactggtttctaacgctcagctttgggagccactgtacgcgatctatcagtccctgcagcagtgtggcatgagcatcattgccaacggtcagctgctggatacgctgcgccgggtgaaatgctttggtgtgccgctggtccgtatggacgttcgtcaggaaagcacccgtcataccgaagcgattgcggaaattacccgctatctggggctgggagattatgaaagctggtcagaagccgacaagcaggcatttcttatccgtgagctgaactctaaacgcccgttgctgccgcgtagctgggaacccagtgatgaaactcgcgaagtgctggaaacctgcaaagtcgtcgccgaagcaccgcagggttctatcgctgcctatgtgatttcgatggccaaaacgccgtcagacgtgctggcagtgcatctgttactgaaagaagccggcattccttttgctatgccggtcgccccgctgttcgaaacgcttgatgacctgaataatgccaatgacgtgatgagcaagctgcttaacattgactggtatcgcggttttatccagggcaaacagatggtcatgattggctattcagactcagcaaaagatgccggggtgatggccgccagttgggcacagtaccaggcgcaggacgcgctgattaaaacctgtgagaaagccggggtttccctgacgctgttccacggacgtggcggcactattggtcgcggtggcgcgccggcacatgctgcgctgctgtctcaaccgccaggcagcctgaaaggcggcctgcgcgttaccgagcagggcgaaatgattcgctttaagtacggcctgccggaagtgaccatcgccagcctgtcgctctataccggtgcgatactggaagctaacctgatgccaccaccggaacctaaaccggagtggcgtagcattatgaatcagctttccgccgattcctgtgccatgtaccggggctatgtgcgcgaaaatcccgacttcgtgccctacttccgttcagcgacgccagagcaggaactgggcaagctgccactgggttcacgcccggccaaacgccgccctaccggcggtgtggaatctctgcgcgccatcccgtggatcttcgcctggacacaaaaccgtctgatgctcccggcatggctgggtgcgggtgctgcactgcagcaggcaatgctggcaggtcatcaggatcagctggaagcgatgtgccgcgactggccgtttttctccacccgtctcggtatgctggaaatggtgttctccaaagccgacctgtggctggcggaatattacgaccagcgcctggtggataaatcgctgtggccgctgggtaaacagctacgtgaacagttagatgcggatattaaagcggtactcaccatcgctaacgattcccacctgatggcggatcagccgtggattgccgaatccattgccctgcgcaacgtgtataccgatcccctcaacgtgctgcaggctgagctgctacaccgttcacgtgcgcaggaagcgcgcggcgatgagcccgatgcccgcgtcgagcaggcgttaatggtgaccattgccggcgtcgcggcgggtatgcgtaatacgggctaaaaacccgccagggcggttgcggttgctgcgtgaccgcccttttttacgatggccttaaacgggcaaaccacactgcaggttactcttacgttcgtgttcaccttacttctctgatatgccccgcgaagcccaggccacctttcagtatcaacagaacgttcttacctgagattttaactcagcaattattacaatttaattacaactcaaatataaaccttcctgctttgaggtcgttactctttctacgggttaaaaaacacccgttcgatgaataaataccaaaacattctttacagccctctctgttgagggctgaacaggtgtcgtagcttctccatgctggcgattaatatcaggaaaaaattatgaataacatcagaataggtataaggctcgtggcagcatttggcttcatgggcatgctcgtcatcttcatggtcctgattggcattacgaaaacaagttcgctgggagatgcaaacagcgagatcgccggagggttgtactcaaaagcctcggcctctgctttactgggcttttatacacaggacatgagccgtcttgcgcgcattgcggtgctccagcaggatgatcccgcgcaggtagaaaagaccatcgccagctatcagtcacaaaggaacaaagccaacagtcttattcaacggcttgataaagaagtcgcttcagcctccggcagacaactttttacacagctgcagtcccacgctgcgctttatcagccttttatggacaaggttgtcgcgcttgcccaacagggtaaaaaagagcaagcggagaagctgctgtcggactctggagacacgattcagaatgaatatatggcgtcgttgcaggcgttaaaacagcatcaggaaacgcggatgcgcgttgctgaacaaacgtcccatgaagacaggaccgacgcgctgaggttactgacgggtgccggtgcgattgctctggtactggccgggttatccgcctggctcatcacccgcagcattacacggccgattaatatggcgctggttgccgcacagcgcgtggcacgcggtgaccttagtgagcccgtactggtgactcacaacgatgagacaggcaagctgctgtcggcgatacgtgatatgcaggatgcactggttcaaaccgtcagtctggtcagatccaatgcggagagcgttgcctctgccagtaaccagatagcccagggcaatgccgatctttcgcagcgaacagaagaacaggccagcgcgctggaacagaccgccgccacgatgacggagctgggaatgacggtgaaaaacaatgccagcaacgcgcaacaggcaagccagcttgcgactaacgtccgtaatgtcgcgcacaaaggcaacgaagcgacagaagctatcactggcacgatgcgaacaatcaaagacagctcgggaaaaatcgctgaaattaccacggttattgacagtatcgcttttcaaaccaatattcttgccttaaacgctgcggttgaagctgcgcgagcaggtgagcatggcaagggctttgccgtggtggcaagcgaagtccggacgctggctcaacgtagcagcaccgcagctggcgagattcgtcagttaattgaggctaatgctcgcagtgtaggacagggcgatgagctggttgccaatgcctccgcaacgatgcagagcattgtgactgccgttgggcatctcagtgacaccgtagaagaaattacatctgccagcgctgagcaggccagaggtgtggaacaagtaggcattgccgtaaccgagatggacagtacgacgcagcagaacgccgcactggttgaagagtccgcatcggccgctaacagcctcagggaacaggccaaacagctgttgcaggcggtttctgttttccgcctcaactacgatcagaagcgagttcatgtcccgcaaacgagtaaaacaccaacattgccaaaatcgaatcagccattgactgatgagggctggacgcatttttaatgcacggcactcgcggtgggagacactatgcataaaacgcgggcggccatcggttctgcccgtcttttattcataccttaatgcggtttatctctctgttgctgcctttctaaaccgacgcacccgcgtcgttttgtatgcgtctgccactatcaggccgccagtgtaggacgcacacctaacgtatgacatatggcatagctcatttctgcccggttcagagtatagaaatggaaatcttttacgccttcgcgtgacagaattttcaccatgtccatggcgatattcgcccccaccattttgcgcgtttcaggatcgtcatccagccctgcaaacatcgcattcatccagcccggcacacgcacgttagtcatggtggcgaagcgctgcaattgtttgaagttagagacgggcagaatgcccggcacgatctcaacatcaataccagtggaaacgcagcggtcacggaaacgcaggtagctttcaacatcaaaaaagaactgggtgatggcacggttagcgccagcatcgattttgcgtttcaggttgatcaggtcggcctgtgcactcttcgcttccggatggacttccgggtaggctgcaacggatatatcaaactcccccacgtctttgagcagagacaccagatcggagccatacatgtccggcttgccgctgcccggaggcagatcaccacgcagcgcgacaatatggcgaatgccgttgttccagtaatcctgagcaataccacgtagctcatcccggctggcatcaacacaggtcagatgcggtgccgcttccaggccggtacgatctttaatgcctttgataatgctgtgcgtgcggtcgcgctcacccgagttcgcaccataggtcacagagacaaatttgggtttcaggctgctcaggcgatgaatggagttccacagcgtttcttccatttcgctggtacgcggcggaaaaaactcaaaagagacattaatccgaccatttagctctgccaggctctgattgagtgcctcgcgctgattggcatgaaagaaactcatcctgctacctccgaccacatcggttaactattcacccgaacacatctatacgtttagacgtccagacattcaaaatgaacgattcccgcattagcgtcaacatataaatcatcactgcaggtgacaaatcttcacgcaacgtgaaaaggcttcatgtaggaggattcattgcagggcaggcgccgaagcgcctgaagaaaagtggggtcagagcaggtgtgcgaggcgattaatatcagactggatagcgccggcagtgacatcacggcccgcaccaggcccgcgaatcaccaacgggttatcgcggtaccagcggctgtcgatggcaaacacattatcgcagggcagtaatgcagccagcggatgctccaggcgcaccgcttcgacgcccacgcgtgctttgccgttggcatcaaaccgcgccacgtaacgcagaaccagccccatttcctgcgcggcttcaaaccgttgcagcatctgttcgttcagctcatccgcattctcgaaaaagtgatcgactgattcaccttcgcaattctgtgggaccagcgattcgacgcgcacctgatccggctcgatgttatacccggcctcacgggccagaataaccagtttacgcatcacgtcctgacccgacagatcgacgcgcgggtccggctctgttaatccctgctgccacgcctgatccaccagctcggtgaacggtaccgtgccatcaaactgtaaaaacagccaggacagggtgccggagaaaatgccgctaatcgacagaatggtgtcgccgctttcacgcaaatcgcgcaccgtatggtttatcggcagcccggctcccacggtggcgttatacaaccagtgacgaccggttttttcaaaggcatcccgaatctcacgccaggtttgcgtatccgatgcgcccgccaccttattcgcgctgatcacatgaaacccatggctggcaaaatccaggtactgcagagccagcggctgactggccgtcacatccagcaccaccaggtcatcatacggatgggcccgcatccacagaaacagcgattcttcatcgcgcgcttcggcttcatcgtcaaagaaggccagtgcacggctggcatccagaccgtcatagctcagcaggctgcgttgactgtccacgacacctgccagcacaaactcaaaaccggtgcgtgccgacaacgtttcctgctcacgggcaaacaactccaaccagcgtgaaccgatattgcccttgccgaacagcatcaggccaatgcgtttttccgcacgaaacagcgagctgtgcagcccctgaatgagatgctgggtggggccaacgcgcagcaccgcaaccacgctgatgtgctccggcgactggctgatgaattcaactggctgatctttcaactgctgccagaaacggtgcgtgtgcaacggattgcgggtaacgccagctccgaccagggcgaccaacgctaaaccctcgcgtaactgcaaatgtccgggcaagcctgcatcctgcaacagggcaaaggcactgtttaccacttcagaggtgtagcaaagttgcagcaattgacggtcaggatggatgcccatcgccagcggccgcatctgcgcgcgcgtcaggagttgatcgatctcttttttgaagagagcaaaatcgtgctgcccgggaagctggatctcaaccaggcacacatcgtcgtgactggtgacaatgcgggcacccgtgccggacgcaaggacgcgctcgatgcgggttgagccttgctcaggctgatagctacagcgcagttgcaaatcaatatcactgcccgaaaccggttgtaaggtgcgggtgtgcagcactggcgcggcaaggcgcgccagctcactggcttcatccagacgcagcagcggcagcagacaggcatcagagactttgcgtggatcggcgctgtaaacgcccgccacatcactccagatagtgacgcgtcccacgcccgccagcgcgccaatctgagtggctgaatagtcagacccgttgcgccccagcaggaccgtttcaccggcatcgttgccgctgataaaaccggtcaccacgatgcgtttatgcggatgctgggccagcagcgtttgtaacaatggccaggatttaccttcgtccacctgaggctgcgcggcacgttccgctcgcagaaaatcgcgcgcgtccagccagcaggcatggagatcctgctggttcagcaccgctgacattaaacgtgccgaccagatttcaccatgcccaaccacttccgcatacaccgcttctgtgatgtcaccatccagtagcgcggccagtttttcgagatcgcgaataaaggcggtaattaacggctcggctatttcagcaggcaacagtgcactgattagctcactctgatagcgacgtaatgtctgctgcacctgatgtgcggacaggcggtcactttggctcagtttcagccagctaatcagctgattggtcgtcgaccctgcggccgataccaccatcatatcgccaggctggctgtaatccgccatgatgctggcaacacgctgatagcagcgtgcatctgcaaggctgctgccaccaaacttgtggagctgtctgttgtttggcgttcctgcgcctgctgaaatcgtcatgatcaatcctcggctgcgatccggaatgcattatccaaatcggcaattaaatcgtcgtggtcttcaatacctactgaaatacggagcaaggtttcagagatacctgctgcggcacgggcctctgcagacatgcctgcatgcgtcatggtcgcagtatgtgaaattaagctctcaacgccacccagcgattccgccagcgtaaacaactcaagtgctttaagaaaacggcgcaaccgggcttcgtcacccttcagctcaaagctgagcatggcaccgaatccgcgctgctgacgcgcagcgaattcatggcccgcgttttccggcagtgacggatgatacaactttttcaccagtggctgttgcttgagataatcaacaatggctaacgcattacgctgcgcggctgccatacgcggccccagggtgcgcattccgcgcaacagcagatagctgtcaaaggcggaaccggtgacgccaatgttatttgcccaccaggctaaatcggtcgccacctgcggatctttggcaataacggcaccggccaccacatcggaatgaccatttaagtatttagtgcaggagtgaatcaccagatcggcacccagtgccagcggattttgcagggccgggctcataaaggtgttatccacgacgctgacggcacccgcagcctgcgcagcttcgcaaatcgaggcaatatcaacgacgcgtaacaaaggattgctgggactttcaatcagcaccagtttaggtttctcgtccagcgccgcctgcagtgcggctttatcgccttgatcgacaaatttcacccggtaggcaccgcgtttgctcagactgtcgaacagacgatagctgccaccatagcaatcgtgtggcgcaaccagcagatcgcctggcttcaggaacaccgtggtgaccagatgaatggccgacatgccggtattggtgagtaccgcccccgctccgccttccagttctgccagcgcgcgttgcaccacatcgcgcgttgggttaccgcgccgggaataatcatgggcacgaggttcattgaagtcatgaaagttataggtgctggaaaggtggatgggcgggacaacgcagccgtattgctcgtcgtcattcaaaccgctgcgcactgcgatggttgcctgtttacgcgtcatagggctaactgttcctgaagtgtgaaataatctgacgacaggatatcaccttgcttttagacgtcaatacatctggacatccaaatgtctttgcgtatagattgagcatcgtcgcaataaccgctaaaattatgcgcccatacctggcgttcaaccacatttgtcgcagaagttgaacgaagaaacccgccagagaaggggtcaggtagaagaaaatcaggcataatcggctgatttcgtaacttttaacatttattgattaaggtatcccatggctgaatggaacggcgaatatatcagcccgtacgctgagcacggcaaaaagagcgaacaggttaaaaaaattacggtgtcaattccgttaagcgtgctgaaaattctgactgacgaacgcacacgtcgtcaggtcaataacctgcgtcacgcaacgaacagtgaactcctgtgcgaagccttcttgcatgcttttaccgggcaaccgttacccaatgatgtcgatcttcgtaaagaacgtaacgatgaaataccggaagctgcgaaaaaaatcatgcgcgacatgggcatcgacccggatacctgggaatactgattttcagacataaaaaaacccagcctgagctgggtttttcttgccgccgaacagatgttcgaatgccgtttcttattttttggtgcctggcacgctgaaacgcttgttgaagcggtcaacgcggccaccagtggcaacttcacgctgcttaccagtgtagaacgggtggcacttaccacaaacgtccaggttcagttcgtgagtcagcgtagagcgagtgtgaatcacgttgccgcaagtacagttgatggtaactgcttcgtattttgggtgaataccttgtttcatgggaaacctcatataaggccgtgtcgctctccgcgccaggatttgaacctgcgcagcaccacacgcgattgaacattaatggtgtactccggcaaggtctttcttaccgaaggcggcatattatacaggctaatgtttgatgctgcaaatgtcacctgagatacaccccgcgcgtgccagcgtgtacactaaccgccctgctagatgaaccggaaagagattgctatgcccgttgttcaggttgccctgcccgttccccttcctcgcctgtttgactatttgcctcctgacggcgtgcagccagtcatcggtggtcgggtgatcgtgccttttggcaaccgaaaaatgaccggcattgtggtcgcgttacctgacaaaagcgacctgccggcagcacagctcaagcaggtcattgccgtactggacagcgaatcgctatttccgccctcactgtggcggattcttcactgggccgcgaactactatcattcgcctctcggcgaggtactgagccatgccataccggtactgctgaggcaaggtaaacccgctcaggataatcctttatggcgctgggaaattaccgagcagggccgcgccaccgcgccggaaagccttaagcgggcgcctaaacaacagcaagggcttgcaacgctcagacagcagccgctttatcgccacgaagtgagtgagcatgaccttaccgatgctgccatgcaggcactgcgcgccaaaggattgtgtgaactgcatgagcatcagccacagatgcatgactggcgcagcagctttgccgttaaaggtgaacgtcttcggctgaacaccgatcaggcgacggcggtcggcgcgatgcggagtgaagatgaacattatgctgcctggctgctggcagggattaccggttcaggtaagaccgaagtgtatctcagcgtactggaaaacgtgctggccagaggcaagcaggcgttggtgctggtgccggagatcgggttgacgccacaaacgattgcccgtttccgcgagcgttttgatgccccggttgatgtgctgcattccgccctgaatgacagcgagcgcctttctgtatggttgcgggcgcgcaggggcgaaaatgccatcatcattggcacacgttcagccctgtttacaccgatggcacgtccgggcgtgatcattattgatgaagagcacgacagctcttacaaacagcaggaaggctggcgctatcaggcacgcgatctggccgtgttccgcgcccatgaagaaaatattcctattatcatggggtccgccacaccggcgctggaaacgctgcataacgttcgtaacgggaaataccgtcagcttgacctgatgaaacgcgccggtaatgccaaacctgctctgcagcagcttatcgatttgaaaggcgcacaactggtcggtggcctcgcacctgccttgatcgctaaaatgcgtcaacacctgaaagcagataaccaggtcttgctgtttcttaaccgccgtggtttttcaccagcgctgctctgccacgattgcggctggattgctgagtgccaacgctgcgatcgctattacaccctgcatcagcatcatcgccaactgcgctgccaccattgcgacagccagcggccgttgcccaatcagtgcccacaatgtggttccacccatttactccccgtgggcgtcgggacggaacagcttgagcaacaattgggaacattattccccggcgtgccggtttcgcgtatcgatcgtgataccaccagccgtaaaggcgcgctcgaacagcacctggccgatgtgcatcgcggcggcgcgcgtattctcgtgggtacgcagatgctggcaaaagggcatcattttcctgatgtcaccctggtgtcgctgctggacgtggatggtgcactgttttccgctgacttccgggccgcggaacgcttcgctcagctctatactcaggttgccggccgcgcagggcgagccggtaagcagggcgaggtcttgctgcaaactcaccatcctgagcacccgcttctgcaaaccctgcttcataagggttacttcgctttcgcacaacaaaccctgctggaacgtcagtcggtgtttttaccaccgtggacgcatcatgccctgttccgtgcagaagatttagataatcatcaggctgcagaatttctgcaacagctacgcaatatgctggaatccagcccgcttaaggacgcgtcaatgtggttcatggggccgctgcctgcgctgcaacccaagcgaagtggccgctggcgttggcagttactggtacaacatccgtcccggaaacgcctgcaacagctgttgagcagttcgttaccgctgataagtacgttacctgcatcgcgcaaggtaaagtggacgctggatgttgatccgaccgaaagctgagtccggtgaggttgtgagagggatcgaaatacgtcgcataagtcacaatttttatgcaaattaagtaacggccctgccgcccaatcgataacaatagtgccaggcttgttttcacatcagacgatacgaacgttgaatgcgcgattacgcatcaggagcatgtgttggatcagaatcaaccgtcggccgccgccacgatgaaagacgtcgcagaaaaagccggcgtctcgaccgccaccgtgtcgcgtgcgctaatgaatccggaaaaagtctcttcggcgacgcgtcagaaagtcgaacaggccgtcgctgccgtcggttataccgctcagagtgtaacccgcaatgcccgacgcaacgacacacaaactattctgctgatcgtccccaacatctgcgatcccttttttagtgaaattattcggggcgtcgagatagccgcgtcgaaggccggctatctggtgcttatcggcgactgtgctcatcaaaaaccgcaggaatggacgtttttaaacctgatgctgactcgtcagatcgacggcattgtgctgctcggcgcgcagttacctttcgatgtgagtcctgatgaacagcgcaatctcccaccgatggtgatggcgattgaatttgcgcccgaaatgtcattgccaacagtcaatatcgacaacctgacggcctcgtttgtagcagtcaatcatctgctgcagcttggtcataaacgtattgcctgtctgaccggcccggaagacgttgcgctctgtcagtatcgcctgcagggctatgtacaggcgttacgccgcagtgggatcagcgtggaaccgacttatatcgtccgaggcgacttcacctttgaatcgggtgttgccgccatgaatcagctgctggctttaccgcaaccgccgcgcgccctgttttgtcatagcgatatcatggccatcggcgctatcagtcaggcaaaacgcatgggcctgcgcgtgcccgaagacctgtcggtagtgggttttgatgatattgaactgtcgcgctactgcgaaccaccgctcaccacggtgaaacaaccgtgttttgaaattggtcgtgaagccgtacggctgttactgaatgaattacagggtcatggcgttcacaatggttcgacattgctggatgctgaactggtggtccgtggtagcacaacattggcaaaaaaggatgagtgataagtaaaatgttccgctattttcaggggattcttaaggctatcattgctggtcaaagttccagcccttaagtaacatggcgggctccttgccgggcgtgcagtaataacggattcgcctacgtggcatcatattttcaagggtatcaggacgagagtggcacaaaaagattatgtaggccgcgggcgttcaacagggacgcgtcgcaaaaaaagccccagccgtggcaaaaaaacaaaaagcggttcaggcacctctaaaataatgattgtactggcggttgctgtattagtgacctttgccggtggtttatggttcctggcgcatcataaaaaagaagatgtgccggttattacggatcataaagccaacgggaatggcttaccgccaaagcctgaagagcgctggaagtacataaaagagctggaaaaccgccaggtcactgtaccgacgccaagtgaaccgacctccggtggcgaagtgcagtcacatacacagctcaccgatgagcaacgccagctgcttgaacaaatgcaggcggatatgcgccagcaacccacccaactgaatgaagtgccgtggaacgagcagacgcctgcacaacgtcagcaaacgctgcaactccagcgacaacagcaacttcaacagcagcaactgcagtcgcagcagcgtcagcagcagatacaacaacagcagcagcaacgccagcagcaggtacaacaacagcaacaacaacgccagcaacaggtacagcagcagcatcagcagccgttgcaggaacagcatactcagcgtcagcaacagcccacgcagaacgtgcaacagacacaacctgctcctgtcacgcgtgaacctgccgctcagcctaaaacgcaggaaaccgcgaaagcgaaaccggccgaaaaagccactacgcagcgctggatggtgcagtgtggctctttcaagggaacagaacaggcggaatcggtgcgcgctgcactggcgtttgaaggttttgaaagccgtctgacgtccggcggtggatggaatcgtgtcgtggtagggcccttcaaagaccgcgccagtgcagacagcacgctaaaacgtctgcgcgcttcaggacattccggctgcattccgctcgccgttgggggttgaaacccgtcaaacctaccccatatctgtctgcatgatcctccgcgccttgggcgcggagcttttttccgacagtaaaaggggtctgcccgtgacaacaatagtaagtgttcgacgcaacggccaggtagtgattggcggtgatggccaggctacgctcggtaataccgtaatgaaaggcaacgtcaaaaaagtgcgtcgtctttacaacgataaagtaattgccggctttgctggcggcaccgcagatgcctttaccctgtttgaactcttcgaacgcaaacttgaaatgcatcagggccatttggtaaaagccgccgttgagctggccaaagactggcgcaccgacagaatgttgcgccgtctggaagccctgctggcagtggccgacgaatcggcatcactgattatcagtggtaacggtgacgtcattcagcctgaaaacgaccttattgctatcggttctggcggtcccttcgcccaggcagctgcacgtgcgctgttagaaaactctgacttaggcgcacgcgacatcgttgagaaatcgctgaatatcgctggcgatatttgcatctacaccaaccacaacgttaattttgaagaattaacgtccaagtcgtaaggatctaaacatgtctgagatgactccacgcgaaatcgtcagcgagctgaaccgctttattattggccaggacagcgccaagcgcgccgtggctattgccctgcgtaaccgctggcgccgtatgcagctggacgaagagctccgtcacgaagtgacacccaaaaatattctgatgatcggcccgaccggtgtcggtaaaaccgaaatcgcccgtcgtctggcgaagctggccaacgcgccgtttatcaaggttgaggccacgaaattcactgaagtgggttacgtgggtaaagaagttgattctattattcgtgacctgactgactccgccatcaaaatggtgcgcagccaggctatcgaaaagaacaagtaccgtgcagaagaaatggcggaagaacgcatccttgatgtgctgattccaccggctaaaaacaactggggacaagccgaacaagccagcgagccctcttctgctcgtcaggctttccgtaaaaagctgcgtgaaggccaactcgacgacaaagaaatcgagatcgacttagccgcaaccggtcctggcgttgaaatcatggcaccgccgggaatggaagaaatgaccagccagttgcagtcgatgttccagaatctgggcggtcagaaacagaagccgcgtaagctgaaaatcaaagaagccttgaagctgctgattgaagaagaagccgccaagctggtgaacccggaagagctgaaacaggatgctatcgacgcggttgaacagcacggcatcgtcttcatcgatgagatagacaagatctgtaagcgcggcggacaaaacgcgggcggcccggatgtatctcgtgaaggtgtacagcgcgatcttttgccactagtggaaggctgtaccgtatcgaccaagcacggcatggtcaaaactgaccatatcctgtttatcgcgtcgggtgcgttccaggttgccagcccgtcagatttgattcctgagctgcaaggtcgtttaccgatccgtgttgaactccaggcgttgacggttaatgatttcgaacgcatcctgaccgagcctaatgcctcggttacggtacagtacaaagcactgatgaataccgaaggcgtgagtatccatttcacggatgacggtatccgccgtatcgccgaagcggcatggcaggtaaacgaaaccaccgaaaacatcggtgcacgtcgtttacataccgtgctggaacgcttgatggaagacgtctcctatgacgccagcgatcgtagcggcgaatccgtcaccatcgacgcagagtacgtcggcaagcatctggatgaactggtggcagatgaagatttgagccgctttattctgtaacgctcgcctgtccatgtgttatatcaaggcccagcccgtttggttgggcttttttctgcatgcgcttgatgcaatacaggtcttttaaagctgatgattttgccaacaattgacataaagcgatatacttagcgctcctgtggcaaacagacgaaacccttatgaaatacgatacttctgaactctgcgacatctaccacgaagacgtgaatgttgttgaaccgcttttttcaaatttcggtgggcggacctcattcggcggtcagataaccacagtgaaatgttttgaagacaacggtctgctttacgatctgttggaagaaaacggtcggggccgcgtgttgctgattgatggcggtggttcggtacgccgcgccttagtggacgcacaacttgcccggctggcgacgcaaaacgagtgggaaggcatcgtggtttacggttcagtgcgtcaggtggacgagctggaagagctggagattggcattcaggctatcgccgctattccggcaggcgccgcaggtgaaggcattggcgaaagcgatgtgcgcgtcaattttggtggcgtcaccttcttctcaggcgaccatctctatgctgacaataccggtatgattttatcggaagatccgctcgacatagaataatgtcggcaaacgaaaacgggtgcttagcacccgtttttcgcattagttgaggcttatacctcttccatttttcccaacagcgcacgcaggcgttcttgccagacatgctgctcctctttcagatgctgattttcgcgcaccagtgcttcatggttgccagcagcattctgcgcgtcgttacgcaggttgttgttctgctctttcagctcttcaatttccatctgcagcaaggtgatagtatcaatcgcctgctgtacttttgcttccagtttctcaaacacttcaaatgacatctttctgacctctcctaaaatcctgcaaggcgttgatgatgccagctttcgcacaaaaggcgtttaccagcaacgttgtcccgattgtatgtagcctcatcacgcaagtccagcaacgcgggcctgcagaccgccgtcagtaacatttttcagcctatccctaaaatgttccttttccgtacgtttgcttagcgaagccggaataacgctgctgaaaacggcctgaatggcgcttaaggaaaaccaaaacacgcgaaaacgcgcatttttttgacagaccacacaaaaatcgatttcgctatttctcgtttatgctcgttaacgataaattaacatcagccctacattaaagatgggcggctcaaggaatgagaacaaaaactgataaaatttaacctcgcttcaggaacaactatcatgagtcagactacaaccacactcaaaggtcagtgtattgccgaatttctgggtaccggtttgatcctgttttttggcgcgggttgcgttgccgcgcttaagctggctggtgccacgtttggccaatgggaaatctgtatcatctgggggctggccgtttctatggcggtttacctcagcgcaggtgtgtcaggtgcccatctcaaccccgccgttactgtcgcactctgccttttcgcgaatttcgaaggtcgtaaggtattgccttatatcctgtctcaggttgcgggtgccttctgtggcgcggcgctggtttacggactttactacagcttgtttatcaatttcgaacaaagtcataacatggtacgaggttcagttgaaagcctgagcctggcgggcattttttctacctaccctaatccacagattggcgtaggtcaggccttcctggtagagatggtgatcactgctgtcttgatgtccgtgattatggccctgaccgatgatggcaatggcgtaccgcgtggcccgatggcaccgctgttgattggccttctggttgccgttattggcggctctatgggtcccctgaccggctttgcccttaacccggcacgtgacttcggtccgaaagtatttgagtggctggctggctggggaaccattgccttcactggcggtcatcagattccttatttccttgtgccaatttttggcccactggtcggtgcttgcctgggtgcctttggttatcgcgccctgattggccgccatttaccgggtgcggtgatcgccacaccaaccagtgacaaaccgattgcgtccgcgcatgaacgtaaagcgtaagttccactttttatcatcaggaatgaatttatgactaccaccgataaaaaatacatcgtcgctctcgatcagggcactaccagttcacgtgctgttgtgctggatcatgacgcgaacattgtggcggtatcgcaacgcgaatttacccaaatctatccgaaagcgggctgggtagagcacgacccaatggatatctgggcatcacagagttctacactggttgaagtccttgcccatgccgatattcgttctgatgaaattgcggccattggtattacgaaccaacgtgaaaccgccattgtctgggataaagaaaccggtaagccggtctacaacgccatcgtctggcaggacccgcgtactgctgactactgtaataagctgaagaaagaaggtctggaagagtatattcagaaaaccaccggtctggtgattaacccttacttctccggcaccaaagttaagtggattctggataacgttgaaggcgcgcgtgatcgtgcaaaacgtggcgagctgctgtttggtacggttgacacctggctggtgtggaagatgacccagggccgcgtccatatcaccgattacaccaacgcctcacgtaccatgctgttcaacatccataagcttgagtgggatgagcgcatgctggagatccttgatattccgcgtgagatgctgccagaagtgaaatcctcgtctgaggtttacgggcagacgaacatcggtggtaaaggcggtacgcgtattcctatcgcgggtattgcaggcgaccagcaggcggcgctttacggccagttgtgtgtccagccgggtatggcgaaaaacacctacggcaccggttgctttatgctgatgaataccggtaccgaagcggttacctcaacgcatggcctgctgacgactatcgcctgcggtccgcgtggcgaagtcaactacgcactggaaggcgcggtctttatcggtggcgcgtccattcagtggcttcgcgatgagatgaagctgatcagcgattccgctgactctgaatactttgcaatgaaagtgaaagattctaacggtgtgtatatggttcccgccttcaccggcctgggcgcaccttactgggacccctatgcacgtggcgcgctgttcggcctgactcgtggtgccaatgctaaccacatcatccgtgcaacgctggagtccattgcttaccaaacgcgtgacgtcctggaagccatgcagaatgatgccaacacgcgcctgcaggcactgcgtgtggacggtggtgcggttgccaacaacttcctgatgcagttccagtcagacattcttggtacacgcgttgagcgtcctgaggtgcgtgaagtgactgcactgggtgccgcgtatctggcgggtctggccgtgggcttctggcaggatctggaagaagtccgtgccaaagccgttattgagcgcgaattccgtccaacactggaaaccacagagcgtaacttccgttatgctggctggaagaaagcggttgctcgcgcgcaagcgtgggaagaacaagagtaatacgcactacgcccgcgacgtccaccgtcgcgggtcttttccccgcctcctccctccgctaaactgccagcctgttttttgtcaggtacatgcaatgaaacgagaacttgccattgaattttcccgcgtaaccgaagctgctgcactggctggttataaatggttagggcgcggagacaagaatgaagccgacggtgcagccgtccacgccatgcgccatgttttaaataccatccagatcgacggccagattgtgattggcgaaggggaaattgatgaagccccgatgctctacatcggcgaaaaagtcggtaccggccagggcgatgcggtggatattgccgttgatcctattgaaggcacccgtatgacggccatgggacaggcgaatgcacttgccgttatggctgtcggtgacagaggcagttttcttcatgcgcctgacatgtatatggagaagcttatcgtcggcccggcggcgcgcggtcatatcaatctggatctgccgcttgagatcaacctgcgcaatattgccatcgccatgaataagccgttgtcacagcttaccgtgtccattctggcaaagccgcgccatgacgccgttatccaacagcttaagcaactgggcgtacggatattcgctttcccggatggggacgtggcagcctccattcttacctgtatgcccgacagtgaagttgacgtgatgtacggcattggcggtgcgcctgaaggcgtggtgtccgctgcggtgattcgtgcgctggatggggatatgcagggcagattactggcccggcatgatgtaaaaggtgacagcgaagagaaccggcggattggggaatatgagctgaagcgttgtgccggcatggggattgaagccggcaaggtgctgccactccaggcgatggcgcgtaacgataacgtgatctttgccgccaccggcatcaccagcggcgacctgctgaaaggcattacccgtcagggcaatatggccaccagcgaaaccctgttaattcgcggcaaatcgcgcacgattcgccgcatccagtcagtgcattatcttgaccgcaaagatcccgcactgcacccctttatcctgtaaccgcatgattttcgccggctggctgccgtgaaagcgggagccagcatagcaacatcaccagggcagtaataaacatcagcatgccaaggctgaactgatcgcgctgtggcatgagcgccgacagcgaagccaccagcccggagcccaggttctgcagaccaccaatcaatgcgcccgcgcttcctgccagccaggcataaggttccattgcgccggatgtcgccaggggaaacaacatacccgcaccaaagaagaacagcgatgccggtaccaacagcgtccagatagtcatgatgccaaaccaggccggtacccacatgagcaccgccgccagcaggcaactgtttaccccaaaccacatcaggctgtgccaggaacgctgctcgcgcccggcgaaccaggcaccaaagaaggcggccgggataggcaagataaacaaaatactcacggtgaaactgttcaggccaagcacgccaccgagaagtacgccacagctggcctcaaatacggcaatgcccgacagcgcgccaactaacagcagcagatagcgaacgaaattcgcatcgcgtaacaaccggatatagcgcgtaaagaacggggtgacttcggtagtgacggggcgcgtttccggtagccagcgcgccatagcaatcgtcacgatcagacacagcaccagcagaaaagcgaaacaggcatgccagccaaacagctgcgttaacagcgcgccaataactggtgcgactaaggggctggcgagcacgcccatgttgagccagctgttcgcctgacgtaaggcatgaccgttatagaggtcgcgcggcatagtacgcgccattacgccagccacgccggtgcccgcgccctgaatcgcactgccgagcaccagcatatccagcgacgaggccatcatggcggtgatcgagccgatcataaagatcgccattcctgccaggatcaccgggcgacgtccaacgctgtcagacagcggtccgtagatcagctgcgatccgccataggtgattaaatacgccgccatcacatgctgcatcatgccattacgcacctgcagcgcatccgccatcgccgccatggcgggcacgtagatggtctgcgccatttgccctactgcaaccagcgcaatgagcatgaccagcaacggacgattttctatttttttcatcatgattgaacaaaaggtctgtatgaacatgaacgtttaagcagcacaaataacggctgaaacgggttgtggcaggaaaatatcaggatttcatgacaaagcgagtcattaatgaaaagtgagtgttcaattcacgtcaataatggctaccaggttgtaaacttaacaatacagtttgtcgattagagcctttgcagcctgacagactggtaatctgccagtgcagtagagaagatgcttattcgcctgacgattcaacgctgaaggagtaaccatggccgagtggatcaatgctcaagtaaaggaagtgaaaaactggaccgacgcgctgtttagcctgcggattaaggcacccattgctccgtttagcgctggccagtatgcaaagctggcgctggagatccagggcgaacgcgtgcaacgtgcctactcttacgtcaatgcaccgaatgacgacctgcttgagttctacttagtcaccgtgcctgacggtaagctaagcccccatcttcaggcgctgcgtcccggtgagcaggtcatgattaccaaagatgctgcgggcttttttatcctggatgaagtgccggactgtcagaccttatggatgctggcaaccggtacggccgtcggtccttatctgtcgattttgcagcagggcgacggtctggatcgcttcgataacatcgtgttagtgcatgccgcgcgttacgcagccgacctcagctttttgcctctcatgcagcaacttcagcaaatctacaacggcaagctgcaggtgattacggtcgtcagccgtgaagaaagtatgggctcattgaccggtcgtgtgccagcattaatcgaaagtggcgagctggagcgggcggccggtttacctatagaggcagaaaccagccacgtgatggtctgcggcaacccgcagatggtacgtgacacgcagcagttgttgaaagagacacgtggcatgcgcaagcacctcaagcgcaagcccggtcatatcaccagtgagaactactggtaactcgcacgtttcagacgtaaaggcaccggcgtggcaccaaagcggttatcgccggcggtgccacgaaacacgcccaggtccagaatgaatcctgccagaatgataaaaggcagcacgcgcccgatcacccactgcaggatatcgccggtcatgctccagttgcccgccatcagcagccaggcggcaatcagtaacagcgcccaataaccccggcgatcgcgatcgtgcaggcgcttaaccaggatggcgctggcgggccacaataaacacacgatgccaaacgcggccatttgtgtatccaccagatcgttaccggccagaaaaaacagcacgctggttaacaataaccagatcgcctgccagagccagaaatcccggcgcccgatgcggccccgaaaagagaaaaaccattgctgtaatatcatgcacgttcctccagacaaaattttacgctgcacgcttttgaccttgaaggtaaaaaccgttctaatttgatatcgagtttattggtcagggccgacaacatgaagaatttgccaggcgtactgttgctgagtcttgcgctaacggttccggtttttgctgccgatccgccccccctcgacaaggcagaacatatgcctaccgcgccctacctgttaacgggtgcgcccacgctggatatgactatcggccagtttcgtgaaaaatataatctggcgaatccacaactgccgctgctggagtaccgcgccattgattcccgcgatgaaaaaaccgatctgacgcgggcagccaccaagattaacgaaacgctttactcttccacggcgcttgagcctggcacgggtaaaattaaaacgctgcagatcacctggctcccggtaccgggccctgatcagagtgcgtcccaggccaaagccatggattatatgaccgctctgttacgtttttttgtgccgggactcacgccagaagagggacgtaaaaagctggaaacgctgtttaaatcgggcaaaggctcacgatactacgagcacgttgaaggtgcactgcgttttgtggtttccgacaacggggataaaggattaacctttgctattgagccggtaaaacttgcgctcgccgctccctgatggtcggggcaaaaatgacgaaaagcaaagccacgacgttatttgatctctatactgtctggcagacaacgttgccccggggcagcgccatttcatgtatcgcgttatgcggaggatagaatgcgacatccactggttatgggtaactggaagttgaatggcagcaagcatatgacagccgaactgatcgacggtctgcgtaaagaactgtcgggcgttgagggttgtggcgttgctatcgccccgcccgcgctctatcttgatcaggcgaaacatgccatctccggtagccacatcgcactgggtgctcaaaacgttgatgtgaacctctctggcgcattcaccggcgaagtgtccgctgaaatgctgaaagatatcggcgcgaaatacatcatcattggtcactcagaacgtcgcacttatcataaagagagtgacgagttcattgcgaaaaaatatgccgtgttgaaagcgacgggcctggtgccggttctttgcatcggtgaaaccgaagcagaaaacgaagcgggcaaaacggaagaagtctgtgcacgtcagcttgatgccgtgctgaccactcaaggcgctgaagcatttaaagacgcggtcatcgcttacgagccggtatgggcgatcggtaccgggaagtcagccacacctgctcaggcgcaggcggttcacaaatttattcgtgaccatattgccaaaaaagatgctgccatcgctgagcaagtgattattcagtacggtggttcagttaacgataaaaatgctgccgagctgtttactcagccggacatcgacggtgcactggttggtggcgcgtcactgaaagccgatgcgtttgccgtgatcgttaaagccgctgcggcggctaaacaacgctaaccggcgattaagcacagcataagcggcctcatcaggccgctttttttatgggttgtagcagggcgcagtcgtgatcctgcacctcctctgccgatcccttattcagcaaaagccagttgcgctctaccgccatcagcaccagacgaccatctgataagccggtcagtgccatgccgtatttccccattgcattcttagcatccgggacttcagacgctaaccggataaagacactctgttgatccagttccgcctgactgagcacccgcacaatatagtgatggttcagaaaggtaacatccttccactgcgcattgagagtcggtgccagtccatccagttgctgacggacatcgggccgtaagcaggaaatatgaatatgcagctggttttgggtacgcccgtattcggaattgatcgccagcgacagcacagtgtctttaatgggcgaaccgagtttctgcgccactacgcctctgtcctgccaggcaaagctgaaaaaattgggtgtggctgcgctgagcaaccgcgggctttcgatgccggttatcttatcaacgggaattaacaggtattgcaaggggccgttacggtctttgagcagtgtataacgctgctgcagatcgactcgctcgcaaggcgcgggctgcccgttattctgctgattgggtacgcacttttcgctgacgatctgccaaagcgcatcggcattgcctttaacatgaagggaagctatccccattcctgccacgacaagcaccagcagaaacgcaatgatgatgaaggcccgacgatttgcctgcatagttaccctctccatactgaatcagtcagcatcctcgcctgacagcgccggaatgtcacgcataaaaaaaccagcgtttccgctggcttagattgtgtcagtcaatcgttacggcttcatgacctggtcataggtgccgccgtccgcgaaatgggttttttgtgctttagcccaacccccgaatttgtcgtccacggtaaacagttttacaggggcaaaggtgctggcgaacttcttcgcaacctcagcattgcgcggacgatagtagttttcggcggcaatcgtctgtccctcggtcgagtagagatacttcagataggcctcagccacggggcgagttcccttttcatcaaccactttatccaccacggaaaccgttggctctgccagaatagactcgcttggggtcacgatctcaaatttgtctttgcccagcttattcacggccaggtacgcctcattttcccaggcgatgagaacatcaccgatgccgcgctcaacaaaggtgttggtcgcgccgcgcgcgccggagtcctggacttcgacattcttaaacagggctttcacatagctcagtgcttttgcctgatcgccgttgttgtgatccagcgcccagccccaggctgccaggtaattccagcgagcaccacctgaagttttgggattaggcgtgatgacggaaacaccgggtttaatcagatcgttccagtcatgaatccctttgggattgcctttacgaaccaggaacacaatcgtggaagtatagggtgccgaattatccggcagacgcttaatccagttcttatcaatacgaccacgttcagcaatggcatcgatatcagactgcagcgccagcgtcacaacgtcagcacgaatgccgtttatgacggatgtcgcctgtttgcctgaaccaccatgcgactggcggaccaccacgtcatcgcccgtttcctgtttgtagtgcgcactgaaggccttgttgtattgctcatacagttcacgggtgggatcgtaagaaacgtttaacagctggatatccttcgccagaacactgcctgatgccagtaacaagctaataccaatggcccatttattcattacgcactctcccagttcattatgggacaagcgtgacataaactttttcagagctaaaagaattaaaaataaacggttataactttggggaatataggaaaggcgtaagggcataccgttaagcatgcccgttaaggctgagaaaatcagtaaagctgtttcgccgtatccatccagtcacgtttgaacggacgcttcatgttctcaatcgcatcgatgatatcgtgatgaaccatcttgtcgttctgaatacctacgcaacggccaccgtagccctgcatgagcagttcgatggaataggcacccatacgggacgccagaatgcggtcataggcacaaggcgcgccgccacgttgaatgtggcccagaaccgtggcgcgcgtttcgcgtttggtttcagtctcaataaagcgcgccagatcgtcgatgtcacaaatgtgctcagtgatggcaacaatcgcatgctttttgcctttcgcaataccggctttaatttctgccaccagctcttcgcgggtgtatggaatttctggcaacacgataaattcgcacccgccggcaatggcggcagccagggtcaaatcaccacaataacggcccatcacttcgacgatggagatacgctggtgtgatgaagaggtatcgcgcaggcggtcaatggcttcaaccaccgtctccagtgccgtaaaatagccaatggtgtaatcagtaccggcaacatcattatcgatagtgcctggcaggccaatacaggggaaccccatctcggtcagtcgcttcgcccccatataggagccatctccgccaataacgacgagcgcatcaataccgcgttttttcaggttttcaatggccacctggcgaacatcatcattacgaaactcaggaaagcgcgctgaacccagaaaagtgccgccgcgattaatcatatcggacacgctgtaacggtcgagattgatcatgcgatcttcgtacaaaccctgatagccgtcatagataccaaaaacttccagcccttcacttaatgcggaccgaactacgccgcgaatggctgcgttcatgcctggggcgtcaccgccgctggtcagtacaccaatttttttgatcatgacaacctctggattgttcaaagctaagggttaatccggcctgttcaacgctgataaacacgattgtgatgagcgcgacatatgatggcagatagtatatcaaaggcctgcggctgaattgattcaggtcagacaacttttcactaattttttgcagtaatgttaacgatatgccgtttccattttgttaacttaattcatgtaagttaaaagttaaaagaatcctgcttttcaaacggtaccacagaacagggatcctgatgaataatgacgtccgaaccgggaaaagcttttcgcagcgctttctctacctgatcggcgatacgatgtgcctggacgagcggtagctgatcttcaagctcaacgtgaagctggatgaactttgtcgggccagactgacgcgttcgcacatcgtgtatcccctgcacgcccggccagttggatgaaatcgaaatgatttgttgccgctcttcgtcgggtaaggctctgtcgagtaacgactgtaccgcctcataacccatacgcaacgcactaaaaagaatatagacaccaatgccgagtgcaaacagcgcatcggcacgcgtgaaaccgtagctgcttaatatcagcgccaccagaatagcgccgttcataaacacatcggactgatagtgcagcatatctgcccgaatggcctggctgcgggtttttcgcacgacccagcgttgaaaggtgaccagaaataacgtcgaaaccagagccaccagggtcacaatgatcccgatgccgggcgagcgcagttcattgggggacgcgagatgctgaataccggtgagaaagaggaaaagtgctgaacccgaaataaacatgctttgtgccagtgccgccagtgattcggctttaccatgaccaaacgtatggtccgcatcggcaggctgtaaggaataacgcaccaccagcaggttagtaagagaagcggcgatatcaaccaatgaatccaccagcgctgccagcaaactcaccgatccggtgtaccaccaggcaaaaatcttcacgatcaacaggatggaagcaagcagcgtcgccgcaactgccgcagattgtattaactttccgtacgaagcctgcatgccatcactccatggacatcattactgagaacgtaaaacagaatgagagaagggataagtttaacaccataggcagcgttgcgcctgactgttcaactgccatggagagtcatgaggaaggtgtatttcggaagggaattagcctggtacttcgccccatcctgatgtaagacggggcgaattgcctgtatgaacaggcgccaaatcaacgtgcagatttggttcagtgcttagcagccgttactttttgccgcctttcttgcccgcttcggaggctttttcggggttatttttgaaattaccgccgccgccattgccgctgctcttaccgcctttcttaccggcttcagacgctttttgcgggttgtctgcgaaattacctgaaccaccacgatgctctgccataatttactccgttaatagattaattcggactacatgatgtggttgctgctctccgttaatttcgtaagtacatcggcgtccatgctgagacaatttaagtgtaggtgggggcaattaacgtgcaagcggaacgggatatttccagctaattgaaatataaatgaaattaaatcgaattcgaaaataacacataaatatcagcaagttgaaaactttaaagaaaaatgaaatatgcgcaacgagggaaagcagcaaaaagcggaatgaataaaaaacaggaagaaaaccaaaggcatttcatatttacccggttcggggcaggaattgtaagtttatcgtaaatgataaataacagataaaaaaaaccccctcatcatgagggggaagacagggatgtgtctatggcaaggaaaacagggatactatttactactggtcactactggttactactggtacgactcacgggttgcagcgatgatgctggctgcagattcgagagcttgcgtaatgtgtttaaacgctgctcgtaattcttctgtaacgcggcttgctgctcgggcgttaacaggtgatacatctgattgcggacccgcgccatctcaacctgctgttcgatctgaactctggcaatggcttcggctttattgcggatggccgcttcgttaaatttatctgcagtcaccagatcgtgcatggctgcgatatcatcaatgttcgttgcaggacgctcatgtcgggcttgctgcataaggtcacgcatctgctgtctttgatgttccgtcaactcaatgccgtcgaacatgtgactttgcgaattttgcgtcatactgcctgtcgtaaatccgccgtgatgcacctcatcaagcgccatcgactctgctgctcttgcgctggcgttacagagaaccatcgctgaggcaataacgacggcggttaatttgcgcatcgtttactccagttcgttctgttttgcgattcaacgatagccagtgtacggcgacagctgcaaacatccgtcagggggtgtaaaagtacgtaaagcgatggattggtatcataggaacacgctattttgcctgcggagggctacaaaaatgaataaaatcctgttggtagatgatgaccgcgaattaacttcgcttttgaaagagctgttagaaatggaagggtttgaagtcgtggtcgccagtgatggtgagcaagcgttgaacctgctcgataactcaattgatttgcttttactggacgtcatgatgccgaagaaaaacggcatcgacaccctgaaagaattacgccagcaataccagacgcccgtcattatgctcaccgcacgtggaagcgagctggaccgcgtgctgggccttgaactgggtgctgatgactatctgccaaaacccttcaacgatcgtgagctggtcgcgcgtatccgcgctatcctgcgccgctcgaactggagtgaacaacagcagcaacacgacaacagttcaccgacgctcgaagttgactgtctgcgcctgaatccgggtcgtcaggaagccagtttcgacagtgaaacgctggatctcaccggcacggaattcaccctgctttatcttttggcacagcatttgggtcaggttgtctctcgcgagcaccttagccaggaagttctgggtaagcgccttacgccttttgaccgcgccattgatatgcacatctccaacctgcgtcgtaagcttcccgaacgccgtgacggccatccgtggtttaaaaccttacgtggccgcggctacctgatggtttctgcatcatgataggaagtttgactacccgcatctttgctatcttctggctgacgctggcgctggtattgatgctggtgctcatggtacccaagctcgactcacgtcagatgacggcactgctggaaagcgagcagcgtcaggggacgatgatagagcagcacgttgaagcagagctatcgcgcgatcccccgaatgatttgatgtggtggcggcgcttatttcgggctattgagaaatgggcgccgcccggtcagcgcttgctgttagtcaccagcgaaggccgggtcattggcgcgcagcataatgaaatgcaggttatccgtaactttatcggtcaatcagataatgccgaccatccgcagaagaaaaagtatggtcgggtcgagatggtcgggcccttcgctgtacgcgatggggaagataattatcagctctatctgatccgtcccgccagcagctctcaactggactttattaacctgctgtttgaccggcctctgctgttgcttatcgttaccatgctgattagctcaccgcttctgctctggctggcatggagcctggcgcggccagcgcgaaaactcaaatacgcggcggatgaagtcgccagcggcaacctgcgtcagcatccagaactggaatctggcccgcaggagtttctggccgcgggttccagcttcaaccagatggtcagtgcgctggaacgtatgatgaacggtcagcaacgcttactgtccgatatcagccacgaattgcgtacgccactgacgcgattacagctggctacggctctgctgcgtcgccgtcatggcgaaggcaaagagctggagcgcattgagatggaagctcagcgactggatggcatgattaatgacctgcttgtgctgtcgagaacccagcacaagaatgcgctggtcagtgaagccatgaaggcgaatcaactctggaacgacgtgctggaagatgccaggtttgaagcggagcaaatgggcaaaaccctggagattccttatcctcctggcccctggccgctttacggtaatccgcatgcgctcgaaagcgccctggagaacattgtgcgtaatgctttacgctactcacatacgcatatcagcgtcagtttttcagtcgatatttcgggcattacggtgcacgttgatgacgatggtcctggcgtgagcccggaagatcgcgagcagatattccgccctttctaccggacggatgaagcccgggacagggaatccggcggcacaggtctggggctggcgattgtggaaacggccatacagcaacatcgtggatgggtaaaagcggatgacagcccactcggtggcttgcgtcttactatctggctcccactctactcctctgcaaggcaataatttgctatgcttcggccctcgttatcgggggccttatgcttaacatcgtattatttgaaccagaaatcccacctaacacaggcaatattattcgcctgtgtgcgaataccggtttccagctccacctgattgagccgcttggctttgcctgggacgataaacgtcttcgccgtgcggggctggattaccacgaatttaccgccatcaaatttcatgctgattatccggcttttctcgcaacagagcagcctgggcgcctgtttgcgctaaccacgaaaggcacaccggcacacagtgcggtcagctatcagcgaggtgattatttgctgtttggcccggaaagccgtgggttacctgcagaggtgttgcaggcattgcctgcagagcaaaaaatacgcattcccatgatggcggaaagccgcagcatgaacctgtctaatgcggtatcggttgtggtgtacgaagcgtggcgccaactcgactatgctggcgcactgatcaaatcctaaataccatcaccaaactggaagccggcaccattgccgttaaagtgttgatccatatccattgacggcttttcactgccgggcttaccgacgatgcgggcagggacaccggcagcagtcgtatgcggtggaatagattgcaatacgacagaaccggccccaattttggcaccgcgccctacctctatattgcccaggatttttgcacctgcaccaatcatcacgccttcacgaattttcggatggcggtctccgctggttttaccggtgccgccaagcgtgactgactgcaaaattgagacatcgttttccacaacggctgtctcaccgatcacaatgccggtcgcatgatccagcatgatcccgtgaccgatttttgcagccggatgaatatccaccgcaaacgagacagacacttcgttctgcagataaaccgctaaggcgcgtcgaccttcattccacagccagtgtccaatgcgatgtgcctgaagagcatgaaatcctttcagataaagcagtggcgtggaatatttatcaaccgcgggatcgcgcagacgtaccgcctgaatatcacaggccgcagaggcaatcattgagggatcttcacggtatgcttcttcgaccacttcacgaatagcgatagcaggcataattggattagccagtttattcgccagcatatagctcagggcactgccaagattctcgtgcttgagcaatgtcgcgtggtaaaagctggccagcatcggctcgcagtctgccagcgctcgtgcttctgccttgatattattccagaccagttctaactcatcagacgacatgctgttttctcccgataaaaaaagcgccttaaccggcgctacaggtgatgatgcctggcttcctgctttagtttgtactgttttcgtccttccttgaacgccccagcaggcttaatgctgcatctcgtgccggttttccgcaatagagcacctgataaatctgttcggtaatcggcatttcgaccccgacgcgtgcggccagtactttgacttctttggtgtttctgtaaccttctacaacttgtccgataatgcgctgcgcaccatcaacatcttcgccctgtccgagcatcatgccaaaacggcggttgcgcgactgattatcggtacaggttagcaccaggtcacccagaccggccatgcccataaacgtcgtcggatcggcacccagcgccgcgccaagacgactcatctcagccagtccgcgggtgattaaggctgttcgggcgtttgcgccaaaaccgatgccatctgacatcccggcaccaatcgcaatcacgtttttcactgcgccgcccagctgaaccccaataaaatcgggattactgtatacgcgaaagcttttgccacagtgcagtcgcgcctgcaaatcatccgcaaattgtgaatcggtggccgccagagcaatcgccgttggtaaacccgcagccaactctttcgcaaacgttgggccggagatcaccgccagtggaatcgcctcacccaggatttcccgtgcaacgtcctgcagcagacgaccggtttctttttccagccctttcgtcgcccagacaatgcgtgagtcatcgcgcaaaccgggtttgatctgcatcagcacatcgccaaaaacgtggctgggcacgacaaccagcagatcgcggctggcagcgatgacactcgccagatcgggttcaacagtcagattatcgggaaaaggaacatcaggcaggaaagcaagattgcagcggtcggactgcagttgtgccatatgagcgggattgtggccccacaacaacaccggatggccattgcgggccagcgtaatcgccaaagcggtgccgtatgaaccggcaccgatgacgctaatcgaagcgtgagtactcatcaggcatcctgatgttgcgcagcaccttcttcgccttgctgctgctgcagatagttcatgaacagcgcatcaaagttcactggcgcaaggttgagttgcgggaacgttccacgggaaacaaggctggtgatacattcacgggcatacgggaacaggatattcgggcagtaagcgcccaggcaatgcgccatctgagtaccgtcaatgccgccgatggtaaaaataccggcctgctgaacttcacacaggaaagcggtctcttcgccaacggtcgcggttacggtcacacgcagcaccacttcatacacttcatcagccagctgcgaagaagcagtatccagatccagcttaacgtctggttcccactctttctgaaacacttgtggcgcgttcggcgcttcaaaagaaatatctttcgtgtaaacgcgctgaatctggaattgcatttcgttagtgttatgttctgacatgtgactaagtcctgtaagttaaaatgtctggcgtaaaactacgcctgaagtaacggatctaaaccttcacgatcgttcagcgccatcagatcgtcgcagccaccaatatgctgaccgtcgataaaaatctgcgggacggtagtccggccactgcgcttaatcatctcttcgcgttttgccatgtccccatcgatgggaatctcctggaacgccacgcctttttgactcagtagcgcttttgcccggtggcaataaggacaggttgctttaatgtaaatctcaacgtttgccatagggacctcaggatgattatttaccgcgaaccagcggcagattttcgccgctccaaccgctgataccgtctttcagaacggacacctggttgaatccggccgcactcagatgtgcagcaggttcggctgcgctttgtccggttgcacataccacaattatgggctgtgctttgtgcttttccaactcacccaggctgcctttcttgatatctgcggcagccacattaatcgcgcccgaaatatgacccttgcggtaatcgtcacgcgaacgcacgtctactaccaccgcgtcctctttgttaataagtcgggttgcttcacctcgactgatcgtttttactttagagaacattcctttaacggtggtcacaatcaccaatataagtaatacgacccatgccagactcaggacggggtgattgcttgcaaactgcataatttcttgcatgaggggtaacgactccagaccgggctaataagctaaaacaaggcttctgagtatacctgcgccacttcgcatgtacagacgctaagcggacagagtgaagatttgtgcgtcattttccaaaaaaatgagcggaatggcaaaaatgacgtgacgctggtgccttgtcctgatgaaaatggatcactctgggaaagcaaaagccggtcagcaatgctggtaagcaactgttcatcgtggaataatcatcgacctatgaagggaaagataaccgttctaccaacatggactcgttacaacggtcgcatcctgccgttgttcacccgcttgtccgccctgtcttttagcctgctttatgcgggcctgttgcttttccctgcgcccggcgtagccgcggatgacaataaagcgcaactgaaatctattcagcaagaaattgcagaaaaagaaaaaagcgtaaaagcgcaaaaagttcagcgtagtcagttgctcaatcagttgcagagtcaggaaaaaatcattgctcaggcaagtcgacagttgcgggaaacccgtaacagcctgtcggccctgaacggtgaaatcacgcaggtcaccgcctcggtttcccgccttgagaaacagcaggctcaacaggaaaagctgcttgcagaacagttggacgcggctttccgccagggtcagcataaaggcctgcaactcctgttagggggcgaagagagccagcgcagcgaacgtattctggcttactttggttatctgaataccgcacgccaggaaaatatcaccgccctgcaaactacccgtcaggaattagcccaacagcgcgcgtcactggaacaaaagcagcaacaacagaaatcgctgttaacacagcagcaagcacaacaagacaaactccagcaagccagcgcagcccgtaaaaaaactctgacctctctggaaagtgcgctgcagaaagatcaggctgacctggttgagatgcgtcagaacgaaagccgtctgcaagataaaattgcccgtgccgaacgtgaagcccgtgagcgcgctgcccgtgaagcacgcgaggcagaaaaagtgcgtcagcgtcaggtgcaggctaaagccaaaggctccagctatcagccaacacaaagcgagcgcgaactgatggcgcgaacaggtggactgggccgccccaacggtcaggatatctggccagtacggggccgcgtcgagcatcgctttggcgaggagctgcagggtgaattacgctggaaaggcctggtcattgccgccccagagggtacagaagtcaaagccattgccgatggtcgtgtgttgatggccgactggttgcaaggttatggcctggtcgtggtcatcgagcatggtaaaggggatatgagcctgtatggttataaccaaagtgcgctggtcagcgtgggtgcccaagtgaaagcaggccagcctgttgcgctggtcggcaccagcggtggtcgcggaacgccttcgctctactttgaaatccgacgtcagggcaaggcggtcaaccccattccatggttagggaaataagtgctacatcatcgtcataagatcaccgcgttgttgtgcggcttgctgctcagttgcgcggcccaggctgctaagctcgccatcgttattgatgatttcggctaccggccaacggaagagaataaagtactgcaaatgccgcgggcgatttctattgccgtgcttcccgatgcgccttatgcccgccagatggcgaccaaagcgcataacggcgggcgtgaagtgctgattcacctgcctatggcaccgttaagtaagcaaccgctggaaaaaaacaccttaacgcccgaaatgagcagcgcggaaattgagcgcatcattcggagtgcggtgaataatgtcccttatgcggtggggctgaataaccatatgggcagcaaaatgacttccagcctgcccggtatgcaaaaagtcatgcaggtgcttaatcagtacaacctgtatttcctcgacagcatgacgattggtaacagccagtcactgcaggccgcgcagggaacgcacgtcagagtactcaagcgccgcgtattcctggatgacagtcaggacatcaattcgattcgtcagcaatttagccgggcagtcaagctagctcagcgggatggctacgctattgcgatcggtcatccgcatcctaataccgtgcgtgtgctgcaacaaatgttgccctccttgccggcggatatcaccctggtgacaccgggtcagttactgaatgagccgctgcgcaacggcaacacctcgccgactaacactccgccacgcaacaagccatcgcaaggtttccagccgccgggtgaatgtaaagtgaagcagccgctggcgcccgtaccggctacacgcgcgctgggcgtgattggagaaagcatcacagaaagtccgctttatcaccggctcgatgaactcttctgaaatatgctgcacccggcattaaaccgggtgcagcatatttacactacgcaaacttacgtcatctcaccctgtgtttgatgagcactcgcgggctcaattatgcccagttcaaaatcacttttcccgactgccctgagcgcatttcgtcgaacccctgctggaaatcatcgatagcataacgatgggtaatgattggtgtaagatctaaccctgactgaatcagtgcggccattttataccaggtttcaaacatctctcgtccgtatatccctttgataaacagccctttgaatatcacctggttccagtcaatggccatttctccgggaggaatgcccagcaaggcgagccgaccgccgtgattcatcacctcaagcagggttcgaaaagcaggtggtgcgcctgacatttctaatcccacgtcgaagccttctttcatatccagtgactgcatgacctcacgcagatcttgttttgcgacattgactgcacgggttacacccattttgcgggccagctcaaggcgataatcattgatgtccgtaatcacgacattacgcgcaccgacatgccggcacacggccgcggccataataccgatagggccggcaccggaaataagcacgtcttctccgaccaggtcgaaggataaagcggtatgtaccgcattgccgaaaggatcaaaaatcgccgccagttcgtcggagatattgtcagggattttgaacgcattaaaggcgggaataaccagatattcagcaaaacacccttgccggttaacgcccacgccttgggtattgcgacacagatgggtacgaccggcacggcagttgcgacagtgcccgcacgttatgtgaccttcgccagaaacccgatcgccaatgttaaatcccttaacctcctgaccgatagcgacgacctcgcccacatattcatggccgacaatcataggcaccggaatcgttttacgtgaccagtcgtcccagttatagatatgtacgtcagtcccgcagatggcggttttgcgaatttttatcaataaatcgttatgacccggctcgggaaccggcgcatcagtcaccatccagatgccctgctcttttttcaacttagccagtgctttcatggtcaatcctcaggcgatgacgccaagttgtttaccaatacgcgtgaaagctgccaccgccgtttccagttgctgctggctgtgtgctgctgaaatttgggttcggattcgcgcctgaccttttggcacaaccggatagaaaaacccggtaacatagataccttcatgttgtaacagctgagcaaattcctgcgcgacgctggcttctcccagcatgacgggaatgatggcgtgatcggcaccagccagcgtaaaacctgccgatgtcattttttcacggaagaagcgtgcgttgtcccacaggcgctgacgcagaccgtcgccttcgcttaataaatccagtacgcgaatagaggccgccacaatcgccggtgccagggagttagagaacaggtaaggtcgtgagcgctggcgtagccattccactacctctgcttttgccgcggtgtatccgcccgatgcaccgcccagcgccttgcccagagtgccggtgataatgtctaccctgcccatgacctcgcaatactcgtgggtgccacgaccggcgttacccacaaaacccaccgcatgggaatcatccaccatgaccagcgctgaatattcgtctgccagatcgcaaatggctttcagattggcgatcacgccgtccattgaaaacacaccatccgtcgcaatcatcactgtctgcgcaccgttatccctggcttcctgaaggcgggcgcgcagttgggtcatgtcattgttggcataacgatagcgctgtgctttgcacaagcggacaccatcgataatcgacgcatgattaagcgcatctgaaatgatggcatcttccgcgcccagtaaggtttcaaacagcccaccgttggcgtcaaaacaggaggaataaagaatggcgtcctccatgccaagaaagtcagccagttttttttccagttgtttgtgcatatcctgcgtaccgcagataaagcgcaccgacgccatgccaaagccgtgtgaatccatgccctctttagcggcctgaattaaggctggatggttagccaggccaagatagttattggcgcaaaagttaatgacaggatggttatgtccgacctcaatctccgcctgttgcgcggaggtaatgatgcgttcttttttaaataaaccttcacgctgggcggcgtcgagttgctgtcggatatgttggtaaaaatgcactggcattattctgctcctgataaggtaggaatgaggcaaatattactgaacatatcgcctttctacgcttaatcgaccaacagaatgttaattttgcagcatagttcacgtcgttaagaggtatgagtaacgccttacagagtcatctggctgtctgtgacgggatgaaatgttatgatgtaagcattacgtgtgaaacgtcccgtttcaccccaaaacttcaaaggtaacagtatgattatcgtcaccggtggcgcaggaatgatcggcagcaatatcgttaaaacgctgaacgatcgcggtcacaacgacattctggtcgtggataacctgaaagatggcaccaagttcgtgaatcttgccgatctggacatcgctgattacatggataaagaagaatttttgacctacatcatgtccggtgaagacctcggtccgattgaagcggttttccatgaaggtgcctgctcagccaccactgagtgggatggcaagtacatgatggacaacaactatcagtactctaaagatctgctgcacttctgtctggagcgtgaaattccgttcctttacgcgtcgtcggccgccacctacggcggacgtaacgagaattttattgaagagcgtcagtacgagcagccgctaaacgtttacggctactccaaaatgctgttcgaccactatgttcgtcagatcctgcctgaagccacctcgccggtatgcggttttcgctacttcaacgtttacggcccgcgtgaaggtcacaaaggcagcatggcaagcgtggcatttcatctgaacacgcagatcagtaatgatgaaaatccaaaactgtttgaaggcagcgacagcttcaaacgtgatttcatccatgttgatgatgtggtgtccgtgaatttgtggtgctgggagaatgggatttccggcatttataactgcggaacaggccgtgccgaatccttccaggaagtggcagatgccgtgcttaactttcaccagaaaggccagattgaatacattccattccctgacaaattgaaaggccgctatcaggcttacacacaggccgacctgtcaaaattacgcgcagcgggttatgacaaaccgtttaaaaccgtggcacagggtgtgtctgaatatatggtttggttaaaccgtaacgtctaaaggaacggatacccgcgatgaaaattctggtgatcggcccatcgtgggtcggcgatatgatgatgtcgcaaagtctctatcgtacgctcaaggccgaacatcctgatgcggtgatcgatgtgatggcaccggcctggtgccgtccgctactttcacggatgcctgaagtcaatcaggcgctggcgatgccgctgggtcatggcgcattggggattggcgaacgccgccgactgggcaaatcgctgcgcgccagcggttacgatcgcgcctatgttctccccaactctttcaaatcagcgctggtgcccttttttgccgggattaaacgccgtatcggctggcgcggagaaatgcgttatggcctgttaaacgatcttcgggtgctggataaagaggcgtttccgctgatggtcgagcggtatgtggctttagcttatgacgcgccagtccgttcagcccggcaactgccacagcccttgctaacgcctcaactgcaggttagcgaacaggaaaaaacagaaactgccgcgcagtttcagctcgctgctgagcgcccgacgattggtttttgccccggtgcagagtttggcccggcgaagcgctggccacattttcattatgctgcccttgcgcagcagttaatcagcgaaggttttcaggtcttgctattcggttcggcgaaagatcatccgaccggtgaagatatcatctcttctctgcctgaagatagccgggcacactgccgtaatctggccggcgaaactcagcttgagcaggccgttattcttctggcactgtgccgcgcagtcgtcagtaatgattcgggcctgatgcacatcgccgcagcgttaaatcgaccgctggtcgccttatatggccccagcagccctgacttcacgccaccactctccgatcgggcgcggattatccgtttgattagcggctatcaccgcgtacgtaaaggggatgccgagcaaggctaccatcaaagtcttatcgatattcagcccgcacaggtccatgaaacactgagcacgctattgcgtgaagcccaggaggggacatgcacgtcctgattgttaaaacctcttctatgggcgacgtgctgcatacgcttccggcactgaccgatgccatgtatgccttacccggcatacgctttgattgggtggtagaagaaaactttgcgcaaatcccgtcctggcatccggcagtggaaaaagttctgcccgtcgccatccgtcgctggcgtaaacattggtttggcagccaacagcgtgaagaacgcgttcagtttaaacgtgagctgcagtctcgtgaatatgatgtggtgatcgatgctcagggcctgattaaaagtgccgcgctcgtcacccgactggctaaaggcgttaagcacggcctggacaatcgcagcgcacgtgaaccttttgccagttggtggtatgacaaaaaacatgatgtcagcaaaaagcaacatgcggttgaaagaacgcgtgagctgtttgcaaaaagtctgggttacgataaaccgcacactcagggcgattatgcgattgccgaacatttccagaaacacgtagcatcgcgtgaaaacccttatctggtatttcttcatgctacgacacgtgataataaacactggcctgaagcccattggcgagacttaattgaacgcatccagccaacaggtttacgcgtgaagttgccgtggggtgccgaacatgagcaccagcgtgcgctacgtctggctgaaggttttgagcacgtagaagtcttgccaaagctttctcttgaagctgtggcacagcagttggcaggtgcggatgccgtggtgtcagtggacacgggcctgagtcatctgacagccgcgctggacaggcctaatatcactttatatggtccgaccgacccgggtttgattggcggttacgggcaaaatcagcatattttgcgccctgttgagggcagcaaattagcagacatcagcgcgaaggacgtcgcagatatggtctttgagattcttgcatgaagaaactccacataattaatcttggcaaaatgggtggcgttgagcgtctgttcttgcagtacatcaatgacttttctgacgggcatgacgatgtgatttgcatcagcaatgagatagacgacgacattcgtcgccatattcctcaacaaaaaatcacctttgccaatcgttggattaatggcctgaaattaaaagtcccacaatttcttcggaaatatgtactacaaaaacggatagaagccagcgatgccgatgtgattgtagtttgggatttgattccggggctggcagccaaacccaggcgtgctgctctggtctattacgaccacggctgctcatggcgctatcccaagaataaaaaaacgcttaactttatggcgatgctggatggcgttatttcagcctcttatgcttcaaaccgcgtgatgcagcatcgttttaatttgccttgcccacatcatgtcgttattaaccgaatcatggtgccacagggaattaaccccgcaaccagaacgctgaaaaatccgatcagactgggaaccgcatcacgccaggttagccttaaaggtattagcgtagcgctactgacgttaaaagaattacgtcaacgtgggcacaatgttgtgctggaaatcgcgggtaaaggacctgaccacgacgcctttgtggggctcgcagagcgtttaaatattagtgagtttgtcacctttagcggttttcagcatgacataagcacctttttcaaccgcattgatctctatctcagtacgcccgttactgagccatttggtctttcttgtatggaagcgctttattttggtgtaccagtcatttttccaatgatcgatggccaaccagaagtcgtcagccatcaacagtgtggaataggtttaatgccctcagtgacgattgatgaacatgagaaattaactggcatacgcgttgatttcccttatcagatctacgatcctgtccacgatgttatggaagaggccaaactggtttctcatattgattgcgccaacgcggttgaaatcttatccggacatgaaacctaccaacgatttagtgaaaccgccaaagcctggacagcagagcatttcgactatgcgctgtttaagacagaattcaatgatgctttgatggacgtaatcagtaaaaaatgaaacttaatcatttaatcttaaaaaaagatgcacctgccaacgttcttaaccagctgatttttattggatgtgcgatagcctttattacatcgccatttgggggagattttggcaagaatgttttttatctatcgagctatctggcctttctggtcgtcattttccatttcagattttacaccaccaataaaaaaatttgattcttcccggtgctcttttggttgtcggtatcatcagtattatctggacagccatatataaacagcctggcgatttcatcagcctttaccgacagtatcagtcaaccggaagattgcagatcgccgcagcgtttatcttactgacaatgctcaatattaaaatcgcactgcaaaaacacaccgtgttgaccgccattatttgcggacttgcggtaaatggctatgccatttaccagggtgttttcttacatatagaccgtgtagagcttaattttgatcgggcgacggttgccgcctatattattacctcggttaatctaatttttattaaagccgttttactcttaaagaaccgacatagagtgctgctttttttagccgctttcgcctttacctatgcttccattgtgctgaccggaacgcgtgcagcgatgctggcttatcctgtgttgaccttaatgattgtactgatgagtacacatgtcattagtcgtcgacataaaatgacgctgttcactttggtgccggtgatgattttgctgagcgccgcgctatttcataacctcattgcgacacgtatacagcagttcaatcaggacattgctcacatgcatgagaaaactggtgagaattcaatagcttctcgcttaagcatgcaaatcattgcatttcgtaccggttcagaggccccatggggagagtccgctgagcaacgcgcggaagaagcaaaggcaatcgtggcaaaagagccttcgctttatggggcgttaacctatcttaccgttcacatgcacaatgaactgatggaaaatttctcaattaaaggtattgtggggctgttggcgatggtcggtttatatctctgcttagtgcgtaatgcattcacaccttgccataatcctgcactcctggccgtgactgtatcattaataacatatggcttgagcgacgtgatcttttttagtactgagggcacactagcctattgtctggctgtgattattagcggcttgttggtcaatacctccgttacattacaggacgcagcataatgcaaacccgcgactggctgctaagcgtaattatccctttgtacaatagtgaacgttatattatcccctgcctgaattcactatttacgcagatcgatgacgatattcaggtcatcattatcgacgatggttcgacagatctttctgcacagcgcgtaaaagattttctgagcggttatccctcagcttcagtcgaatttatccaacaggctaaccagggcgttgccgcagcccgaaatgccggactgctcaaagccagaggaaaattcattaccttcctggacgctgacgatctcctcagtaaaaactatctgtcgattatcaagccattattattatccgatcaggacgatctgattgattttaattatgcccgatttgaacatacggtgcctgaagcatcagaaaacgaatcgcctcagcgtgttgcttatgatttttcagggcggggactggattgtcttcaccctctttttatccgatcgatgtggcatctgtggaaccgggtatacagaaatagcttactggaaggagacgcgtttgaggtaggaaggcgctatgaagacgttatctttacgccatttcagtatctgaagacgcagaagatcgctcatcttgagaatacactctactattaccgcgataatcagcaaggcattacgcgtaatgttcgtgagagcgatattcaggacatgctgttcgccatgaataaaatgtgtgccatcgcgcagacaaacagtgaacggcgtcggttggcggcaggcatgatagtgaactgttttaatgaagtaaaaagcatgtcgaaagcggtttttggctattaccattacgataaacaaacaaaactggcgcttaagtcagcagcacgcctttgtaagggccattgcaaaacgaaaaagttttggcaaatgcgctatcccgaagtcgacacgcttttttcgtggttgcgatttaaaatccgtaaaccggctactggtgtgaatcggtgacggctccgagtgccgtttttttcttcagggcatattcggttaatgtcatgccctgagtgcgcacctgaagccagctaaacagctgctctaaatcatcataaagacggtcaatatctgcgtcatttttaaacgttggactgccatcaggcataaactcagaagagtgcagcataaattcaacataatcgtttccctgcgacagtgtttgttcaactacctgcttcatttgcgccagatttccgcctatgggtcgtaaccagttgacccgagcccctctcgatttaccccgaacagtgtcccaggcttttttaaactgatttttcaatgggccatgtcgatactgaatgctcatcggcaattccagtaaggttgagtggccaggttttgaaatatcgttgatatcgacgtaataggcacagtcaggaaaccggctgtaatctgtaccacctttaccctggggtgcaccaggtgagccacgccagtcgacacgcggcgtaacggagcagtcaaccagataaccattgtcgatcaatgcgcgcgcataaacttcattaaaggcccagcgaccagcacgatgactgcgcattttggtatcaaatgccgtttcaagcagatcagtcatgtaggcgactttatcgcgcaggaccgcctctgggtactcaatcagataaggctggtaacgccagtcatcctccgtgagtgcgaaatcaggagggctgtaccaggcatgtaaatgcatgcctatttcaccctgattacgatcaaggaggtcgcggccaaactccacataggcaggatcgctgaccatctcatagttagtgagccaggtgggtttgaacgcatatttttcgcacaacgactgaaaacgcggtaaaaagcgaacattatgcgtggtgacattgccgctgcgattgcgccagaggttgtcaccttctgtatcaagggtaattaaaaatgctggtttatccatgacttatccaacaatcagtagagattctctttaccatgttacgcagggtgcgcaatccgcgcaaaaatataattgcggtgagtttggtttttattcgtagtcatctatgcgccgataacctaaaatcattaccttaatccaaggggcatttcgtttataagccattgaataacagagcgttgtaatgttttttatatttgaaaaattatttgaaactgcactcactattttactctgttacgacttgtttaatgcctgtgagtcacataattaagaccacgcacagcgcaggcgagtctttgaggtgaaaatttgtccaagcgtattttgatgataattgacgggctgccaggcggcggtgctgaaaaggtcgtgctgacgctggcacagggcctgataaatgacgggcaccaggtagcacttttttctttgcgtaacgtctgcgattatcccctacctgcagaactcgattaccagataattaacgacgctagccgtagcccatggcgtaagctcactgaaacatcgcgtcgcgccacactcctggataaggccgtccgtgccagtgagacccggtatggcaaatttgatttggtactatcccatctgcataaaactgaccgcattgtatcttcctcgcgtgcgctcgatccgttaaaaacctggtactgcatccatggcgttttttcggcctcttatctggcgcgcaaatcaggttttgcgttttggcttaagcgccagaaaatccgttacgtctaccgtaatcgtcaggtggtcgcggtttctcaatatgtactggatgatttgatccgttgtgtcggtgtaaaaccctcgcgaaccaacgtgatttttaacccttttgattttgatgaaatccgccagctttctctggaaccttgcccgctcgcaggcacagatttcctgatacatgttggtcgttttcatgaaacaaaacggcatgatcgcctgctggaagcttacgcacaaagtggcatccaggctcctctggtcttactggggcaaggcagccctgcaacgaaagagaagttacatcgattgactgaacaactgggcatttcagatcgcgtgcgttttgaaggtttccagcgtaatccctatccctggattcgtcatgccaggatgttgattctgagctcagacagtgaagggtttggcaacgttttgattgaagcgatgagttgtggaacaccggtagtaagtacgcgttgtcctggcggacctgcaagtattttaaccgacgacctgggacgcggactgtctgagatgaatgcagcctctttagcggaaaaaatgcgtgaaatccacgataatccccctgatttgcatcaacttgatttgaacatctatagcctgtcggttatttgccagcaatatttgcacctggctgacacctgatctgaacgcccacatttctgccgttgagcacacatcctgttaaccagccgttccttaaatcaccgaacagattaagggaacggcaggtttgaccgttgtttgcgcaacgaaagacgcctttagtctcagacgttcagtaaatgataagattgctacgcgacaacggcttccggactgcctttgagctgttgccacgcatcaataacgctttccagcgtcacgtcattacattccccggaaggcgtctgcaggattttatattcacctgaccatgggtgccatccgggggcatcagtatcgccaaaaaacaccacctgctttttatgtaaacctgcagcgatatgcatttggccaccatcgctacacagaatttggtcacaacaactaaagcccgccattaaatcacgcaccgacgttgtcgagtaggcggcgacacgagaggaattgactaactcaaggaggctctctgcacgggcatcatcccccctgtcatccggccccagtgcaccctgcggagaccaaaagatcagcacacgcgcttgctcatcctctaacagataatggataaaagccgcatagctttccaggccccaacgtcgcttcgggctacggctgctgatgtgtataccgtaagtttggccggatacggaaaacatggaattgatacgttttttcgcctggtctcgctctttatgagttaaataaactctcaccggcggaactgcaggcaaatgatcggtcagcgctgagagatacgagtaagtgtgttcgacctggtggttgccagaaaaatcgtctctgccaaagattcttgtcagcccgttactggcttcacccgcgccaataatatgggtggctcccgccatacgcgccagacgtaagctgtatttacagggaaccgggttcgccagtaccgccgcatcaaacttcgttttacgtaaagcccaaaaaatttttaaacggtgccagtaaacgccaattgcggtctcattcttgccacggtgcttggctttcttatagacatgaagcgcatcaacatgggggttatgcagtatcacatcctgcgccactttatttaccaacagcgtcagtttagcttcgggaaaggccgttttgatgccttcgagcaacggtgtggtacaaaccatatcaccaatgttgtcgcgcctgatgacgaggatatttttcatacaatactcggtttagggatacctgtcctggctgtaaagcacccggcgttgagagtggcgaaaaaataaatttctgctacacagagtatttgacccgtattgcaaaaaaagttctgaatgctttcgtaataatgtctgcaaaaatccgctcaattttcatttgaactcataatgctgtgtcacagaatttgcctttattatcaataatcacaccaatgtttaacgctggtgccatgtttgagacatttatccagtctttgctggctcagacgctgacatccctggaaatcatcctcgttgatgatggctccacagacggctcaggtgagaaggcagacggctatgcacagtgctacccccacattcaggtcatccaccagcccaacggtggcgtctcacgtgcgcgcaatgcagggctggcggtcgctcgcggcaagtatgtgacctttccagacgctgacgacaccatgaagcccgagatgtaccagacgctggtagatatggcagagtcagacaatctggatgcggcacaatgtaacgccgagtggttattccaggcggatgggaacgttcagccacttattcccccggacaggctcaccagcacagccgtgttgagcggaccagaatggctcaacaaggcgctgaagactcatcgctacaaacatgtcgtctggctcggtatttaccgacgcgaactgattgaaaaactgaagctaaattttgaacccggcctgcaccatcaggatattccgtggaccaccgagttcatgctgaatgtagagcgcgtacgctataccgataaacagctgtatcgctactatctgcacgatgcttctatcagtaaccgtaagcgtaccggcctgcgcaatgttgaatatcaacgtcactacctgaaaattgcccaaatgctggaagcgatcaatgcgcgctatcgccataaagtcaaaatctacccggcattccactatcagatcacttacgaagcactcagcgtatgccacagtatccgacgcgaacctgaggaatcagcccgtcaggcgatgattgcggatctcttcgctacccagacacacaaacgcatgctgcgtaatgcgcgtggtgtaaaacagtggtatcagttgctgctctggctgagccgtatttattactggcgcaggaaataagcgacgtcacttgctttaaccccttcagggtttgccctacaatcagctcactgaattctgagagcatttgagtatgacaagcccgattccagcccagtttgcaccgaaaaaaattctgttaatcaaactgcgtcatcacggcgacatgctgctgactacgcctgtcatcaatgctttgcatcagcattatccgcaggccacccttgatgtcctgctttataaagaaacacgccccatgctggaggcgcatccttccatacatcacctgcatatcatcgatcgcaactggaaaaaggaaggcggctggcagaagttgcgccatgaaatggccctgctctcagcggtgcgatcccgtcattacgatgtggtgattaaccttgccgatcagtggcgcagtgcgattattacccggctgtctggcgcgccggtgcgcattggctttgcgtttaagaaacgcgataacgccttctggggttggtgccacaatcatttggtcaccacagaaaatcacgatcggttgcacacggtggagcagaacctgtcagccctggcaccgctgcagatttcaaccgagggcgccaaagcctctatgcatttcagcccgaacgacgatcggaaagtgcaggatatgctgctccagcaacagataaatagcccttttatcgtactgcaacctacatcgcgctggcagtttaaatgttgggaagaagataaggttgcagccactatcgaccaactggctcaagccgaccgaaaagtcatcctgacagcaggaccggatgatagcgagctggcgatggttgagcggattcttgcgcagtgccattctccgcatgttatctccctggcaggccagctgacgctgcctcagttggccgcgcttatcgctcgcgccaggctttttattggcgtggactcggcccccatgcatatggccgccgcgctggacacaccgtgcattgcgctgttcggtcccactaagttgcaacactggcgtccatggggtgacaacaatcgggtcatctgggctggcgattatgctccccttcctccaccagactccattgatacgcgcaccgggcaacggtatttatccgttattccggttgaggacgtggtgaccgccgcaaggagctatttaaatgagtaagttacgtctggcgattgtccggcaaaaataccgccccgatggcggggccgagcgttttatttcacgcgcactggaagccctgggtagcgaacagttagatctcaatatcatcacccgaagctggcaaggaaaacccaatccggactggcatctgcatatctgcaatcctgctaaactgggacgggtttcgcgtgaacggggttttgcccatgctgcacgggcctgctgggaacgggagaagtttgatattgtccagagccatgagcgtatagcgggctgtgacatatttcgggccggcgacggtgtacatcgtgtctggcttgagcaacgggcacgcattgtttctccgctgcagcgcttgagtgccgcaataagtccttatcatcgctacgtcctgcaggcggaaacagatatgtttcattccccctcgctgaaagcggtgatatgtaattctgagatggtgaaaaaagacatcctgcgctgctttacgctgcaggcagagaaaatacatgtcatttacaacgctatcgattcaacgcgctttcagccggccactgaggcctctcgtcatgctatgcgtacacagctgaacctgcccactaatgcaaccgtactgatttatgtgggttctggatttgaacgtaaaggcctgaaagccgccattgaagcgctggccagaagtaatcgctatctgattgtggttggtcaggataaacaggtgaaacgttatcagcagttagccaaccagctcaactgccttgaacggttacgttttgtcggcgtacagcaggatgtgcagcccttttaccatgctgctgatggtttgctactgccaacgctctacgatccttttcccaatgttgtgctggaagcgatggcatgtggtttgcccgtgattaccagtacgggctgtggcggcgcggaatttattcgcgaaggccaggaaggctttgtgcgcgatgcgctagacatcacaggccttaaccaggctattaacgccctttctatgctgaccgtcgatatgaggatgggagaagcggcgcggcgcaggatcgaaccctatagtccacaaaacctggcgaattcactgaatgcgctttatcagcaggtgctgaatagccactcatgatgtgggatgagtgattatgctgtttctgataagatgcagtaatctgactttaatctgtttttttgacgccaacgtgtcataacggtaactatgacgaccatttacaccgcattgctctattttattcagccactgatttggctgcgcctgtggctgcgtggtcgtaaagcccctgcctaccgtaaacgctgggcagagcgttatggctattgcgccggaaaagtaaaacctgaaggcatagttttgcattccgtctccgtgggtgaaaccctggcggcggtgcctctggtgcgcgcactacgtcatcgttatcctacgctgcctattaccgtaacaaccatgacgccaaccggctctgaacgcgcgcagtctgcgtttggcaaagatgtgcatcacgtctatttgccctacgatctgcctggctccatcaatcgctttcttgatacggttaatccgcgcctggtgatcattatggaaacggagttgtggccaaacatcatccgcattctgcatgagcgccatattccgctggtgatcgccaacgcccggctgtcggaacgttctgcaaaaggctaccgcaagctgggcaagtttatgcgtaacctgttacagagcatcacgctgattgccgctcagaacgccgaggacggggagcgatttcttcagctcggcctgaaacgttctcacctgtcgattaccggtagcctgaagtttgatatttctgttacgccagagctggccgcaagagcgataacgctgcggcgtcagtgggcgccccgccgcccggtttggattgccaccagcactcatgaaggcgaagaggcgattctgctggatacgcaccgccgtttattacaaacctttccggatctgctgcttattctggtgccacgtcatccggagcgtttcaacgatgcccgcgagctgacgcaaaaacgccagttcagttttaccttgcgcagcagcggtgaaatcccatccagttcaacgcaggtcgtcattggcgactcgatgggggaactgatgctgctgtatggcattgccgatctggcatttgtgggcggcagtctggttgagcgcggcggtcataatccgcttgaacctgcagcccatgctattccggtgctgatgggcccgcacacctggaacttcaaagatatttgcagcaagttgcagcaggcacagggactgatcaccgtcaccgatgctgcgtcactggaaaaagaagtgacaaatctgctgcaggacgatgattatcgtcgctactacggacgccatgccgtagaagtgctccaccaaaatcagggagccatacagcgtctgctacagttacttgaaccccatttaccgccacgagctcattgatgacttcaacgcgccaacgcctgtcagtggtgatgattgccaaaaatgaagcagagctgctgcctgactgtcttgcatccgtccattgggccgatgaaatcatcgtgctggattccggcagtacggataacaccatagcgctggcccgtgaagcaggtgcacaggtttatcaggcgacggaatggcagggctatggcaagcagcgtcagcgggcgcagagttttgcccgttgcgacatgattttgatgatcgatgccgacgagcgtgtaacgccagcgttacgtcgggcgattgagcaggtactggacgcgccgccgggccgcaccgtttacagcctcagccgaagtaatctttttttagggcgtttcatgcgccatagcggctggtaccctgaccgggtaatgcgtctgtatccgcgtacgttacgctataacgacaatctggtgcacgagtcgctgaacaccgaaggcgcaccagtcaaggtccttaacggggatttgcagcacctgacctgccgcgacctgatggcatttcaacgcaaacagctggcctatgcggaagcctgggcacaggaaagattcctgcgcggaaaagcgtgcagtctgttttctgtcttcacgcatacgctgggtgccttcattaaaacgctgctgctgcgtgccgggttccttgatggcaaacagggttggctgctggcggtcgttaatgcccagtacacgttcaacaaatatgcggcgctatgggcgctgaataatgcttcggcgaaagggcgcacatgaccactaaagctatctatccaggcaccttcgatcccatcacattaggccatattgatattgtgacgcgtgctgcacagatgtttgactggcttgtcgtggcgattgcggccagcccaggcaaaaagcccttgtttacgctggatgaaagggttgcgttggcgcgtcaggcaaccgcccatttatcgaatgttgaggtggtgggttttagcgatctgatggccaattttgcccgcgcgcagcaggcaaatgtcttagtacgcggattacgtgcgatatcggatttcgagtatgagatgcagctggcgcgtatgaaccggcatttgttgccgacgctggaaagcgtgtttttgatgccgtcagaagacttttcttttatctcttctacgctggtaaaagaagtggcgcggcatggcggcgatgtttcggccttcctccccgcgcctgttcaccaggcgttactggctaagctaccttagcgctgacagtttgggcaccagtaagtactgcgttgcccatgcttaccgctgacaatgggcgtgccacatgcccggcacggctcacccgcacgaccataaacctgtagctcttgtgcaaaatagccgggcttaccatcactttgcaaaaagtcgcgtaatgtcgtcccaccctgctcgattgagcgtagcaacaccgctttgatggtattagccaaaagcgcggcgtcttcatgggacagactcattgcggggcgatcaggaaggatcccggcggtaaacagcgactcactggcataaatgttacccacgccaaccacaactttattgtccatcagccactgcttaatcaccgttcgcttaccacgggatttttcgaacagatagtcgccattgaacagttcactcagcggctctgggccgaggtgtgccagtacgctactgccggccaggtcactgctccacagccaggccccaaaacgccggggatcggtatagcgcagcactttaccgttgctcatcaccaggtcgacatgatcgtgtttggcggcaggcaactcttctgaaagcacgcgcaaactgccagacatacccagatggataatgatccagccgtgcggcaactccagcaaaaggtatttggcgcgacgttgaacactcagcacaggctgatcgcttagcgccaaaatttcttgtgagaccggccaacgcaatcgcgcgttacgcacaaccgcgtgaagaattgtttgaccaaccagatgtggctcaatgccgcgtcggctggtttctacctctggcaactcaggcataacctctcccctgcgcattacacaaacaaaaaacccggcctgagccgggttttttgcagaaaaccaaaattacttaattttggcttctttgtagatcacatgctgacgtacaaccggatcgaactttttcagttcaagtttctctggtttagtacgtttgttcttcgtggtggtatagaagtgacctgtaccagcagaggaaaccagcttgatcttctcacgaatacctttagccatgattcagttccttagtactattagtacttctcaccacgggcacgcatgtcggctaacaccgtatcaatgccctttttatcaataatacgcataccttttacagatacacgcagagtaacgaagcgcttctcgctctcaacccaaaaacggtgtgagtgcaggttcggaaggaaacggcgtttcgtcgcgttcattgcgtgggaacggttgttaccggtcaccggacgctttccagttacctggcagactcgtgacatgtctattctccaaaaatcaaatcagctcgagctttaaaaattaggttttggccgcctcgtcaggcttacagcccgccaggcgagttccatggaacccgctaagctggcctaaccgccaaacccgagattctcaaaggtggcgtagtatacgccgctcggcccaagtgctcaagtcccgaacagataaagatcccgaatgatcgtgtaaaaagccgtcatctggaccagattttcaggctcagagccatccccgttcggtaaatgagacagattcaccatgtccaatcaccagatgatcgagcacgcgaatgtttaccaggcgacaagcttcgcagattttcaccgtaatgtcgcggtcagccttactgggctcggcttttcccgacggatggttatgcgcgatgatcaacgctgcagcgttaattttaagcgcctcgcgcacaatctctcgtggatgaacctccacactattaatggagccagagaacatttgccgggcggttatcacccgatgttgattatctaaaaacatcacgataaaaatctcacgttcctgttccgccaacagcatttgcagatactggcgtgttgcaatggggctatcgagcgtattttcacgggccagttggctggcaaaaaagcgtttagccagctcagcaacggcccggagctggattaacttaatttcgcccgcccctttaatgcctttaaaatcctcggcactggcgttcacgatgttgtatagcgagcccaactcttgcaacatctgctgtgccagcttcatcaccggtacgcctcttgaaccggtgcgcaaaaagatggctaacagttctgcatcacttaatgcatctgcgcccagtagcttaagtttttcccgtggtagaaaatgattcattgctgctctccctgtcgccccctgtatcatcccctgtcagtgaaaacgccaccagtgagcaaacgtgattcttcggcacatctcgcaaacgcagtcattgaaaaggtgcctgagaggttttgtgataaaattcgaccattccgccgtcccgaaacggcaattgaaaatgaggttagctgcatgatgggattagccggtaaaaaagtgctgttaggcgtaagtggtggtattgcggcctataaaacacccgagctggtgcgccgtcttcgcgatcgcggtgccgatgtgcgcgtgatgatgacccatgcagcaaaagcgtttattacgccgctcagcctccaggcggtatcgggctatccggtaatggacgatctgctcgacccagcagccgaggcagcaatgggtcatattgagttggccaaatgggccgatctgattctactggcaccggcatcagcagatgtaattgcgcgaatgacggccggtatggcgaatgatttagtgacgaccgccgtgctggctaccgcgtcacctgtcgcgattgtgcccgcaatgaatcagcagatgtaccgtgcagccgtcacgcaagcaaacctcgcgacgcttcagtcgcgtggcgtgttgatctgggggcctgacagcggcagccaggcatgcggcgatgtcgggccgggtcgtatgctcgacccgctggctatcgtggactacgcggtgcagtgggcaagccccgtcaacgatctgcaacatctcaacattatgattaccgccggtcctacccgtgaagccatcgaccctgtgcgttatatcagcaatcacagttccggaaaaatgggctttgccattgcgacagccgccgccagccgtggtgcaaatgtcacgctggtttgtggcccggtgaccttacctacacccaccggagttaagcgggttgatgtgacatcggcactggacatgcaggcggcagtgatgggcgagataaacaaacaacatattttcattgcaagcgctgccgtggcagactaccgggcagccaacattgcggatgagaaaatcaagaaacaggatgacgataatgatgataatgtcaccctgcaactcatcaaaaatcccgatattgtcgcgggcgttgccgcgttaccgcagggccggccgtttgtggttggatttgcggctgaaacccagaatgtggaagaatacgcccggaaaaaacgcgcgcgtaaaaagctggacctgatctgtgctaacgacgtgtcaaaagcaggacaagggttcaatagcgacaccaatgctcttcaccttttttggcaggaaggagaaaagaccttaccgctcagcgataagtcactccttggtcaacttttaatagacgagattgtcagccgttatgatgaaaaaaatagacgttaaaattctcgatgcgcgcgtcggcaaggatttcccattgccgacttatgcgacaccgggttccgctgggttagatctgcgtgcctgtattgatgatgcgatggaaatcgcaccgggcaccacaacactggtccctaccggactggctattcacattgccgatccgagccttgctgctgttattctcccgcgctcaggcttgggtcataaacatggcatcgtactgggtaacctggtcggccttattgatgccgattatcagggtcaactgatggtatcggtatggaatcgcgggcaggaaagctttacgctacagccgggcgaccgcatggcccagctggtttttgtacctgtcgtccaggccgaattcaatctggtggaaacgtttgacgccagcttgcgcggcgaaggtggcttcggtcactcaggccgtcagtaaccagcactaccgattttcacttacgccaatcattttatttctcatcgccataagtctttctcttgtggctgatgcgtaggtgttgcctgtttatggtgaaattcaggggtttttaagggcatggcagaaaaaaaagtcgtaaagcggaatcgtcgcgaagagattttgcaggcgctggcacagatgctcgaatccagcgatggcagccaacgtattactaccgcaaaactcgcggctaacgtcggtgtttcggaagcggcgctttatcgtcattttcccagcaaaacacgcatgttcgacagcctgatcgaatttattgaagacagtctgattacccgcatcaatctcatccttaaagatgaaaaagaaacgatggcgcgcctgcgtcttatcgtgcagctgattctggggtttggtgagcgtaatccggggttgacgcgtattttaacgggtcatgcgctgatgtttgaacaggaccgccttcaggggcgtattaatcagctgtttgagcggattgaggtccagctacgtcaggtgatgcgtgagcgaaaaatgcgagaaggtgaaggctttcacactgatgaagcattattagccagtcagttactggcgctgtgcgaaggattattatcgcgttacgttcgttccgagttccgctttagtcctactgccgagttcgacacccgctggccgctgatcgcggcacaactggtgtaatacgctggcgggctctggcccgccggcgatcagacgccgtacgctttttgatacgcacgcacctgggctaagtggtcagccatgtgcgttttttctgccaggtagtcaatcaggtcgttgagcgtaataatggcggtcaccttgcagccgtagtcacgttccacttcctgaatggcggaaagttcaccacggccacgctcctggcgatccagtgaaatcagcaccccagccagactcgcatcatgtgcattaatgatatccatggattcacgaatcgcggttcctgccgtgatgacgtcgtcgaccagcataattttaccctgcagcgggcttcccaccagcagaccgccctcaccgtgatctttggcctctttccggttaaagcagtaaggcacatcccggtcatgatgatcggctaaggcaacagcggttgtggtcgcgataggaatccctttataggccggcccaaacagcaaatcgaaatccacaccgctgtcgactaatgcctgcgcatagaaacgccccagcaacgctaaatcccgcccactgttaaacagaccagcattaaagaaatagggacttttacgacccgactttaacgtaaactcaccaaatttaagcacctgcttattcagtgcgaattcaataaactgccgttgccaggctttcatgtcttactcctcagataaaaaaggcgactctgtggtcgcctgttactttacttttccagcgctgctttttgcgcctgaattaattcttcgataccgccgcgcgctaacgccagcagtgccagtaactcttcatgactgaaaggttcgccttcggcagtgccctgcacttcgatcatgcgcccatcttccatcattaccacattcatatcggtttcagcggcggagtcttcgacatattcaaggtcgcacagggcttcaccgttaacgatgcccacggatacggccgcgaccatccctttcatcgggttcgctttcagcttaccgctggccaccagcttgtttagcgcgtcggccagtgccacacatgcgccggtaatcgaggctgtccgggtaccaccatcggcctgaatcacgtcgcaatcaagcgtgatggtgtattcacccagcaccttgagatcgacagcggcacgcaatgaccgggcaataagacgttgaatctcaagtgtgcgcccgccttgtttcccttttgcggcttcacgcgccatacggctgtgcgttgaacgcggtaacatgccatattcggcggtgacccagccctggccctgccctttgaggaaacgcggaacaccttcatccaccgttgcagtgcagagcactttggtttcaccgaactccaccagaacggaaccctctgcgtgtttggtgtaattgcgggtcaatgtgacgggacgcacctgatgtgcgctacggcctgctggacgcatggttatctccggcttgcaaatggttggctgcgtattatacggacttcctggcctgctgtctcttgccctggcccgtcaggctcatgatgaaattcatgttggagtatggctaaatgccttaccttttgccgcatatttgctaactgataaaactatggccgctatttttcatttcctgctggcgctggtggtgattttcgcccttgcgttactggtcagtcatgaccgtaaacacattcgcccacgctatattattcaacttattgtcgttgaagccgcactgggctggttctttcttcattctgccggtggactggcactcgtgggtgcggtgggccgcttttttgaaacgctgcttggttttgcagcgcaaggcacggagtttgtttttggcggcatgagtcaacaaggcctggcctttatctttcttggcgtactctgcccgatcgtttttatttccgcactgattggtattttgcagcactggcgcattctgccattgctgatccggctcgtgggaacagtcctgtctaaaatcaacggtatgggaaagctggagtcctttaacgcagtcagtacgctggtactgggccagtctgaaaactttattgcttataaaggtattctggccgatatcccacctaagcgcctttacacgatggccgcaaccgccatgtccaccgtttcgctgtccattgtcggtgcttacatgtcgatgattgaggctcgatatgttgtggctgcgttactgctcaatatgttcagcacctttatcatcctgtcgattattaatcccggcaaggaaagtgatgagcagcctgtcgcactggacaagttgcatgaagaacagagtttcttcgaaatgttgggtgagtacatcctggcaggctttaaagtggccatgatcatcctggcgatgctgattggttttattgccttgatcgcggccatcaacgccctgttcgccgccgtgtttggatacagtttccagcagctccttggctatgttttttatccctttgcctggctaattggtattcctgccgccgacgccctccaggctggcagcattatggcaaccaaactggtcgccaatgaattcgtcgctatgatcgagctgaagaaagtcgcggcaggcatgacgccacgaggattaggcatcctgtcggtattcctggtgtcttttgctaactttgcgtcaattggcattgtggcaggcgcgattaaggggctgaacgaacggcaggggaacgtcgtttcccgatttggctggaaactggtttatggttcaaccctggtaagcctgctttcggcggccttcgccggactgtttatctgattctttcacggcggccaatgccgccgttaatgacatcagaaactcacgcaggaaggcgaatcgacgcgcatgaccgattcctgaccaaactcttttttatactgctcgcgcagtgcttcaacacggctgttgctatcgctgtcaaaattataaatgagcaccaacgctttacttttctcacgcgccagttgaccgttttcactcagccattgcccctgggcatcataaaccgacaatccagatttaaagcgcggggtcacttctttatcgataaaacgcatccagtcctgtgaactcacgctgcccccttttggcttgctgagaccaaaccacaatgtggtttgcatcatcacttcaccgccagcgcaaatgggaacgggccgggtagagggcgcaagttgcagtgcagacggcggaggcggcgagtggcagccagccaacagcaaggtcagcagtacaggaaagcacaatacacgagacataaaagggatcctcgatgagtaaaccagtaaacagcataagtgcctgttgctaaaagcggaaataatttgttatctcatcctgttcacgcttacacctgttatggttagctttgcctcgttatactgacgctaatctttctgaaaatgagtaacgcttatgatccgcagtatgaccgcctatgcccgccgtgaagtcaaaggcgactggggcagcgccgcctgggagctgcgttccgttaatcaacgttatcttgaaacctacatccgtctgccggagcagttccgcgggctggagccgatgattcgggaacgcattcgtcagcgcctgacgcgcggtaaaatcgaatgtaatctgcgctttgatgctgacccgggcgcgcaaggcgagctgatgctgaacgagtcgttggctaaacagctggtgcaggccgctaactgggtaaaaatgcagagcgacgaaggctcgatcaatccgctggatattttgcgctggccgggcgtgatgtctgcgcaagagcaggatctggatacgatcaacacacagctgatccaggcactggatggcgcgctggatgatttcatcgacgcacgcgaaagcgaaggtagtgcattaaaagcgatgattgagcagcggctggaagcggtgacgcatgaggtaagtaaagtgcgtgctcaactgcccgacgtgatcaagtggcagcgtgaacgtctaatcgccaaactggaagacgccgaagtacagttggaaaacaaccgtctggagcaggaactggtcatgatggcgcagcgtgtggatgtcgcagaagagctggatcgtctggatgcgcatgtcaaagagacgtacaacattctgaagaaaaaagaagccgtaggacgtcgcctcgactttatgatgcaggaattcaaccgcgagtcgaatacgctggcctctaaatcaattaatgcagagatcaccaactcagcgattgagttaaaagtgttgattgaacagatgcgtgagcagattcagaatatcgaataaattctttcaaagtccacggcaatccataagcccatgttaaatgggcttttttattcaaactacagtctattgaagaccacttagattcattataaaccactaccaagtggggagtaaaacgggggagcgtttttggtttattagtctcatccggcagtttataaccatatcctccccacaacgatttttcatcaggataggtgtattttgatgaaagaaaagaagccttacaaagagttgcagcgaaaataagatttattaatgagcgttaggtttaatcaactttgttcgctagcaattgtttactttacaggcgtagtaatataacccgcattagaaggaacaacctgtctgattttttgaaaaaacgttaagaaaaatcttaattgcactacaaaaatatagttgtatagtagttgtacatttgagtgtaagggatttatttcgaatgaatgcaattgacagtaaactgataatctttacgaccaaaaaaaaattcaatgacagaaatgccgatgatatgcaaagcggtgatattgatgttgatacactaaaaaaacattaccatcttgggcaagtatcaactttcattgactggacaactttcggtccttcctataaacatccctatctgaattcaataccgccagtaagcaaagaaaaagccattgcaatactatatgatgaattaagatctcaatcatatgtattttctttccaagggccataccgggatttaatcaaagatcttttcaatcacatgcaacgaaataatggaagagattatcaaaatcccgcgatgaacaatgcgtacagaaatctaattttggctgacgattcaccgaacagcagcagatacataattaaaagagctatcgaacagtttgattttagcaaatcgaaactgacaaaagaaaatttcatcaatgatttatataacagttatttgccaaaatacacaagatggaaagattgggttaatggaatgggtattaccgttcatgacgtaaacagcacagagatttccattgaaagtctcgtaattgaaggaaataaatatactgcggttatcaaatacagagcacaggaccattttgggttagacagagaagacatactaaaacctaaatttaattcgattgcctttttcaggatatggtttgtacttcagcgggcaaagcatttagcacaaaaaccatttttcactaactttgaagcttctataacattgacaggagaaacaaatgttaaaatataaaaggattgtagtgattgtattttttttaatcattacatattgcacatggattgttttaagaccaataaaaatagtcagagtggataatggtgttgtttttgtagaacatttaccaatgacaacagagggaaaattagaatggtggatgaataacaaagaattattgcagaaaaaatatcatattatcaataaagagtataacttcacggttaccatcatgaattttaatggttatgaagaattacctaaagggacaatggacgggtctatcgatgactatacctgctttgatgatactgatgaaaagcatgaaaaatgtgtgtataaaaacatagcaataattattagaggaaaccttaatggaaaacaatttataaatattgatggtaaaacatatatccagacagatgataaaaaagtcgaattagaatgagcatcatttcctatatctagctatagattgagatgaaataatgggattctaaaatatttccaaacataacccaacgagggattattcgtccaacagtgatgtttaaatctttaagtttgaaaaaataaatctatataatcacaaaaaattaattaggtattttgtaatggcacactgaatttggccacctgaacagaggtgatatgctcacctcacaacattacaggtgccccaatgaaaagaagaagtttcagcgcagaatttaaaccctgccaaccgatagattgatatcatcaagcattaacacattatgaacctgtataatgccacatttatcacccttgaggtgataaataattaagcatgcagaacgctatctatcatgcgacttcctaaccttacagcgactaattctgcacgcttgctaaaagttattgtcttcacacgatataagtaaccattccattataagcatttgcgcttcatctcgttaacctcccgaaaagaaaacctctctgttaaaaaacgtcatcatcaatcatagaagcctgacagccgacaactcaggtaaaaaataagaatgaggaaaattcttatgtatgtaaaatcagtacatgacgttacgtgttagcacgtgtaatcgtgcctacctcaatgaggtatcactcagaatgcgtatgtaaggaatttgatacgctttgataagtacgattagttttaagttgtctttcattacccagaatgcgttattccgaaagaaatcattaattaaaagccaaatgcgaaaaaacgttcagaaacgataagcctgcttatttttaatgctcggtattataacacaacaaaaaaacaccaattcgctcacattttagtattaaaaaagcaaagatgagaaataaaaaacgaatgttctactaaagttttatttttaaatgccgttctttctttgtgaaaccaatcagagactgaagccatgaaaaaattaacttttgtgtttgtattaatgacgttatcgccattgtcttttgccactggcggacaaatcaatttcaaaggttcaattgtggaacccggttgtgacacgcttattgttaattctcagattaaacaaagttgcacgagaggaggtaaaactgaagccacaaccttgcgtatgaatgacagccaacaatctttgccgcttaagctgggtaaggtgcagttaaaaaaagtcggtgattttcgcctgatgacgattacctataactaggatttttcttttccagactcggtttttctcttaagccatacacgttacgtatgtgggtaaacgtgtatcgcttgtgaggataatttccgctgaatttccagttctcaaacatcctgaacagtgcgcacgcattcatcatgtagcttttcacaagaagcctgtgcatactcatgcatagtcattttttagatttttgccactaagaatgtaaatttatcgaaaagatggtggctgttgagtacagaactgtcttaatttccagacgcctgttttgctatcctcaacacacaaccgaaaaaataagacattgttttataaaaataaaattttttcacaccatcatttcttgctcgatgacgccccgatgcaatcgatcatcctaatcctgaagatgacgaaagctcactgtgacagagggcactttttgataaagtgctggtcgtagttagtacagccgtaccgcttgggaacttaaggaatgggtctttttgcgttacatccatcaatcctttaaggtcaatgatgaaaaacaccaggcagttcagcagcacccttttacatccccgttattggtttacatggtttggtcttggcattctctggctcttagttcaacttccctatcctgtcctgatgcgacttggcgcaggtgccggtaaactttcccgtcatttccttcagcgtcgagagcgcattacccgtcgtaacattgaactttgttttcctggcatcagtgatgaagacaaagaaagcatgattgcgggaaactttgcttctcttggtatggcgctgcttgaaacgggcattgcctggttctggccagaccacgccgttaagcgcctgtttactgtctcagggcttgcaaacctctattctgctcagaatgaaggccggggcgtgatgttaatcggcatccattttatgtctctggagctgggtggccgcatcagcgggttgtgtcagccgatgatggcaatgtaccgaccacataataaccgcgcgatggagtacgttcagaccaaaggccgcatgcgttccaataaggcgatgattgaccgtcgtgatctgcgcgggatggtacaggcgcttaagcagggcgaatccgtctggtttgcaccggaccaggattacggcccaaaaggcagtactttcgccccgctgttcgccgttgagaaagcagcgacaacaaacggcacatacgttttatctcgcctggccaagcctgcgatggtgccgatcatgctgattcgtaatccaggcaacgatggttataaactgattatcgaaccgattctggaaaactaccctcatacggatgaatcagccgccgctgcctatatgaataaagtgattgagagccaaatcatgcgagcgcctgaccagtacctttggctgcatcgccgatttaaaacgcgtccaccaggtgaagcgtctctctacgtataacgataaagcaggctcaagcctgctttattttttcatactgccgctatcgctctttccccgttacgactcacagcacgtgctcatccagcgtgcagatatcaatattctgtcctgaccataaaacggccgcacccgcatctgccatacctcctcttatgacgttgtgcctctctaccatgaacatattctgacgtctgggaaatttttacgttcagaatggataagcgctacgaccattgcttacataaccaccttgcactttctttgccccggcttaagtgtttcatacgggaaaaatcctgggtcatcgccttaaaacgacgctatgtataacgtttcaaagccttttttattttgtattttttactactgaatagtcatacgtgactttgccacaagtcgttatgaagcgtttatttagcaagtgagaaatatcatccagacaataaacattatcgcctttctcaaatcacatatcagattttccttatgatgttaacctcattaaaaagcgttataaattatctacacacagcaaaacctttataacgatataacagggatcgtttttaatgttcatcgttaaatgaagaacagaagaacaggtttgggcattaaacataaaaaagcatttagcactccatgtgatttttatacagtgctgatgtgctcaaggccgtgtttactgaaaaaccacaataaaatataaataaccccgagggtaagcaggcatcactgtctgcttaccgtcataacaatttacccggcgggaatattatggcgatacgtaaaataaatcttatacacgttaattggccgcttctttcatcgtttaaaatattaagcattggcgtattgcaactttccctgctgggtaaaattctgcaggctgaagcctttaatttattggctgttgtcattgctggattgctggtcattgacacactggcggatcgcgggttctcaaacagcgtgattcgttattcgacactctcagtcaataggttatcggttatttactggggcaacatactgctgggactgatcatttttgctgttttttttatttccggcattgttgtcgatcggctgtttaatcagccacagataaccatgatgcttgagatggctgccgtcatctttatcatcattcctcaggggcaacactatcgcgcgatattgcagcgcgaaaaacaattttccgatatcgcattttgcgaaatatcatccgtattcgtgggcctggtcattacactgctgacggtatggagcacaccttcggttttgtgcgcactatggggctacctggcaatggtgtcagtaagaatgctggcttactgctgttatggccgtatatggtttcaaccggtatatcaattcagtctgaaaacattcttccagatctgcctcaggaatatataatgcgcttgctggatgccggacacctgaaaagcggtcttgccgtgttgtcgatcagcacggtttttataagacctggcacgttgcatcaacagccttctccgctcgcttaacccacacttcacttgcgctcaccccgcatacgggctgccattaatcagccctgtagattcccggcttacactgtttcctttctctgtttataccaacataatgtcgtctcaaagagcctgagccgtgcaatacgtcaacggggagtaaggctgacccggtttatccaatagaatttgtgttgatacaggcccttaattttccataatttattgattaataaaagcttatcctgaaagggtgagtttttactgatactattaaagctattaacagaaaatctcagtcgcgccgttctcttcagtggcgtagccttgccgccgtcttcctggagcctgctatgttacttactgttctctatatccttggtatcaccgctgaggcaatgacgggggcgcttgccgctggccgtcgtaaaatggacctgtttggtgtgatcatcattgcttctgtgaccgcgataggcgggggttcagtgcgcgatattctccttggtcattatccgctgggttgggtaaagcatcctgaatacatcatgatcgtagccgctgctgccgtggtgaccacgtttgtcgcgccgttaatgacccatctacgaaaggtgtttctggtactggatgcgcttggtttggtggtgttttctattatcggtgcgcaggtcgccctggattcgggccatgccatgattattgccgcgatcagtgcggttattaccggcgtctttggcggcgttttgcgcgatatgttttgtaatcgtatcccgttggtgtttcaaaaagagttatatgccggtatcgcgttcgcatcaggctggatgtacatcctgctgctgaaaacccctctggcacatgaggttgtgattattatcaccttactctttggcttttttgcccgcctgctggccctgcgatttcgcctcggtttgcccatcttcaattatccccatcccgatcattgatgaggaagggataccctgctgctgtaaaaaggtaatcaacgttcgcagcccggcatccttaagatgtgaggtaatacgttctgcacgcaatgcgcccacgccgggcagagattgccagccttttacatcccgagtcagcacagcgtcccacgctttatcgtctaatgcgcgcagtgccttttgcggcagttcaatgcccaacgcattgagccagcgacgcaaaggttgtttccgggtcaaatcaaaccgatgccagatgtgttgtgctctctcggatgagatacccgctgcggtggcgatttgttctggcgtaatggtcagccaggaaaacagatgcgtaatacagccggtttccagtagccgttgccaggtactgcgttgcacaccaggaatgtctagcactgacttttggctcagccaactcaaacgcgccagtaactggcgatggcaatccggcgttaaggtataacaacttagtcgcgtgaattgctcaggttcaggcggttcagggtaatcccgctgcgccacgcgccagataacacgatcaagccgtggaatgccctgacccgcaaggctaatcgtcacctgatcgcctgcgataatatcttgctcacgccagcgttttagcgaccctatactgactcgcctgacggttttatcatccaactgcacaggttgcaggttcagtaccactgcgacttttcccgtgcgccctatcgaaaaatcaacggagcgtacctcactgctgaccgccggtggctgatatttccaggcgatagcccattccccctcacctggctgccagtactttcccgccggacgtgttgcctgatgcacgacaacgccatcggtgacaaaaggcaagggtgcatgaaaccagcgatcacgccagctttcagcatcctcttcatcctgaacgggttgggtccagtgactggcaagatcgaatccccatgcggccaatcgggtcaggcgttcatgcatactggctggcccgtcaggccagccccagataaaaatacccagttgttccagaagcggcgagtcttcctgactcatcattgcccccgcaacgcgggctctggcgttctttccgccatcggtcgcctgttgatgaccggtcatccgcaaaaaaagctcgccctgtaaaacaacggtagcgtcatcactgtcaatcatcgccggaatggcgggaatccgtctggctttcgccagccactgctcaccgtgtaaaccatctccacggctaattaacgacaccagttttccctgtcgatagattagcgagacggcaacaccatcgattttcggttggacccaaaggtcttgtcgcgtctgcatccagtaacccagtgcacgtttatcctgtactttttttacgcccgtatgcgcaaccggatgccacaaagtaccgtcccccggcaaagcaggctcatagtcgcccgccgtctgcgtaaaacagcgctgccagtggttaagccgctgctgcaaactatcgtaatctgcatccgcaaccagcgaatgcccctgctggtaatacgcgttatcccagtgccgaagctgttgttgcaggtgaccgatctcacttaccgcccgtgcaggcgtccatgcaggacacaaggccccacaggaataagttgggctgaataacagcatcagcccggcagttaacatccctttcatccgtcacctcctgattttttatcattcaagcgctgaacgtcaggctgagccagctgcattcgcgcgttctgggacggcttgtgtgaacattgaggtatgttttcagatgcgaaaagcggctttgcgtacctggtcgcataaacttttcaccgcgatggcggcgcaaacgctgcgtggcgcggggaagctgtgtatactgtgcaggaaatcgactccgcacttaatcaattcaagaaaatcatggcccaaggtacgctctatattgtttctgctcccagtggcgcagggaaatccagtctgattcaggcgctgttaaaaacgcagccgctgtatgatacgcaagtgtctgtttcacataccacgcgcggcatgcggccgggcgaggcacatggtgaacattacttctttgttcaacagcatgagttcgaaaagatgatcgaggaagatgccttccttgagcacgcgaaagttttcgacaactattacggcaccgcgcgtaagacgattgaacaagttctggcgaccggcgtagacgtttttcttgatattgactggcaaggtgcgcagcaaattcgcgctaaaatgcccgacgcgcgcagtatatttgtattgcctccttctaaagaagagctggatcgtcgcctgcgtggtcgcggtcaggacagcgaagaggtcattgcacgtcgtatggcacaggccgtggcagaaatgagccactatgccgaatacgactatttaatcgtgaatgatgattttgatttggcgttatccgatctgaaaaccattattcgcgcagaacgtctgcgcatggcccgtcagaaagcgcgccatgacgctttgatcagcaaactgttggcagtctgaacccagtttcagtatgatgccgagtcatttcttcatctgtggagtagcacacctatggcacgcgtaaccgttcaggacgcagtagaaaaagtgggtaatcgttttgacctggtgttggtcgctgcacgtcgtgcacgtcagatgcaggtaggcggaaaagatccgctggttcccgaagagaacgataaacacaccgttatcgcattgcgcgaaatcgaagaaggtttggtcaccaatcagattttagatgtgcgtgatcgtcaggagcagcaagagcaggaagccgcggagttacaggccgttaccgctatcgctgaaggtcgtcgttaacagctagctgcaggtcaaccttgtatctgtttgaaagtctcaatcaactgattgaacaatacttgcctgaggaccagattaagcgcctcaagcaagcctatctcgtatcacgtgatgcccacgagggacagacacgctccagcggcgagccttacatcacgcatcctgtcgcggtagcctgtattctggcagaaatgaagctcgaccatgaaaccctcatggccgcgcttttgcatgacgtcattgaagacacgcctgccacctatcaggatatggaacagctgtttggtaagagcgttgccgagctggttgaaggcgtttcaaagctggataagctgaaattccgtgataagaaagaggcgcaggcagagaacttccgcaagatgattatggcgatggtgcaggatatccgcgtcattctcatcaagctggctgaccgcacccacaacatgcgtacgctcgggtcgttacgtccggataaacgccgtcgcatcgcgctggaaacactggaaatatacagtcctctggcgcatcgcctggggattcatcacctaaaaacggaactggaagagctgggttttgaagcgctctaccccaatcgttttcgggtgattaaagaggtcgtgaaagcggcccgtggcaaccgtaaagagatgattcaaaaaatcctctctgagatcgacggtcgcctgcaggaagccggtattccctgccgggtaagtgggcgcgaaaagcacctttactcgatttaccgcaaaatgacgctgaaagagcagcgttttcactcgatcatggatatttacgcctttcgcgttatcgtgaaagatctggatacctgctaccgcgtcctgggccagatgcacagcttatacaagccacgtccgggccgggtgaaagactatatcgccattcccaaagctaacggctatcaatctctgcatacctctatgatcgggccgcatggcgtaccggttgaggtgcaaatccgtaccgaagatatggatcagatggccgaaatgggggttgccgcgcactgggcttataaacaagctggcgaaagcggcaccacggcgcaaattcgtgcccagcgctggctgcaaagcctgctggagctgcaacagagcgccggtagctcatttgaattcattgaaagcgtgaagtccgatctcttcccggatgagatctacgtctttacgccagaaggccgcatcgtcgaattgccgaccggctccacgccggtcgattttgcctatgcagtacataccgatattggtcatgcctgtgtgggcgcgcgcgttgaccgtcagccttatccgctgtcccagacgctcaccagcggccagaccattgagattattactgcgcccggcgcacgtcctaacgccgcctggctcaactttgtggtcagttccaaagcgcgcgctaagattcgtcagcttctgaaaaacctcaagcgtgaagactcggtaaatctgggacgtcgcctgctcagccatgcgatgggcggcagtcgtaaactggcggaagtgccggctgaaaacatcaagcatgagcttgaccgcatgaagctgacctcactggacgatctgttagcagaaatcggcctggggaatgcaatgagcgtggtggtggccaaaaacctgcttcaaactgacactaacgcgctcaataacaacaaaaaacagggcaagctgcccatcaaaggcgcagacggcgtactcattacctttgcgaaatgctgtcgtcctattcccggcgatccgattgttgcacacgtcagtccgggtaaaggcctggttgttcaccatgaatcctgtcgaaatattcgcggctatcaaaaagagccagaaaaattcatgccggtggagtgggataaagtcactgagcaagagttcgtggctgagatcaaggtcgatatgtttaaccaccagggcgcactggcgaacctgacggcagcgatcaacacggcgggctccaatattcagagcctgaatactgaagaacgcgatggccgcgtttacagtgcctttatccgtctgaccgcacgcgatcgcgtccacctggcgaatatcatgcgtaaaattcgtgtgatgccggatgtgattaaagttcaccgcaaccgtaactagtgcatgaatcctcaacgcttttctcgtattcaggaaatgctggccctgcgtcagcatgaccttaccgtctgcatggagcaggtgcataaaccgcacaacgtttccgcggtgatccgcactgcggatgcggtggggattcatgaggtccatgccgtgtggccaagccaacgcatgcgaacccaggcttcggcttcggccggcagcaatagctgggtaaaggttgtgacgcaccgttcaatcaccgacgctattggccatcttaaaacgcaaaagatgcagatactggcgacaaacctctctgctgacgctgtggattttcgtgagattgattacaccaaacccacgtgcattttgatgggtcaggaaaaaaccggtatcacagatgaagccctggccctggccgatcgtcacatcattattccgatggtgggaatggttcagtcactcaacgtttctgttgcgtccgcgctgattctttatgaagcccagcgccagcggcaaaatgccggtatgtatcaacgtcaatccagccttctggattacgaagaacaacagcgcctgctgtttgaagggggctatcctgttctggcgcgcgtggcaaaacataaacggatgccctatccccatatcaacgcgcagggcgagatagaagccgatgacagttggtgggcaacgatgcaagcaacaggcagaagtaagaaatgaaaggccgtctgctggatgccataccgctcagtaccctgaccggcgtcggcgccagccaggcagcaaagctggctaaaattggcctgcatactatccaggatttactgctacaccttcctctgcgttatgaagatcgcacccagctttatgctatcaacgacctgttaccgggaatttgggcaacggtcgaaggcgacgtgctgcataccgacattacttttggccgccgacgtatgatggtgtgccagatcggcgatggcagcggcgtgttaaccatgcgcttcttcaacttcaatgccggtatgaaaaacagcctcgcacccggccgccgggtaaccgcctggggcgaaattaaacgcgggcagcgcggcgcagaaattatccatccggaataccgcgtacagggcgagcacagccatgtgacgctggaagaaaccctgacgccagtctatcccacaaccgaaggcattcgtcaggcaacacttcgcaatcttaccgaccaggcattaactctgctggaaaactgccctattacggaactgttgccgcaggcgttaagcggcggactgatcagcctgcccgacgccttacgcacgctgcatcgtcccccacccgatgtcaaactcagcgaacttgaaagtgggcagcatcccgctcagcgcaggctgattcttgaagaactgctggcgcataatctcagtatgctggcggttcgggccggtgcgcagcgccactacgcgctgccgatgcccgcccgtcatacgttgagtgaccgcttactggctgccctgcctttttcccccactgccgcccaaaaacgcgtcgtggcggaaattgaaaaagacttagcgcacgattatcccatgttgcggcttgtccagggtgacgtgggatcgggtaaaacgctggtcgcggcccttgcggccctgaacgttatcgcccacggcaaacaggtggcgctgatggcaccgacagagttgctggctgagcagcatgccaataatttccgtcagtggcttgcgccacttggcctggaagtcggctggctggcgggcaaacaaaaagggaaagcgcggcaggcacagcaagatgctattgccagcggcaacgtagccatggtggtcggtacgcatgccctgtttcaggagcaggtgaagttcaacggtctggcgctggtgattattgatgaacaacaccgttttggggttcaccagcggctggcgctgtgggaaaaaggggaagagcagggtttccatcctcaccagttgatcatgaccgccacaccgattccgcgtaccctggcgatgaccgcttatgccgatctcgatacctcaaccattgatgagctgccgccgggcagaacgccggtgacgactgtggccattcctgacagccgtcgcagtgagatcattgcccgggtgcaaagcgcttgccatgaaggtcgtcaggcttactgggtctgtacgctgattgaagagtccgatctgctcgaagcccaggccgcagaagcgacatgggaagagttaaaaatcgcgctgccggacttgcaggtagggctggtgcacggccgcatgaagccagcggagaaactggcggtgatgcaggccttcaaagcgaacgagatacagctgctgatcgccacgaccgttattgaggttggcgtggatgtgccaaacgccagcctgatgatcattgaaaatccagaacgcctcggtcttgcccagcttcaccagctgcgcgggcgcgtaggccgtggcgcagtcgcgtctcactgcgtactgctgtataaagcgccgctaagcaaaacggcacagaagcgtttgcaggtgctgcgcgacagcaacgacggctttgtgattgcccaacacgatctggagatccgcgggccgggcgaactgctgggtacgcgccaaaccggtaatgcggagtttaaggtcgccgatctcctgcgcgatcaggctatgattcctgaagtacaacgcgtcgcgcggcacatccaccagcactatcccgaacaggcccaggcactgatcgagcgctggctaccggaaaccggccgctacagcaacgcctgacgcctttttttgcaccaccaggcaaacgtttgcttttgatccgtggacgattacaatcgccacacttttttttgggaaccgttacgatgtcaaccaatcagcagcttaacccgactaccgccagtaaaagtgaactgatttaccgtctggaagatcgtccgccacttacgcaaaccctgtttgcggccggtcagcatctgctggccatgtttgtcgccgtgattacgcccgcgctgttgatctgccaggcattgggtttaccggcgcaggacacgcagcacattatcagcatgtccctgttcgcctctggcgtggcatccgttctgcaaatcaaaacctgggggccggtcggctcaggcttgctgtccattcagggcaccagctttaactttgtgacgccgctgattatgggcggcatggcgctgaaaaatggcggcgcagatgtgcccaccatgatggcggcgctgtttggcaccttgatggtggcatcctgcacggaaatggtactgtcgcgggtgctgcatctggcacgccgtatcatcacgcctctggtgtctggtattgtcgtgatgatcattggattgtcccttattcaggttggcctgacgtccgtcggtggtggtttcgccgccatgaacgaccacagcttcggcgcgcctaaaaacctgctgctggccggtgcggttttgttggttattatccttctgaaccgtcagaaaaatccttacctgcgcgtcgcctcactggtgattgccatggcggttggctacctgctcgcctgggcgctggatatgctgccatccatcaatacgcccgcaaaccagccactgattgcgctaccgactccgctctattacggcctggggtttgactggaacctgctcatcccgctgatgctggtgtttatggtgacctcgctggaaaccattggtgatatcaccgccacctctgacgtgtcggagcagccggtgagcggacctttgtatatgaagcgcctgaaaggcggcgtgctggcgaatggccttaactcgtttgtgtctgccctgtttaataccttccccaactcctgctttggacagaataacggcgttatccaacttaccggtgttgccagccgctatgttggttttgtcgtggcgctgatgcttatcctgctgggcctgttcccggcggtcagtggactggtacagcatatccctgagccggttctgggcggtgccactattgtgatgtttgggaccatcgcagcatccggcgtgcgtattgtctccagagagccgctgaaccgacgcgccatcatgattatcgccctctcgctggccgcagggcttggcgtgtcacagcaaccgctgattctgcagtttgcgcctgactggctgaaaaccttgctctcttcgggtattgccgcaggcggtattacggcgattgtgcttaatctgatcttcccaccggaaaagtgattttaaaggcaggtcaggacctgcctgctatttatgctgatttacatccaggcggttgagctataacgctaattaaggcataacaacctttcagcggactgaacccgggaaggatacgatgaaatttataggaaagtttttcctcaccttattgttactgctactgtttgcgttagtggtgctgtatgtactgctgcagacacagtggggcgcgggctggtttagccgttgggtgagcgacaaaacggaatggcatctgtcgctgagtaaaatcgaacataacttttcatcaccctcgcacattattctggatgacttcagttttggccatgatggacagccggctgtgctggtcgccaggcgcgtcgacttgggcattgccctgttgcagttcagcgatccttttcactttgccagcatagaattacgtgacggtgaggttaatcttgctaacctggcaacgaatagcgcattacccgtgcaggctaaccgcctgcaactgaacaatatgcgcatcgacagcccctcttcggcgttaccgctttcagccctgcaggtgaatggcggtatagtgccgtgggccccgttgactggcgatgtgctgggacgggatgcgcagttccagatgagcgcaggcaagatgacgctaaaccgcgttgcgggtgaaaatgtgctgattcagggcaatgtgtcacagggccgcatggtgtttagcaacatcggtgctgatttagcccgcggttccatgaccggtaacggggaacgtgatgcgcagggaaactggaagatcaatcaactccgcctgaacgatatccgtttgcaaaccgccagcacgcttgttgatttcctgaaaccctttgaagaagtgcagtcggtgacgctaaaccgcgtcgacattaccgatgcccggctgcagggccctgactgggcggtaaccgatctcgatctgacactgaaaaatctcagctggaaaggccgggactggcagagtcaggatggttcactggcgatgaacgccggtaactttatcaacggcaaattcgagcttaacgatcccatcatcaacatggacttctcgccacaggggattgccctgacccagttcagctcgcgctgggccaacggcgtcatccgtgccgacggaaactggtcgcgtaacgacaagcaattgacgctgaataatcttgccgtcgcgggcctggaatatacgctgccgcagaactggcgggcgttatggcaggctccccttcccgactggctgggcggccttaccgtgaaccgtttcacctcaaaccgtaatttgatcatcgatatcaaccctgcgtttcctttccagctcacctcactggatggcagcggggagaatctgcagctggcccgtcagcatcaatggggaatctggtcaggtaaactcagcctgaacgctgcggaatcgacctttaaccgcaccgatctgcgccatccgtccattgcgctggaggctgacgatcaacaaatcaaggtgacggaactgagcgcgtttagtggtaaaggtttactggaaggcacggcaacggtaggacagcaagccgtccgtcctctcagcctgaatctcacggggcgcggcgtaccggtcaatgtcttgcaaaactggggctggcccgcgcttccactggaaggtgacagcaattttcagttgcgactcaatgcctcactgaaggacgggcagccgttagccccctcagttaatgccacgctttcggtgaatacagacagccagcaactgcagcaaaccatgcaggcaggacaggtgaagtaaaaacacacagggccgcaatcgcggccctgttgtttaattgatgcgtgcccctgagccgccttcttccagcggcccgtcagggtcaacgggcaacacgatgtagaccgcttcaaacaccgcgccacactcatcatcaccaaataactgcacatcaagctgaacccgggctttacggcctcgcgccaggcgatcgagatcgccactcaatgatccgaggtcggcaatggcacccggcctgcccgtaatcggacggctgtagcgtatgtgcgcatcagccagaataatggtgccgcccaggtggcgctcacgcagcaacagccagatcagtccccagccggtaagcgttgccagcgaaaacagacttccggcaaacagggtatggtgcggattttggttgccggtttccggcatggtggtaataaatttttgcccggtgtattgcaggatgcgcacgcccattttctcactcaacggaatgtgctcataccaggcctgctgcaactgcccgcaccagtcagcacggtgtaaaatatcatccagcgtgacaaccggtttaatcatcaggaagtgacgcaccggcgtggtttgcggtgcggtaatctcgccctgattgacgtatccgagcttggcgaagaacgccaccgcgtcctcacgcgcgctgcacgtcacgcgctttacgccttcctgacgcgctaccgactccagcgtcatcgccaccagcgtgcccagaccttttccctggacggtaggatgtacagcaaggaagcggatagccgcctcattatccgcattgatgtaaagtcgccctaccgcaacgggtttaccttgttcatccaccaccatttgatgatgcgctaacgcatcccaggcatcacgctcagaaccctgcggctgatgcagcggctttcgtaacatttcccagcggaactgataatacacatccagctcttccgccgtttgtggcacacgaagatgatacataaagtgtttctctcgttctgatgcggggttgcggatgtttagccgcgcggtatgtggcgtcatacctgtaaccagaaggttaccggcccgtcgttaaccaacgccacctgcatatcagcagcaaagcggccattggcggtcgtcacatcatggcgacggcaacacgcgctgaaatagtcgtagagacgttccgcttcttgcggctccgccccaccagaaaatgaggggcgcatgcccttttgcgtatcggcagccagcgtaaactgcgacaccaccagcgcactcccgcccgcctgtttgacgttcaggttcatcttgccctgttcatcactgaaaatgcgatagcccagtacgcgctccgccagccgctcggcgtgcttttcatcatcacctttttcaacacccaacagaatcaacaacccctgtccgatttcacccacaaccgcgttatcgatactgacgctggcacgctgtacgcgttgaattaaagcaatcatccgtcctctcgttctttttctctttcctgctgtttgaactggcggtagtcatctaaggtgacggtaatctctgcgccgaggagtacgatacaccaggtccagtaaacccacaggaataaaatggggatcaccgccagcacaccatagatcagttggtatgacgggaacatcgtaacatacagcgcaaagccctttttccccagttcaaataacagcccggcgaccagcgcccccgtaagcgcatcgcgcgcgggcacccgctgtgtcgggacaatactgtatagcagccaaaacgatagccatgataagagcaacggaaagaaacgcagcatctgatcgaccagactggttacccccgtcacatttatccacttcaacgacaggagataagagctgatggctaaactggcacccgccagtaacggcccgagcgttaatatcatccagtacaccgcaaaggaatagaccagcggccgctttttgtcgctgcgccagatagcattcagggccgaatcaacggaatgcatcagcaacagcgccgtcacgatcaggccgacggcacccacggccgtcatacgatggacgttggccacaaactgctcaagataacgttgtagcgtattacctgcagccggcatgaagttggtaaaaataaaattcttaagctggacgctgatgtcagagaacacaggaaacgccgcaaacagcgcaaagaccacggcaatcagcggaaccagcgccagtaacgacacaaaagccaggttaccggcctgcgtcgtcatggcgtcattatcaatgcgtttccacagcagctttagccacagccagaacgcatgaaacccggggcgaaaatgacgtaacttcatggcttaatgccgacccgcgaaccagtcaggtacggtggtgctatcggtcaccagcactgtctcaatccccaatgcgcgtgcaccctcaatgttctgcgcattgtcatcgaagaacacggtctgatcggcgctaaagccttcagcggccaaaacatgctgatagattctcgcttcgggtttgcgcatgcccagctcctgcgacaaatagatcttgtcggccgcctgctgcacgtcaggatactgcgtcggccagaaggtacaatgcagcgcgttggtgttggagagaatcaccactcgatgtccctcctgccgcagttgatgcattatcgccagcgtatctgggcggacgccaacgaatattgcctgccagcctgccgcaaactgttcatagctcagtgcgatatccaacttttcacacagggcttcagcgaaggcttcgtcactgatttcaccgcgctcatgctgctcaaatgcctcatccatatggaagtgactttgaagcgatgccaatggcacgcggctaaggtcactccagacacctaacacgcggttaaagtcgatatcaataatcacattgcccaaatcaaagatataaagcatggtgcctcctcgggttccctggatcattcactctagcggtaaaagcgcagcctgaacaggcagcctggacgagaaaaatataaacgctaagttaaggcacgacggcacgacgttgaaaggggatagagaagaagttacgggctggtttaggctggatttaactctgtatgacaatcgcgcaggcaaaaaaaagccccgttaaacggggcttcttacatgcatttacgcgtctttaggaccgcgtgaagcacgcttacgatcgttctcggtcaggtgacgtttacggatacgcacggactgaggggtaacttcgaccagttcgtcgtcatcaatgaactcgatagcctgctcaagtgtcattttgatcggtggaaccagtgtcgttgcttcgtctgtaccggaagcacgcatgttagtcagcttcttaccggtcaggcagtttacggtcaggtcgttagaacgactgtgaataccgatgatctggccttcatagacttctgcaccgtgacccaggaacagcttaccgcgatcctgcagaccgaacagggcgaaagcaaccgctttaccctgaccgttggaaatcagaacgccgttctgacgctggcccacttcgcccggacgaatatcatcgtagtggctaaaggtggagtacagcagaccggtacctgatgtcatggtcataaattcgttacggaaaccgatcaggccacggcttgggatcacgtagtcaagacgtacgcggcctttaccatctgggtccatgtttttcaggtcgcctttacgctcgcccatggcttgcataacggaaccctgatgcgtttcttcgatatccagcgtcacgttctcgaacggctcttgcttacggccttcgaattcgcggaagataactttcggacgggataccgccagttcgaaaccttcacgacgcatgttctcgatcagaacagacaggtgcagctcaccacggcccgatacacggaacgcgtcagcatcttcagtttcttcaacacgcagtgctacgttgtgaaccagttctttgttcagacgctcaaggatctgacgtgacgtcacgtacttaccttctttaccgcagaacggtgaggtgttgacgttaaagaacatcgtgaccgttggctcatccacgctcagtgctggcagggcctgcacattctgtggatcacaaatggtgtcagaaatgttcagttcacccagaccggtgatagcaatgatatcgcccgcttctgccatgtcgctgtcaatacgctccaggcccaggtgagtcagcactttaccgactttaccgttacgcgttttaccttcgctatcaatgatagtgacttgctggttaggcttcactttaccgcgcttgatgcggccgatgccgataacgcccaggtagttgttgtagtccagctgagagatttgcatctgcagcggcgcgtcagcttcaacctgtggaggcgatacgtggtcaacgatagcctgatacagcggggtcatatcgtcagccatgtctgtatgctcaagaccggcaataccattcagcgcagaggcaaaaatgatagggaagtccaactgctcgtcagtcgcatccaggttaacgaacaggtcaaatacctgatcaacaacccagtcaggacgtgcgccaggacggtcgactttgttgataaccacaatcggcttcaaaccatgcgcgaacgcttttttggttacgaagcgggtttgcggcatagggccatccatcgcatctacaaccaacagtaccgaatccaccatagacattacgcgttcaacttcaccaccgaagtcggcgtgtcctggggtatcaacgatgttgatacggtagtcgttccatttaatggcggtattttttgcgaggatggtaatcccacgctctttctccaaatcattggagtccatcacacgctcggtggcttcagtacgggcatcaaaagtaccagactgttgcagcagtttatcaaccagggtggtctttccatggtcaacgtgcgcgatgatggcgatgttacgcaaattttcgatcacagcttttttgcctcaggcattagaaataacgcggtattgtacacggattaagcgggagactgaacacgatcacacttttcactgaaagtttattgcattgtcgcaaaatcgcactactagccgtgcaaaatttgcactgtatcgaggttttgcaccaaaaaagtgctcactttcaattcagatgcacataaacggtgcgttgcgactatcatggtgcatgacttatatgacaaaaaggtgcatgacagcgcgattttgtgcaaagaaataaagttggcacagaattcgctttgtattatccagacgaaaacgatgtaagacaacggttgcagagctggtcaggatcagattcaggaatggtcgttaacagtcgttcattccgtaacccggttctcactatgtagacaatgaccatttccaggagagttgagtatgtccgctgaacacgttctctcgatgatgaacgagcatgaagttaagtttgttgacctgcgttttaccgataccaaaggtaaagaacagcacgttactattccggctcaccaggttaacgctgacttcttcgaagaaggcaaaatgttcgatggctcttccatcggcggctggaaagggattaatgaatcagacatggtactgatgcctgatgcaaccacggcggtgatggaccctttctttgaagattctacgctgattattcgttgcgacatccttgagccaggcaccatgcagggctatgaccgtgacccacgctctatcgctaagcgtgctgaagactacctgcgcgcttcaggcattgcggacaccgttctgtttggcccagagccagaattcttcctgttcgacgatatccgttttggttcttcaacgtctggctcacatgttgccatcgacgatatcgaagcggcatggaacaccagtaaagaatacgaaggcggtaacaaaggtcaccgtccaggtctgaaaggcggttacttcccggtgccaccggttgactcatcacaggacatccgttctgccatgtgtctgaccatggagcaaatgggcctggtggttgaagcccatcaccatgaagtcgcaacagcaggtcagaacgaagtggcaacgcgcttcaataccatgaccaaaaaagctgacgaaattcagatctacaaatatgtcgtgcacaacgtcgcccatgcctacggcaaaaccgcgacctttatgccaaaacctatgtttggtgacaacggttccggtatgcactgccacatgtcgctgtctaaaggcggtcagaacctgttctctggcgataagtacggcggcctgtctgaaatggcactgttctacatcggcggtatcatcaaacacgctaaagccattaacgccctggcgaacccgaccaccaactcgtacaaacgtctggtgcccggttatgaagccccggtcatgctggcctactcagcacgtaaccgttcagcctcaatccgtatcccggtggttgccagcccgaaagcgcgtcgtattgaagcccgcttcccggacccggctgctaacccatacctggcgttcaccgccctgctgatggctggccttgatggcatcatcaacaaaatccatcctggtgacgcgatggacaaaaacctgtatgacctgccaccggaagaagaagctgagattccaaaagttgcaggttcactggaagaagcgctgattgccctgaacgaagaccgcgagttcctgacccgtggcggcgtgttcactgatgatgctatcgatgcctacatcgaactgcgtaaatcagaaaacgatcgtgttcgcatgacgccgcacccggttgagttcgaactgtactacagcgtttaatttcagagtaagcaaatgggtgccgcagataaacattgcaaaggcggtaccgagagtctgaaacgtttttttgttgccgtggaaactttagcccatcttcggatgggcttttttctccgcgaattcatcgttcattcgctttaattccggcttaaagattacaatgcactaaattagtgcagaggaacgctgtatggcaactgcctcactgcccgatgcagggcagattctcaataccttaatcaacagtattttgttggtggataacgatttggttattcattatgccaatcctgcggcacagcaattactggcgcaaagttcacgtaaattattcggtacgccgttacctgaattgaccggctatttttcgctgaatgtcgaggtaatgcgcgagagtcttgaggcgggccagggctttactgacagtgaagtcactctggtggtcgatggccgggcacacattatgtcactcacggcacaacggttgcctgatggcttaattttgctggaaatggcgcccatggataatcagcgtcgtttgagccaggaacaattacagcatgctcagcaggttgcggctcgcgatctggtgcgtggactggcccatgagattaaaaatccgttagggggattgcgtggcgccgctcagctgctgtcacgcgccctgcccgatcccgcgctgaacgaatataccaaagttattatcgaacaggccgaccgcctgcggaatctggtcgatcgcttattagggcctcaacaaccgggtatgcacattacccagagcattcatcaggtcgctgaacgggtggttaacctggtctcgatggagctgcccgaaaacgtgtctctggtccgcgattacgatcccagtctgccggagttacctcacgatcctgaccagattgaacaggttctgctgaatgtcgtgcgtaatgcgctgcaggcgttaggcgaggacggcggcacgatcgtgattcgcacccgtacggcctttcagctaacgctgcatggcacgcggtatcgtctggtcgcccgtattgatattgaagatgacggccccggcattccggccctgctccaggatacgctgttttatcccatggtgagcggacgtgaaggcggaaccggtttaggtctttctattgcccgtagcctgattgatcagcattcaggaaaaattgagtttaacagttggccgggtcataccgaattttcggtttacctgcctattcgccagtgaggtttctatgcaacgagggatagtctggatcgtcgatgacgatagctccatccgctgggtgcttgaacgcgcgctcactggagccggtttgagctgtgcgacctttgacagcgcgaatgacgtgctgaacgcattagcgacgaaaaccccggacgttttattatcagacattcgtatgccaggtatggatggtctgacgctgctaaaacagattaaacagcgtcatcctatgcttccggtcatcattatgacggcgcactccgatctggatgccgcggtcagtgcctatcagcaaggggcatttgattatctgccgaagccgttcgatatcgacgaagctgtcgcgctggttgagcgcgccatcagtcactatcaggaacagcagcagccacgcaatcaacccgtcagcggcccaacgaccgatattatcggtgaagcacccgccatgcaggacgtgtttcgtatcattggccgtctttcccgctcgtcgatcagcgttctgatcaacggtgaatccgggacgggtaaagaactggttgcacatgcgctgcatcgccacagccctcgtagtaaggctccttttattgccttaaacatggctgcgattccaaaggatttgattgaatctgaactgtttggccatgaaaaaggggcgtttaccggtgccaatcaaatccgccagggccgttttgaacaggcagatggcggcacgctgtttttagatgaaatcggcgatatgccgctggatgttcagactcgcctgcttcgcgtcctggctgatggacaattttatcgtgttggcggctatgcgccggtcaaagttgacgtacgtatcattgccgcaacgcaccagaaccttgaactgcgggtgcaggaaggcaagttccgtgaggatttgttccaccgcctgaacgttattcgcgtgcatctcccgcctttgcgtgagcgccgtgaagatattccccgtctggcccgttatttcctccaggtggcggcacgggagcttggcgttgaagccaagatcctgcacgcggaaaccgaaaccgcgctaacgcgtctgcactggtcgggtaacgtgcgtcagttggagaacacctgccgttggttaaccgttatggcggcggggcaggaagtgctgatccaggatttaccgcctgaactgtttgaatccagcacaccagaaagcccgacgcagtcgttgcctgacaactgggcgacactgctggcgcagtgggcggatcgcgcgctgcgttccggtcatcaaaatctgctgtctgaagctcagccggagatggagcgcacattactgaccactgcgctacgtcatacccaagggcacaagcaggaagcagcacgtttgctcggctggggaagaaataccctgacgcgtaagcttaaagaactgggcatggaataagaaaccaacccgccgggacagcctgtgctgttccggcttttatatcacgcgtgaaaacggctgttgccgcgctttttgtcgtaaacaggcatcgaagcacatacaaatattacgaatcagtaaccgtccgatccccgtcactctcagaccggttgcgtcctgctccaccagcccatcagccaccagcggttttaacagcgccaggtcttgcgcaaaatacgtttcaaagtgaaggttccactgggcttccaccgcgctgaagtcgagcgagaagttgcagatcagcgctttgatcacatcacgacgtaagcagtcatcatcacgtagcgttaaaccccgccacaacccatgaccctgtttttcgacctggctgtaccagtcgttaaggcctttctggttttgtgcatagctgtcgccaatcatgctaatggcagatacgccgagacccagtaagtcgctgtcgccctgggtggtataaccctgaaagttacggtgcagtttcccctcgcgctgtgccactgccagctcgtcctggggtttcgcaaagtgatccatgccgatgaactgatagccatgctgagtcagcgttgcgatagtttgttgcaggatgtccagcttctgctgtggcgacggcagctcatcgtctttaattttacgctgtgcggcgaacagtgcgggcagatgggcgtaattgaagacgctgagacgatcgggatcgagtgcgataacgcgctgcaaggtataagcaaaactttcgggcgtttgcagcggcagcccgtaaatcagatcaatgctggttgaacgaaatccctgctcgcgtgcccgcgccattaaggcaaaaataaccgcttcatcctgaacccgattaacccgctcctgcaccgctttattaaaatcctgtacgcccatgctcaggcgattgaaaccgcacgcacgcagatgatcgatcacatccagttcaatttcacgcggatcgacctcaatcgacatctccgcgtcatcgacaaaggtaaagtgctgtttcagcagcgccaccagccggctgatctgctgtttattgagaaacgtgggcgtcccgccgccccagtgcaactggctgacctgacgaccacgaaacaacggtgcgcgagcaacgatctcctgctcaagcgcatccagataacggtcggctttgtgcagttgacgcgtgacaatcttattgcagccacagaaatagcacaggcgatgacagaacgggatgtggatatacagcgataacgaacgttgtggatagcgctcggtcgcacgtctgaagtcatcggcggtaaagttatcgctgaacgctaaggcggtgggataagacgtgtagcgcggcccggcatagttatacttttcaattaacgccgggtcccactcaagctgcattgctgacatgcttactccttccgtttacgtcgccgttgtaaaggtcgcgatacagaaggaaagagaggagagcgggcgggaacccgacgtaaacgctgcttcagacgcgacagtcgttgtagtttaaacattaaccacagcagataacatgtcatcaacaaccataaaattgatccaggccaaaacattgtcgtttacctgttaagcggggcatgcggattaacgcatgccgatcaaaaatgcttaattacctttaagcaggcggtacatatcttcttccgcctccttgtcctcttcttcgtccatctcaatgccaagctgttccatcagttcgtcaatgcgatccagggtgacgtcgagccagccctgatcatcagatgacagcgtctcacctttttcaagacgatccagcagcgcatcaaggcgctcactgttctcaagctgcgccagctcttcttcaggcgtaagcgcggcttttttctctgcggccggtttagccgcgacttttttcactttcgccggtgtggcgttttcgccagcaatcaatgccaccggctttttgctgccaatgcgtggatctttcgcggcgtcactttgtttgctggtgttgctctgagtttgcgggttagcacggctgccagacgcatgaccgcgatgctttttgtcgcgtttacgatcgcgcgcttcatgattgatatcgtcacgcgatttgcgtttagctttggcgacaggcttacctttcgcagcgcttgcaggttgcttcataatattgggtcccggtgttttttattcagtatagaattgcggcgaaatctagcagaaaccagacaaagaaaaaaggcgacagctcaagctgtcgccttatttcataccttcggcagaaggaatcatgtttcaaatccgtttcggctcacaacatcccggttaatcctgcgcctgctcaactcttgagcctgtccttttccttttccggtccgacatccctgaccatttccactccagccgctcttcgtcatcccgacgttcctgagcgcatcatcctgatgagtacgtcctgcactgctgaataatgtagaccatctggtaaaaccctcaagtaacacttgcggggtatttgagcgtaaaaacctatacttaagtataatgccctgaattttaatcatttatttttttaattatttaattaaaaagagacataactggcaagatttatggcaaatgtctcacaaccttgcctgaccaatggtattgagcactttcacgccataacgcgtataatcagcgccattgccctaatgcgttcctggagtatcaccttgtctgaactgaattaccatgtcacccgcttcattcttagtgcaccggacatccgccatttgccttctgataccggcatcgaagtggcgtttgctggccgttcaaacgcgggtaaatccagcgccttaaatacgttgaccaatcaaaaaggcctggcgcgaaccagtaaaacgcccggtcgtacgcagttgattaacctgtttgaagtcacagaaggtaaacgcctcgtcgacttaccgggttatggctatgccgaagtgccagaagagatgaaacttaaatggcagcgggcgctaggtgagtacctgcaaaaacggcaggcgctcaaaggcctggttatactgatggatattcgccatccgcttaaagatctggatcagcaaatgattcaatgggcggtagagagcggcatccctgttttactgctgctgactaaagctgacaagcttgcttccggcgcacgtaaagcccagctcaatgtggtgaaagaagcctcaatggcgtttatgggtgatgtgcaggtagagattttctcatcgctgaaaaaaattggcgttgataaagtgcgtcaaaagctggatagctggtttagtgagcttgagcatgctgtagaagatcaggacactgaggcataagcgaagcgatgtgctacgtatttttagcgtttttccaataaaaaacgccccagtcacagaatgactggggcggctaaattcagccaaatccgattacgtgaagtaaaaggtctgaaagatagaacatcttacctctgtaccctacgcctcgaactttacctgattttttgtgagcgacaaagggttttttgttgctccctttcatttttaatcactttttttaccgcactcgtcacaaaaacgagagtgggatgtagttaaattacaaaaaaagtgcttaggccataataagttactgcaccgttttgcggcttcagcgagggccgacgcctgttccctgcctgcccacgggacatcgcataaccggtggcgcgttaacgccaccggttatggccgtatcagtgcgcttgttcccaattatctccgacaccgatttcgaccagtaagggcacatctaacgccatactgccttccataagcgtgcgaatctgcttgctggcctcatcaacggcatcggctttaatttcaaacaccagttcatcgtgtacttgcatgatcatccttaccgcatcatcgttctgcttctgcagccagctatcaaccgcaatcatggcgcgtttgatgatatctgcagccgtcccctgcatcggcgcattaatcgccgcacgttcagccgccttacgacgaatggcattactggacttgatgtcaggcaaccacagacgacgtccatccagcgtttcaacataaccgttactggccgcgagctggcgcgtgttttccatataacgcagcacgccgggatagcgttcaaagtacaaatccatatactttttcgcttcgcctgcgccaatgtttagctggcgagataacccaaatgcactcatgccatagatgagaccaaagttgatggccttggcactacggcgttgttcgcccgtaaccttactgagcggcacgccaaagacttctgaggcggtggcgcggtggatatcctcaccctgggaaaaagcatccagcaggcctttatcctgcgacaggtgcgccatgatgcgcagttcaatctgcgaatagtccgccgcgacaatgcggttacccttgtctgcgatgaaggcctgacggatgcggcgtccttcatcgttgcgcaccgggatgttttgcagattaggatcggttgaagaaaggcgtccggttgccgtcaccgcctgatgataagacgtgtgcacgcgcccgctaacgggatttatcatcagcggcagcttgtcggtgtaagttgacttcagtttcgagagtccacggtgctccagaatcactttcggcaggggatagtccagagccagctctgccaacacttcttcactggtagagggcgcgccacccggtgtttttttcgtgggcttaattccctgcttttcaaacagaatgacctgcagctgtttcgtcgaagaaagattgaagggctcacccgccagctcatgtgctttaagctcaagctcagccagacgcgatgtcagctctttcgagtgctgcgccaggatagcctgatcgatcaacacgccattacgttctatacgtgaaatcactttaagcagcggcatttcaatctgttcaaaaacctttttaggtccggcttctttttcaagctctggccacatcttcagatgcagctgtaaggtcacatcggcgtcttctgctgcgtagtgcgcggcctgctcaagggctatctgattaaaggtaagctgatttttacctttaccggcgatctcttgaaaggtgacggttttatgattcagccagcgcgcagagaggctgtccatatcatgcttgcctaccacgctattcaggatgtaggactccagcatggtgtcgtatttgataccggcaagttctatatcgtagtttttcaggacgccacgatcgtatttgagattttggccgactttgctggcgttaggatcttccagcagcggcttgagttgcgccagtacggcatcgcggtcgagctgctccggcgcatccaggtaatcatgtgccacaggcagatatgccgcatcacccggcgctaccgcaaagctgagaccgataatgttggccgttaacgtgtccaggccatcggtttccagatcaaaggcaaagacctcgctgtttttcagcttttcaacccaggtgtctaaggtttgctgatccagaatggtgacatagccgtcagttgataacaggctggtcgcttcaacgatcgccgccggctcatcagccagggcctgctgggattgtcggttgctcttattaccctgcaaccattttccttcttgcaggtcagtcaaccagcgcttgaattcgaaacggctaaacagcgcctgcagtgctttgacatcaggttcactgaccgtgagcgcttcgcacggctgctcaagctcaacgtcagttttgatggtggcaagctgatacgagagaaaagcaacatcgcgattctgctccagcttagcggccatggtttttgcaccacggaatgagagatcggcgactttatcaagattatcgtaaatcgactgcatcccacctaacccctgcagcagcgcctgggccgttttttcacccacgcccggcacgccaggaatgttatctgaactgtcccccatcatcgccagaaaatcgatgattaaagcgggcggcacaccatacttttgttccacttcttccggcccaagaatggtgttggtcatcgtattaatcagggtaatcgccggcgtgaccagttgcgccatatccttatcgcctgtactgatcaggacagaatagccttttttctccgcctctaacgccagcgtgccaatcacatcatccgcttcgacaccgcttacggctaacaacggcaatcccatcgcgcgcaccatttcatgcagcggttctatttgtgaccgcaaatcatcgggcatcggtgggcggtgggatttgtaatgttcaaacagctcatccctgaaagttttgcctttagcgtcaaagaccacagcaacatgtgtagggctgtattgtgccaacaggcttttcagcatgttcagcacaccatacatagcaccagtaggctcacctgcagtgttggttagcggcgggaaagcgtggtacgcgcgataaagataggatgagccatcaaccaaaatcagggggttttctgctatttgcgccatatgtctgtgtattcttcattgccatggattggtctataaggatgccacaccttggcgaaaagggttaatcaagacaaaccgagatcggcgtttttcgtgcttctgtaatcgggatcgcaacgatctttctgtggataactttgtgcgtaaaaattatatcaatagtttatttatagtataaaaaagattgaggctaaatttaatcacataaaaacaatgagttaatttaaatccgtgatgcgatcgtgatttttaatggcatgtttgcttgtgtggatagaaaaactgtgcttcctcaacctgccagcgatgtgcgtagtgattacaaatgaaaacgccagcgtatgctggcgttatgcagggtattcagcgtaaaacgcttattttttctcaaccaggaacttaaccacgttggcataatccgccacaaagttcgccatcgagctggtatccagaccaccgttattaaccatgtatttaccgttaataaagatcgctggcacaccgcgcagatcaacatcagaggccgctttttgctgctgggccaccaacgcttttaccgcaaagctgttccaggccgcatcgtattgctcagaggagatgcccgctgctttaatgaatacctctttcaggctggctgcgtcagtaatcgtctgggttttctggatgccatcaaaaataggtgacgtgactttatcttctacgcccagcgccatagccactgcccacgcatgcgtaacaaccggacctaagtcgccaccaaggaaatcgacatggtatttaaccatcttggtatcagctggcagattttttttcactgcatcactgacatggtagatttgctcgaactggtagcagtgcggacagaaaaaagagaaaaactccatgacctgcggctcacctgctataggcttaggcaggctaacgtactgtttaccttcagaaaactgtgcagcagatgcgctaaacgccagcaccaaaccaatcagtgcaaaaaatattttcttcattggggaaaactctcctgacttttcattaaaattgcggggccagctgcaacggcggttcccgtaacaccttttcctgctcgataaactgcaaaatttgcctgcgccagaaatcctcatccgtcatccaggggaaggcgcgcggaaaagcaggatcctgccaacggcgaaccacccaggccagataataaatcatgcgcatggcacgtaaaggctcaatcagtgacaattcattaatatcgaagtcgctgaattcactgtaggcgtccagtaaaatatcccactgaatacgctgttcctgtctatcgccactgattaacatccacaagtcctgaatggccggaccattgcgggcatcatcaagatcgacaaacagcggaccatcacgccacagaatattacccggatggcaatcaccatgtaatcgtagtggctgccagtcactgtgccagcttttgcgcaacgtcacgccgagtttatcgacggcttcgagcagtgcattgcgaagtgaggctggcacgagcctggtttttgccagttcctcccgcggctgatccagatattcttcaagccctatcgatggacgttgctgaaacaggcttttgcggccagtttgatgaatacgtcccaggaaacggcctacccattccatctgatcttcgttgtcagtttcatactgccgtccacccaggctgggaaagactgcatagtaaaagccagcatgacgttgcagcgtatcgccctgcaaaactaacggcgcggcaatcggcacctcatcgtccagcaaatcctgggaaaaccgatgctcttcggtgatctgttctgcactccagcgctgagggcgataaaacttggcaacgtagcgacgtttttcatcgtcgctaaactgataaacacgattttcatagctgttcagggcggttaaaccagaatccacccgaatacccgtttcccaaagcgcatccaacaggacatcaggattgagcgtctggaagttaaaggcggcatcactcatggttatccctgtgcttatctttacggttaatcgccaaggataacactactcgtcatttttgatgacaccacgtgctcgtagcagggctgttttaaaatcaacttcataatcttttttcaggcctggaatctgatcgtcgctggctgaatcacgcatttttagatgataaatcaatacgtcatcgcttaattcacttaatgggccaatgaaaccggactcttgtgccagtttttgtaaaaatgccaacaggttaagatcgggttctttttcccacgccggtagcaggagttcaagcaattcagtcagccgatgcgttttcatgacgattccttaatgcagggtgcgttatatccagaatgaagcaaggagacaaaaatgacagcattcaccggtgtaatccttgctggcggacaaggtagccgtatgggtgggcaggataaagggttactcatcatgcggggtgaaccactttatcagcacgttttgcagcggttgaggccacaggtagacattgtgttaataagtgctaaccgtaacattgatcgttatcagctaagtggttgtcaggtcgtaacagattcgattaaagactaccctggaccgctggcaggtatgctgagtggtttgcggagcagtcccacagaatgggtggtattttgtgcctgtgatacacccaatatccctggcgatcttgtcgcacgtttatggcagcagcgtaacaacgctcttgtcgtgtgggtcaaatcgtcacagcgagatcatcccaccctggcgttaatgaataaggcgatcgccgacgatcttgaagcctggttgatgcgcggtgagcgtcgactgatgcaatttatgcgtgagcatggtgggcattcggtgtcgtttagcgacccggagtcggcttttagcaacatcaatacgcctgacgactttgtggagcaggagaaatcataatgtgtgttccgttgttggccattgtcgcctggagtgggaccggtaaaaccacacttcttgagcaggttatacccttgttaagggcgcaggagatacgtgcaggattgattaagcatacccaccatgacatggacgtagatacgccaggcaaagacagttatcgactgcgccaggccggagccgatcaggttattgtcgccagcgaccgtcgttgggcgctgatgtgtgaaacgcctgagcagcctgtgagtttaatggcgttagcacggcaaatggacagcagacaactggatgtggtgttggtagaagggtttaaaggtgaaccaataccaaagattgtgctttggcgatcgggcgtgaaaggtgagcttgcagcactactggatgagaacgtcgtggctgtcgccactgacgacatgacactaaagctggacgtgcctgccatgaatatcaaccagccagaagcagtggccgcgtttatcatgacatggctgggtaaaaagaagcattaaggacagagaggtagggagtgagagcgtctgtgagcaagttttacccagatcagcggcgttctctgcagggctttttcatcttcggacggagaaagtgacgtaaattccgttatgacggacacgccatccggctttctcacgcgccgtttcatcccggcccggcggttttaatgacgcggacggcgctcgcgcagtcccggccgcgcagcataaccggcctgacgccccgctttccgcaggttacggacgtaaaaaagccctgaactttcgttcagggcttcttcacttgtttgatgcctggcagttccctactctcgcatggggagaccccacactaccatcggcgctacggcgtttcacttctgagttcggcatggggtcaggtgggaccaccgcgctacagccgccaggcaaattctttgtgcacgaaacgactcttttacgccatgaacgcgttgcattcgctctgccgcaacggtcacatacttcagtatgctcccgctgacgtcatcgctctgcgccttctcatgccgcaaaatctgtcgtttccgcaaattcttttccggtaaacaatgctgaaaatttaatcgtctctcaaccaaaacgcctctggcgttgtaaggttaagcctcacgggtcattagtaccggtaagctcaacgcatcgctgcgcttacacacccggcctatcaacgtcgtcgtcttcaacgtcccttcaggacccttaaagggtcagggagaactcatctcggggcaagtttcgtgcttagatgctttcagcacttatcttttccgcacttagctaccgggcagtgccactggcgtgacaacccggacaccagcggtgcgttcactccggtcctctcgtactaggagcaacccccctcaattctccagcgcccacggcagatagggaccgaactgtctcacgacgttctaaacccagctcgcgtaccactttaaacggcgaacagccgtacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgagccgtcactctcgcagtcaagctggcttatgccattgcactaacctcctgatgtccgaccaggattagccaaccttcgtgctcctccgttactctttaggaggagaccgccccagtcaaactacccaccagacactgtccgcagcccggatcacgggcctacgttagaacatcaaacattaaagggtggtatttcaaggttggctccacgcagactggcgtccacgcttcaaagcctcccacctatcctacacatcaaggctcagtgttcagtgtcaagctgtagtaaaggttcacggggtctttccgtcttgccgcgggtacactgcatcttcacagcgatttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttcagcttgcgcttaaccccatcaattaaccttccggcaccgggcaggcgtcacaccgtatacgtccactttcgtgtttgcacagtgctgtgtttttaataaacagttgcagccagctggtatcttcgactggcttcggctcggggagcaggtcccttcacctacgcgccagcgtgccttctcccgaagttacggcaccattttgcctagttccttcacccgagttctctcaagcgccttggtattctctacctgaccacctgtgtcggtttggggtacgattttgtgttacctgatgcttagaggcttttcctggaagcagggcatttatcacttcagcaccgtagtgcctcgtcgtcacgcctcagtgtaaagtgaaccggatttgcctggaacacacacctacacgcttaaaccgggacaaccgtcgcccggctgatatagccttctccgtccccccttcgcagtaacaccaagtacaggaatattaacctgtttcccatcgactacgcctttcggcctcgccttaggggtcgactcaccctgctccgattaacgttgaacaggaacccttggtcttccggcgacaaggtttttcaccttgtttatcgttacttatgtcagcattcgcacttctgatacctccagcatgcctcacagcacaccttcaacggcttacagaacgctcccctacccaacaacacatagtgtcgctgccgcagcttcggtgcatggtttagccccgttacatcttccgcgcaggccgactcgaccagtgagctattacgctttctttaaatgatggctgcttctaagccaacatcctggctgtctgtgccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagccgggatggccccctagccgaaacagtgctctacccccggagatgagttcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccagttaagactcggtttccctgcggctcccctatacggttaaccttgctacagaatataagtcgctgacccattatacaaaaggtacgcagtcacccccataaagaaggctcccactgcttgtacgtacacggtttcaggttctgtttcactcccctcgccggggttcttttcgcctttccctcacggtactggttcactatcggtcagtcaggagtatttagccttggaggatggtccccccatattcagacaggataccacgtgtcccgccttactcatcgaactcacagcctgtgcacctttgtgtacgggagtatcaccctgtaccctgcgactttccagacgcttccactgatgcacaagctgatgatggttctgggctcctccccgttcgctcgccgctactgggggaatctcggttgatttcttttcctcggggtacttagatgtttcagttcccccggttcgcctcatgcagctatgtattcactgcatgatagtgtgacgagtcacactgggtttccccattcgggtatcgccggttattgcggttcatatcaccttaccggcgcttatcgcagattagcacgcccttcatcgcctctgactgccagggcatccaccgtgtacgcttagtcgcttaacctcacaacccacaggcgtttatctgtaataccgtaacggctgcgcgtaaagaatgcgtcgttgcgcggtgctcgccatgctcacgtacttcagtacgctccgctggctgtgcgccgacgcgccttgctttcttcactgctcgcgcgctactgcataacagttagcttgtaagctgtaagcttttgagagactcgaacgcgttgtgctgtgttccttattacggaggaacacgacaatgcgtcgtttcaaattttcagcttgttccggattgttaaagagcaaaatcttaaacacgactcgtaagtcatctttaagatatgtgggcaacacctttcacctgtcaccaagcaagtggcgtcccctaggggattcgaacccctgttgccgccgtgaaagggcggagtcctaaccgctagacgaaggggacacggacgtgtctcgacttcgcagccgtcttgcttctttatctttctatcagacaatctgtgtgagcacttcgcgggaaggtatcttcaggtaaggaggtgatccaaccgcaggttcccctacggttaccttgttacgacttcaccccagtcatgaatcacaaagtggtaagcgccctcccggaggttaagctacctacttcttttgcaacccactcccatggtgtgacgggcggtgtgtacaaggcccgggaacgtattcaccgtggcattctgatccacgattactagcgattccgacttcacggagtcgagttgcagactccgatccggactacgacgcactttgtgaggtccgcttgctctcgcgaggtcgcttctctttgtatgcgccattgtagcacgtgtgtagccctactcgtaagggccatgatgacttgacgtcatccccaccttcctccggtttatcaccggcagtctcctttgagttcccgaccgaatcgctggcaacaaaggataagggttgcgctcgttgcgggacttaacccaacatttcacaacacgagctgacgacagccatgcagcacctgtctcacggttcccgaaggcactaaggcatctctgccgaattccgtggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccactcctcaagggaacaacctccaagtcgacatcgtttacggcgtggactaccagggtatctaatcctgtttgctccccacgctttcgcacctgagcgtcagtcttcgtccagggggccgccttcgccaccggtattcctccagatctctacgcatttcaccgctacacctggaattctacccccctctacgagactcaagcctgccagtttcaaatgcagttcccaggttaagcccggggatttcacatctgacttaacagaccgcctgcgtgcgctttacgcccagtaattccgattaacgcttgcaccctccgtattaccgcggctgctggcacggagttagccggtgcttcttctgcgggtaacgtcaatcactgcggttattaaccacaatgccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgcctaggtgggccgttaccccgcctactagctaatcccatctgggttcatccgatagtgagaggcccgaaggtccccctctttggtcttgcgacgttatgcggtattagccaccgtttccagtggttatccccctctatcgggcagatccccagacattactcacccgtccgccactcgtcacccgagagcaagctctctgtgctaccgtccgacttgcatgtgttaggcctgccgccagcgttcaatctgagccatgatcaaactcttcaatttaagtttgatttgctgaaaccagttcagcggtgctcatctgtaaaacgtcataatgaatttcattatgtgttcactcgtgagacttgatattttttacgtccggagacgctgatatcaatcctgcgagtgcccacacagattgtctgataaattgttaaagagcagtgcgaacagcgggttaaccgtctgtcgcgaggtggcgtatattacgctttcctccttcagagtcaacctctttttcagaagtttttctccggcggctcagtttcctgaacctctcaacaccgcattccgtaagccgttgtgccgtgtcagtggaggcgcattatagggaattctctctgagtgacaagcattaattacaaaaaaatgactgagcggtttatttttaaacgaacgtgctaaaaaccaacacttcctgcctaaagaacgcacggaaatcaccacacagtcatgaaaagaggcgtattgtgcatttctgccaatgctattcttcttcattatctttgctgaaaacattacgaaggacgctcaatgatcacatccgcgcgcagtatggccggtctgccatggattgccgctatggcattctttatgcaatcactggatgccaccatattgaataccgctctgcccgcgatcgccaccagccttgagcgttccccccttgccatgcagtccgccgtgatcagctataccttaactgttgccatgcttatcccggttagcggttggcttgcagatcgttatggcacacgcaaaatcttcatgattgccgtctctctctttacgctggggtcgttagcctgcgccttatcgccctctttatcggttctggtcacttcacgcatcattcagggagtcggtggcgcaatgatgatgccggtggcccgcctggcactcctgcgtgcttatccgcgcagtgaactcctgcccatccttaactttgtgacgatgccaggtttagtggggccaatccttgggcctctgctgggcggtgttatggtgacgtatgccacctggcactggatattcctgattaacatccctattggcatacttggcatattctatgcgcgaaaatatatgcctgacttcaccacgccaaaacgccgcttcgactttctgggctttctactgttcggaattggattggtgatgctctctacaggtatcgagctatttggtgagcgcattgtctcgccctggattgcggcagcggtactgtgcggcggtattgtgttattgcttctctatatagtacatgcccggcgccatccttctcccctgatcaatctgcccatgtttaagacccgcaccttctcggtaggtatcattggcaatatcgcttcacgactgggtacaggctgtgttccatttttaatgccgctgatgcttcaggtgggattcggttattcagcgattctggcaggatgcatgatggcaccaacggccgttggctctattctcgcgaaacagagcgtgacgcagctgctgcgctggtttggttatcgccgcttgctggtgagcattacggtaatcatcgggtttatgatcgccagcttctccctgcagtcgccttctgaaagcatcgcgttattgttgataccgctctttctgctgggcatggcgatgtccacccagtttacagcgatgaacacgattactctggccgatttagatgacgacaacgccagcggtggaaatagcgtcttagccgtaacgcaacaactggctattagttttggcgtcgcggtcagtgctgccgtactgcgtttttatcaggaatttgatggcacgacggtagaacagttccattctaccttcctgacgatgggcattgttaccgtgctgtcggcgctgacatttatgatgctgcgcaacggtgacggacgtaacctgattagcaatcgggacaaaaagaagaaagcttaaaccgagcctcgcggtactaactccggcgtcagcaccagcgtttgctgactgacgtcgggattgctcagacgatgaatcagcgtatctatcgccagttcgcccagctcgtctttgggttgatggatggtactgagcgggggtgacatatagcgcgccagttcaatgtcgtcatatcccattaccgccatatctcgtggaatctgcaatccggcctgatgcaacgcgtgataaaccccgaccgccatcgcgtcattgctggtaaaaacggcatgtgggggcctgtccagcgccagcaattcaaacattgcgttgtagccgcctgaaaactcaaagtcgccactcacaacatattcgggcggaacatccagaccgtttttctgcatcgcctggtaatacccttccagtcgcatacgcgccggcgttttatcaagcggccctgaaatacaggcgatacgtgaatagccactatcaataagatgctgtgttgccagttcaccgcccagaagcgcattgtcctgaataatatcgccccggccttcaaaaggtgcccagtccatcatcaccattgggatagaaggataacgattaaggatttcagccgagggtagatggctttcagtgcacatgataagtaaaccatccacgcgtttttgcagcagcgtttccagactgcggttcatgcgtgcttcatcgcctgcggtattacacagaatcaggctgtatccacgctcatagcaactgtcttctacgccgcgcacgacttcagcataaaaagggttactactggcggtcagtaacataccaatggtattggtttggttaagcttaaggctacgtgctaatgccgacggcgcataattgagatcgcggatcgcctgttcgattttttcacgcacgccatcactgacaaaacggttcttattgataacgtgtgaaaccgttgaagttgacactcccgccagtctggcaacatctttcatcgtagccaagcgcttaaccctgctgctgtaaaaagtcgtcgatctccgcacgccagggtacagaaggctgggcgccagaacgggttaccgcaattgccgctgcggcgtgggcaaagcgaacggcatcatgcatggccttaccttcaagacgagctgtgataaatgccccgttaaacgtatcgccagccgcaatggtgtcgaccgcgttaacgtcaaaacccgcaatgcgctgccctttaccattttcactcaaccagacgccgcggcggccaagagtgatcaagacggtcgcaatacctttgtcatgcaatgcggcggcggcacgtgcggcatcgtcatcattattaaccgcgatgccggtgagaatttctgcttcagtttcattcggcgtaatgatgtcgataagcgctaacaaactatcggacagttttgtcgccggggcgggatttaaaattacgcgggtctgatgctgtctggctaaggtcgccgcagctaaaacactgtccagtggcgactcaagctgcatcagcaaggcatcggcctgcgcaatcacctgctggtgacgttcgacatactgcggcgttaacgccgcgttagcaccggaatagatgccaatattattctcaccttcgccgttgacgaaaatcatcgcgacaccggtagattcaccttcgaccgcttctactggatgggtatcaatattgtcctgcgctaactgctggcagatgcgttcaccaatgtcatcggcaccgacacaggctataaaggcaatatcggcccccgcacggcccgcggcgacagcctgatttgcgcctttaccgccaaacgcaatctgatatttctgcccgatcaccgtttcgccggggcggggaaagtgagccagattaaggatatggtcagcattgatgctaccgagaacggcaagttttgcgtttttgctcattgggagagtccgaaataagtgcgccaccgacgggtgacgcagtgccctgcttttcttcgatttatttggtaaccagtttcaggtcgaccggattgatcgcctgcactttttcacctttcagcactttatcagcagtctgaacgccgatcatgccaattttctctggcatctgagccacggtcgcggccagttttccgccttcaaccgctttcacaccatctggcgtgccatcaaaacccacaaccattacatcggttttgcccgccgtttgcagcgcacgcagtgcacccagcgccatttcatcgttctgagcaaacacagcctgcacatccggatgcgcctgcagcaggttctgcataacgttcaaacctttagtacgatcaaagtcagccggctggctggccagaatctggaatttatgtgcatcagcggcctgtttaaaaccttcgccacgttcacgtgcagccgaggtacccgcgatgccttctaattcgataattttcgcgttatcacccagtttacgtgcgatgtagtcacccgccattttaccgccaaagcggttatcagatgccacgtgactgaccacggtgccctgtgcagcgacacggtccagggtgatcaccgggatcttcgcctggttagccattttgattgcgttgccgacagcatcagaatcggtagggttaatcagcagcactttcgtcccgcgcacggttaagtcctgaacgttggccagttcttttgccgggttgttctgtgaatccagcacgaccaggttgtagcccagtttatctgcttctttctgtgcaccctctttcagtgaaacgaaaaacgggttgttcagcgtagagataactaaggcaatggtatctttagccattgcgctggcgctgagcgttgcaccaaggatcacagctaatgcagttaactttttcatcattttatcctgtataaaggtctgagttatttgctgcttttattgtccaccagcaccgccagcagaatgactaccgcttttacgatcatctggtagtacgaagatacacccatcagatttaaaccattgttcaaaaagccgaggattaatgcgccaattaaggtgccaacaatccggccctttccgcccgccaggctggtaccacccagaacaacggcggcaatggcatccagttcataacctgttccggccgtcggctgggcggaagaaagacgggcgacttcgatagaacccgccagcgccgccagcatgccggacagtgagtaaacaatcacttttacccggttaacattaatgccggaaagacgtgttgcggcttcattaccacccagcgcatagatatagcggcccaaccgcgtgtggtgcagcatgtaccaggctgccacgaacaccaccgccatcagccataccggtgtaggaatgcccaacggacgaccgataccaaaccagccaaacaggtcggcattgtcattaaagccggtattcacagggctgccgttggtgtacaccatggtgacaccgcgcagtaacaacatcatcaccagcgtggcgataaaagcctgcaccttaccgcgcgccacaatggtgccggtgaccgcaccaatagcagcccccaacgccagcgaagccgctacggcaacaaaggcatttacctccatccccaccagcgaggccgccaccgcgcccgtaagcgccagcagcgatcccacagacagatcgataccggatgtcagaataaccagcgtcatgcccaccgccatgatggcgttgaccgatgtctgctgcaggatgttgaacaggtttgccaccgtaaagaaatttgggctctggctcgcgaccacggcaatcaacacaatcaacgcaatcagcgacttttgctcaagcaaccaggctttgctgaaccagcgacggttagacggaacggtttgggtggtcatacaactaaatcctcactgtgttgcttaccgacggctgccgccatcaggctttcctgagtagcgtcttcacgggtaaattcgccgcttaaacggccttcatgcatcacgacaatgcgatcactcatgcccagaacttctggcatttctgacgacactaaaataatgctcagcccttcggccttgaactggttaataagctgataaatctctttctttgcccccacgtcgacaccgcgcgtcggttcatcaagaatcaatacgttggggcgcgtcatgagcccgcgggcaatcgcgactttttgctgattaccgcctgacagcaggccaatcggctgctccattgacggcgttttaacgttaaataagcggataaagtcgctgacggcgagttgttcttcagcgtgcctgagtctgccgcccatatggctgaagtagcgcagtgcggtcagagacatgttctcttttactgacatgcccagcaccaggccatcgcgcttacggtcttccgagatatacacgatgccattggcaaggccatcctgtggtgagcgagtcaccacttcacgtccactcagccagatctgcccggcgctgcggggcgcagcaccgtaaagaattttcatcagttcggtacgtccggcgcccatcaggccagacacgcccagaatttcacctttacgcagggtaaacgagacgttatcgacgccaggcccgctaaggttttccactttaagacgcacttcgcccggagcatcgtcaacatggggatactgatcttccagtttacggcccaccatcatctcaatgaggctctcttcactcagatcgctgacggcacgttcagcaataaactggccatcgcgaaacaccgtgacgtcatcgcaaatctcgaaaatctctttcatgcgatgggagatataaacgataccgcagccttgcgctttcagctcattgatgacccggaacaacgacagggtttcggtatccgtgagcgcgtcagtcggctcatccataatgatgactttcgactcaaaactcaggaccttggcaatctcgaccatttgttgatcgccgatggataaatcgcccaccagcttatggctgttaaaacgcagattcagacgtttcagtagcgcgtcggcctcggcatacatccgcttccagttaatacagccaaaaccattgacgaattcacgccccaggaaaatgttttccgcgacggttaactgagggatcaggttaagttcctgatggataataccaatgcccgcttcctgcgatgctttaggtccgctaaacgtggtttcttcaccaagccataacagcgaaccggcgtcacggctgtaaataccggtgagcaccttcatcatggtggatttgccggcgccgttttcacctaccaacgccattacgcgtcccggccagactgacaatgacgcaccattcagcgctttaacgccgggaaatgatttttcgatgcctttaagctgcagtaagggttgcataatggcctcagaaggtcacacctgcgctcaggatgacattcgcaaacggagaacactctccgctgcgaatgaccgcctggctacgttgtgtttgttgtttgaactgttcatgactgatgtagcgggtagtgatggtgtttccctggtgctgttgcaatgcgtcgagcacggcgatcagttcgctgtggagctgcggattgtgccgcttaatctcttccgcaataaaggcgctttccacctgcatctcaagcgtaacggcttctaccacctgcataaatcccggcgtacccggcgtcagcgccagatcgatacgttgtggtcctgccggaatcggcaagcccgcatcggcgatcgttaacgtgtccgtgtggcccaggcgggcgataacgtgagagagttcagcgtttaacaagcgaccttttttcatttttacactccatagcgaaacgtttcgctttctggagtgtataaaaaacaggttacaattcaaccacaggatcaaaaatttgtgatcgttatcgaaacgtttcgctgttgcagaaaagaatttgagttaggcgcatagccagagcggaaaatggaccgccggggcggtccatttggggggcgttatggcagcttcttgacctgtttaacatccagctcaatgctgttgaaatctttatccagttcacccgtcagttcgacgcgatcttttggcgaaacggtcaggccgttccagcgcttgtggtcaatttctaccttcatcgtgccggtctcgtcacggaacaggtaatcttcgtcgccaatctgcttttcaagctggccacgaacggtaatccagctgtcatctttcatttcttcagcctgtttcaccgtcacaacgctgctttgaccggctttaaaaccgccttgctgatgatgtgctgccggtgctgacgcattcgggtcaacgaatccgccctgttgagcggcaaataccggcgcagaagccagcatagtcacggctaatagtgcagcatactttttcattttgtcacctcttgtccatgaagctgttatgtcagtggctgtagtaaaacatagagttcttaacaggatcttaaggcgaaaataacctcagtttttagccaaactcgctgtacaacggtcacccagcttcgtataaatcgcttatcaaaagggagagagaatgcgaattttactcattgaagacgatcgcctgattggagatggcattaaagcagggctcagtaagctggggttcagcgtcgactggtttgtctcaggtgaggcgggttttcaggcattaacggcggcaccgtgggatgcggtcgtacttgatttgtcccttccggagcgtgacgggctggacatattgcgccagtggcgtcagcaggggcacgatgtgccggtccttatcctcactgcccgcgatgccctggatcaacgcgttgaaggattacagatgggggctgacgattatctgtgcaaaccctttgcccttacagaagttgccgcacggttacaggcattgattcgccgccgccacgggcaacttcagcccgaactgcgccacggggatgtggtattgattcccggcaatctcagcgtagaaagaaacggcgaaaacattgcgttaaaaagccgtgagctggcgctgcttgagctgtttatgcgtaatccgggtcgggtactgacacgtagccagcttgaagaaaagttgtatacctgggataccgaagtgtcgagtaacgcggtggaagtgcatattcatcatctgcgtaagaagctcggtaatcgctttatccgcactatccacggcgtgggttatacgctgggagacagcgaatgcgatcgatgagtttgttcctgcgtcttggcattggcctggtgctgatcctgggcatttgctggggaacagcgacgctcagcgcctggtataaaacgcgtgacaccattaatgagctgtttgatacgcaacaaatgttgctcgctaagcgcctgctgaccctggactttacctcgctcaacggcacgtcgctgccaaaaacgaaagcgctgttacaccataaccgtggcgaacaggacgatgacgcgctggccttcgcggtattcgaccgcgcggggaaacagatcctcaacgatggcgataatggcaaagatctgccctttaatgcggatcatcaaggtttccagaatggccagcttaacggtgatgacgatctctggcgttttgtctggctgaccacgcccgatcaacgttaccgtgtcgtcgtcggccaggagtgggaataccgtgacgatatggcaaaagatctggtcaatgccggcatggtgccctggctgatttccttgccttttatgctgctgatgttgacgggtctggtctggtacgaacttcgtccactaaaaaaactgagccagcagcttgccgcgcgcgcgcctgatgatgacgcgcccttgcaggcccagcgcgttcctaaagaagtccgcccgttgattgatgcacttaacggcctgttcagccgcattcataccatgatgcagcgggaacgccgcttcacatccgatgcggctcacgaattacgcagcccgctggccgcgctgcaggtgcaaagcgaagtcattcagttggccgccgatgacgaggcgatgcgcacccacgcgctgcagcagttggatgccggtatcgtccgggccacccgcctggttgatcagttgcttacgctgtcgcgcattgaagccgatgatgtccgcaaggcgttccagcccgttatgctaaaaaaggtggcacaggacacgctggcttcacagttaccgctggcagataaggctgacattaagttatgccttaacgctaccgccgatccggttatttcgggacatgcgctactgctgtctatgctgatcagaaatctgctggataatgctatccgctatacaccatcaggcagccgcgttgaccttacccttagccagaatacgttaaaggtggaagataacggcaacggtttatcggcagatgaactgcaacgcctgggggaacgtttctggcgtccgccggggcaggaaaaaagcggcagtgggctggggttatcgatagtgcgcaatattgcacagctgcatggcatgacactgcactttgctccgcatcccggcggcggattatgcgtcacgctacgttggtaacacactgcgcctgactggcaggcgcagtcgtcgtctaaatctcgacctgcgtacccagttctattacccggtttggcgggatctcaaactgatcgggcgcacgtagcgcattgcgttgtagcgtcataaacaacttgccgcgcagacgcaaataccagggccgtttaccgataatcagcgactcatgggacataaagaaagacgtctccatcatccggcagttaagtccttccagaccgcaacggtggaaaatctcttccacgttcggtgtttcgcgccagccgtaactcgccaccacgcgccagaaggtgggcgacagctgttcgatggtgacgcgccggacgttatgcacgtaaggtgcatcttcagtacgcagggttaacagcacgacgcgttcatgcagcaccttgttgtgcttcaggttgtgcagcatggcaaaaggaataacgttcagtgcacgcgacatgtaaaccgcggtgcccggcacgcgcacaggcggcgatttttccagagaagcaatcatcgcctccagggagttaccgtgttcatgcatgcggcgcagcaaacgaaaacgttcgctcttccacgtggtcatcacgataaacatcatcagcgccagcgtcagcggcagccagccaccagagaaaatcttgatcaggttggccgagaacagcgacacatcaatacacagcatggcaattaaaatcagccccaccagataccgattccagtgccagttcagtatcgcgacggtcgcgcaaagaatagaggtcagtaccattgtccccgtcaccgcaataccgtaagccgcggccaggttactggagtgctcaaagccgatgatgacaatcacaacagagaaataaagcagccagttaattaccggaatatagatctgcccagactcattttctgatgtatgaacgatgcgcatagggggtaaatagcccaggcgcacggcctggcgggttaacgagaaaaccccggaaatcaccgcctgtgaggcgatgacggtggctaacgtcgccagaattaacatgggaatcagcgcccagtcgggtgccagcaggaaaaacgggtttttgatcgcttcaggatgcttcagtaacaacgcgccctgaccgaagtagttgagcaccagcgaaggcagcaccaccacaaaccatgccagccggatagggaatttaccaaaatgccccatatccgcatacagtgcttcgacgcccgtaatcgccagtaccaccgcgccgagcgcaaaaaaggaaactgtcttatattccacaaagaagtgcagcgcccagtaggggtttaacgcctgtaatacctcagggttattaagaatgctgcgcgcacccagtacggccagcacgataaaccacagcagcatgacgggcgcgaacagtttacccacgataccggtgccatgtttttgaatgacaaacagcagggtcagcacggcaatggccatcggcacaatatagctgtcgaggcttggcgcagcgatttccagaccttcaatcgccgacaatacggatacggcaggggtgatcaccacctcaccatagaaaaaactgccgccaatgagccccataatcaccaggatcgcagtggcacgtccgcccgtatttcgccccgccagcgacatcagcgtcagaataccgccttctccggcattgtcggcacgcatcacgtagctgatatatttcagcgacaccaccagcaccagcagccagaaaatcagcgaaagaaagccaaagaccgcatcccgttccacgccaaagccaaactgccccgaaagacattcgcgtaaggtgtaaagcgggctggtgccgatatccccgtagacgacaccaatggcagccagcgttaatccgcctagtgagtgcttattatccgagctcataaaattatcttttgttggagtctgagaggcgcacaagccatcaaaaagcgcacagtatgcacgtattcacaaaaattcctacctccgtcgtggtaacagacggccatcccctgttttttctgttgcctgcaatctttaaagccgtgttgtcgaaccttctgaaacaaaaaagctgacatcgattaacgctttcgcgcatcataccctatagagtattgcgttcgctaaaacgcggcggctcgacgattgtaaggacattgatgtgattatggctcaaccccatcttttggcagaaagaatttctcgtctcagcaatgcgttagaaaaaggtttgtatgagcgtcatcatgccattcgcctttgtcttctcgccgccctcagcggcgaaagcgtgtttctgctggggccgccgggcatagcaaaaagcctgattgcccgccgcctgaagtgcgccttccagcatgcccgcgcctttgagtatctgatgacccgcttttccacgccggaggaagtgtttggtccactgtcgattcaggcgttaaaagatgaaggccgctatcagcggctgaccaaaggctatctaccggatgcagaaatcgtatttctggatgagatctggaaagcaggcccggcaatcctcaacacgctgctcaccgccatcaacgaacgccgtttccgcaacggcgatagcgaagaaaaaatccccatgcgcttgctggtcacggcctcgaatgagctaccggaagccgacagcgggctcgaagccctctatgaccgtatgttaattcgtctgtggctggataacgtgcatgaaaagcagaacttccgcagcatgctgactcatcatcaggatgaaaatgacaatccggtcgccgaatcgctgcgcatcagcgacgaagagtatgtgcaatggcaacaaggtatcagtcaggtcacgctgcccgataacgtgttcgaactgatctatcagctacgtcagcagttggaaaagttgccagacgcgccttacatctccgatcgtcgctggaaaaaagccatacatctgctgcaggccagcgccttttacagcgggcgaaacaccattgctccgctggatcttatcttgttgaaagactgtttgtggcacgacgtcacttcgatgcaacttctggatcgcgaaatcgatcagttgatgacgcaacatgcctggcaacagcaggccatgctactcaggcttcagcaactcaaggcgcgacgtctggcactgcaacagcagcaaagcgtggccgtcgccattacgcttgagaaacacagcggcatgttcagccgtaaaccgcattacgatatgcccgaaagctttaccgatgcgcagttgaccctgatgctgcaaaagccgcttacactgcatgatatgcaggtcacgcatctggttattgagcgtgaagcgctgaatcactggctacagaaaggtggtgacgttcgcggcaaattaaacggcattggctttgcacaaacgctggatatgctggtggatgctcaacattgtctggccgtgcgtgatgtcagtctgcaaacgtccaggctgactctgccaggcgcaagcagcagtgatgcgctgcctgaggaaatccgcgaagcgctggatgaactcgacagccagctacgtcagcagcgccatcagttcagccagcaacaacgttgcctgtttatcagtgatgactggctggctcgcgtcgaaaccagcctgcaggacgtggcggaacaacttaaacaggcgcgtaaatgatctctctggagacgctgagtaccctgctgtcaatcggtgaaaccgaactgattgaagagttaattctggcactcctcgcgtccccacagctggccctgttctttgaaaaattccccggcatgaaaaaggcgctgttacgcgacgttcctcgctggaaggcggagattgatgccgaactcaaagccacgcccgtaccggaagcgctggcggaagagtttcagttattccagcgtattcagttactcagcgatcgtgaattcagccagcagcttgatgaaacccttgctcaccttgaacgtctgacgtccccttttctggaagaagcacaacgcctgctgcttcataacgatcccggcaatcttagcagcgctcagcatacgctgttcctgcaacgctggcggctcagccttacgctgcaaacgctcacgcttaatgagcagcttcttgagcagcagcgcgaacgtctgatggccgagttacagcaacgtatggcattgagcggtcaactggcgccggttctggcagacgatgacgaagccgcagccggacgcttatgggatatgggcaaagccccgcttcagcacggcgactaccagctgatgctgcaatacggtgagtttctggcgcagcagcctgaattaatgaagctggcccagcagttaggccgcagccgtgaagcaaaatcggttccctcgcaggacgcaccgatggaggcctttcatcacctggtgcgcgaacctgatgccgtaccggaagaagtcagcggcattcatcagagtgatgatgtgctgcgtttgctgccgcccgagctggcggcgttaagcgtcagcgagcttgaacttgagttctaccgcaggctggtagagaagcgactgcttacttacaaacttcagggtgatgcctggcatgaaaaaatcacccaacgtcccgtcagccaccagcagcacgaagaacagccacgaggtccgtttatcgtgtgtgtcgacacctccggttcgatgggcggttttaatgaacgctgcgcaaaagccttttgcctggcacttctcaaggtcgcactggccgatcgccgccgctgttacatcatgttattcgcccatgacgtaattggttacgaattaacaggtgatgacggactggagcaggccatccgttttctcagccaacgttttcgtggcggaaccgaccttgcggcctgtctttcagccgtggtcaagcggatggagggcgcgttatggcacgatgccgatgccgtgatagtgtcggattttattgcgcagcgcctgccagaagaggtggtacgcagcgttaaacaccgtcagcagcaacagcagcagcgcttccatgccgtcgccatgtctacgcatggaaaacccggcattatgcgcatcttcgatcacatctggcgtttcgataccggcttaaagagccgcctgttacgtcactggcgccgttaagcgaggcagcagaaattccattttgctttatagtaaatatctgcaattacttattcagcaatcaggagtgtcctgtgaataccgttcaaccccatcgcgatttacctgcgccgacccgtacgctgatgctctctggccaaaatgtcgaacaaaaacgtgcagagctgctggcttacttcaatcagacctgggcgctgtacgaagacctgtttacctgtcttaacgatcagcgcgcctggtttaccaaagcgattcccctgcgccatccgctgatcttttattttggtcacaccgccaccttctacattaataagttaatggcgggccgttacatcgatgaccgcattgatgaccacattgaagccatgctggccatcggcgtggacgaaatgagctgggatgacctcaacgacaaccattatgactggcctacagtggaagccgtgcgcgactatcgcggcagcgtaaaagcattagtgacgcaatttattcaggagatgccgcttgaactgcccattcgttgggacagcccggcctgggtgatccttatgggcattgagcatgagcgaatccacctcgaaacctctagcgtactgattcgtcagttgccggttgaatgggtgaaaccccagccgcagtggcctgcgtgtgctgaagcgcgccatgaccgacagtcagtacccgcgaatacgctggttccccagcccggcggtcacatcacccttggcaagacagatgagacctatggttgggacaatgaatacggtactcagcaaattgagctaaaaccgtttaaagccagcaaaatgctggtcagtaatgcagaattttatgagtttgtgcaggctggtggctatcgggaaactcgctggtgggatgaagaaggtttgggctggcgtcagtttgcgcaggcagagatgcccaccttctgggtgggcgacgctacgatgcccgatcagctaaaactccgcctgatgtgtgaagaaatttccatgccctgggactggccagcggaagtcaatcagctggaagccgctgctttctgtcgctggaaagcagaagaaaccggtaaatcagtgcagctaccctgtgaggctgaatggtaccaactccgtgggcaggtagaaggcgatcagccagactggcagcaggctccgggcaatattaacctggcttactgggcttcttcctgcccggtcgatcgtttccctcagggtgagttttacgacatcgtggggaatgtctggcaatggacaacgacgccgatcaatggttttgaggggtttaaagtccatccgctgtatgacgatttctctacgcccacctttgatggtaagcactcacttataaaaggtggaagctggatttctaccggcaatgaggcgatcaaatcgtcacgttatgctttccgtcgccactttttccagcatgccggtttccgctatgtggtctcctcgcatcaggaaaccatggcgctgaatccctatgaaacagacagcatggtttcgcagtatctcgatttccagtacggtccgcgctatttcggtgtcgataactacgctgaagcactggtcaaactggccctgccgcacagtcagaatcgaggtgaagcactggacatcggttgtgcaaccggccgcgccagtttcgagcttgcccgccactttgaacatgtcaccgggatggattattcggcgcgctttatcgatgtggctctacagctcacgaccggcgaagatttccgttacgtggtgccagaagaaggcgagctggtggaatatcggcaggtacggcttaaggactttgatgtcagtaacgaacaggcgaagcgtattcagtttgtacagggcgatgcctgtaatatgaagcctcaacccgcgcgttacgatctggtgctggcatcgaacctgatcgatcgtctgcgtcagccggcgcgcttccttcaggatgtaacaccgatgctgcgtccgggtggtgtcttagtgctgtcatcgccttatacctggctggaagagtttacaccgaaggaaaactggctgggcggcgtgcgtgagaatggcgaagccctgaccactcagcaggcgttacaacgcctactggccgcggacttcgagcaaatcggttctccacaggatgtgccgtttgtcatccgtgaaacggcccgtaagttccagcacacgctcgctcaggtgacgctgtggcgtaagcgttaagataaccggcagcggctgatgccgctgccggtgagttgccagtttgattattttgctgcacattctcctcagttcattgaagaaaaacgataacgaggatgaccatgcccgaacatctgcaactggataatctcgaccggggtatcctgaatgcattactggaaaatgcgcgcaccgcttacgccgaactggcaaaacagttcaatgtcagcccgggaaccattcacgtccgtgtcgaaaagatgaagcaggcaggcattatcctgggcacgcgggttgagatcgatccccgccagctgggctttgatgtctgctgttttatcggcattattcttaaaagcgcccgtgattacccgtcggcactgagcaagctggaagccctggatgaagttgttgaagcctggtacaccaccgggcactacagtattttcatcaaggtaatgtgccgatctattgatgccctgcagcaggtattaatcaacaagatccaaactattgacgaaatccagtcaacggaaacccttatttctctgcaaaaccccatcatgcgaaccatcaagccctgatctttccaccagcttgtgcacaatcttatccttagacgatcggccgcctgacaacggctgcatcgacatcatctaaactaataaccctgttttccacaggtggatcaccgcttgatcacagcgtacaatgctttccttgatctcaggagagcacgatggccgacattacgttaatcagtggcagcaccttaggcagcgccgaatatgttgctgaacatctcgaagaaaaactgcaggaagcgggcttctcaacgcagatgctgcacggccctgagctgcatgacgtgccgcaacagggcatctggctggtggtgagttctacccacggtgccggagagttgccggataatctgcaacctttttatgaggccattgatgagagccgtcccgatctgtcagccgtacgttttggcgcagttggcatcggcaaccatgaatacgatctgttttgtggtgcaatacgcaatcttgatgccctgttaattgcctgtggtgcacagcgcatcggtgaaaggctcgaaattgatattctggaacatgagatccctgaagatccggctgaagagtgggtgatgacctggaaagatgcgatctaagctggtcggggatcgggaaatagctacgatccccagcagaagatactgtttttcacacgatcctgccatttattttgtggataactaccctgtttagttgcgtataaccggtagttatccaaagagcaaccggagttcactttgtgagctgtggataacaagccattttgatcccagcttatacggatcaggaacaccgatcattaacaggtatcgatcctctctatacgcttgtttacgctgtgcttttcgcagatatccacagggaaccgcgatcctaataagagatctaacagaaagatcatataaagaattaagatcttttcttttaatacctgacgatcccgctgctttcacctcagccataatttcagtagaatccacggcccagagagaacgatctctgactattcatcaacgaggtaccacttcatgttttatcaagatccttttgacgtcatcgtaattggtggtggtcatgcgggcacggaagctgccatggcagcagcccgaatgggtcagcaaaccctgttactgacccataacatcgatacgctgggacaaatgtcttgtaatcctgcaatcggtggaattggcaagggacatttggtaaaggaagtggatgccttaggcggtttgatggctggagcaatcgaccaggcaggtattcagtttaggatactaaacgcgagcaaaggccctgctgtacgggccactcgtgctcaggcagaccgcgtgctctatcgccaggccgtgcgtaaagcgctggagaatcagccaaacctgatgatcttccagcaggccgtggacgatctcatcgtcgaaaacgatcgtgtcgtcggtgcggtaacccaaatgggcctgaaattccgtgccaaaacggtcgtgttaaccgtgggaaccttcctcgacggtaaaattcatatcgggctggataactacagcggtggtcgtgcaggtgatccgccgtcgattcctctggcaaaacgcctgcgcgctttgccactgcgcgttgaccgcctgaaaaccggtacaccgccgcgcattgatgcacgcagcatcgattttagcgtactcgccccgcagcatggcgataacccgatgccggtgttctctttcatgggcaatgccggacagcacccccagcaggtgccgtgctggatgacctataccaatgaaaaaacacatgatgtgatccgtaataacctcgatcgtagcccaatgtacgccgggatcatcgaagggatcggtccacgctattgtccgtcgatcgaagacaaagtgatgcgctttgccgatcgtaattcacatcagatcttccttgagcctgaagggctgaccagcaatgagatctaccctaacggtatctctaccagcctgccattcgacgtacagatgcagatcgttcgttctatgcagggtctggaaaatgcgacgatcgtgcgtccgggctatgccattgagtatgacttctttgatccacgcgatttgaaactcacgctggaaagcaaatttatcgacggtctgttttttgccggtcagatcaacggcaccacaggctatgaagaagccgcagcacaaggtttgctggctggccttaatgcggcacgccagtctgctgacaaagaaggttgggcgccgcgccgcgatcaggcttatctgggggttctggtcgacgacctgtgcacgctgggtaccaaagagccttaccgcatgtttacctcgcgtgcggaatatcgcctgatgctgcgcgaagacaatgctgatttacgtttgacggaaaccggccgtgaacttggcctggtggatgatgcgcgctgggctcgttttaatcagaagctggaagccattgagcaggaacgccagcggttgcgtgatatctgggtgcaccccaagtcagaacatgtcgatgcggttaacgccattaccagctcgccactgacgaaagaagccagtgcggaggatctgctacgtcgtcctgaaatgacctacctgaagctgatggcgcttgatgcgttcggtccggctttagcggatgatcaggctgccgatcaggttgaaatccaggttaaatacgaaggctacattgcacgtcagcaggaagagatcgatcgtcagctgcgtaacgaaaatacgctgttgcccgcgacgcttgattatcgccaggtcagtggcctttcaaatgaagttatcgccaagctgaacgatcacaaaccggtttctatcggccaggcatcacgtatctcaggcatcacgcctgctgccatctcgattttacttatttacctgaaaaaacaaggtctgctgcgcaaaagcgcctgatctgaaccggggcgggttatcccgcccccgctgactggactgatgctgtgatcaacaaactcacttcgctgctgcaagcggctaaaatttccctctccgatcaacaaaaacagcaactggtcgcttatgtcgggctgctggataaatggaataaagcctataacctgacttcggtgcgcgatcctcagcagatgctggttcgccatatcctcgacagtatcgtggtggcacctcatcttgagggggcgcgctttattgatgtcggcaccggtcctggtttaccgggcattccactggccatcgtcatgccggatgcgcatttcaccctgctggacagcctgggtaagcgggtacgatttttacggcaggtccaacacgagctggggctgaccaatatcgaaccggtacagagcagggtagaagcgtttccgtctgagccgccctttgacggcgtgatcagccgtgcctttgcttcgctggaggatatggtgaactggtgtcaccatttgccgacgaagaacggccgtttttatgccctgaaaggggtccggcccgatgatgaaattaccagcctgcccgcaggctattcgctggacagggttatctcgctccaggttccacaactggacggtgagcgtcatctggttattattacaccgccaggaagcgttcaggcaccgtgaaagcctggcgtttcatcgtgcctgtgttaccaaagatgcgatagtttgaggggcgaacccggcgatgttgagtgtcacattgttaaatttcgccccggaaattatctgaaaaactttttcacatttaacttttatttcacaaagttttatcaaaataatcactactccgcttggtattaaacgcgtgcatcgcgattaatcctatttaagggcaataaaatttttgcatgagtaataggcattttacgattctgaaggtgacttcgatgtcaatagaccattttcatcgacaacaaaaattatcaaggacgtttttctttttaacgtgatgattatcaatgtttttatccttcataccttagttggataatggctccttaataaaagttactgtggtgtgaatgcttattatgtgatctaaagcacgctttaaaattgagccgctgcagaacttttcacagctttatccataaacggctgctccgtatctttggaaaaatagtcattcggaaagaaatttagataattgttcaccttttcgttacttaacgattgaaatcacagggacggcccgtataatttgcacggcttttgctacttgactcaaatgcacaaaggcagtcttatacgacacgcgacatacccctaaaggggcaggagagtatcagcgtcatgtcagtgtctctttacagtgtaaaatacgcccgaacggtgctgatgattcagctagtgaccattgtcatcgtcggtgcactctttgccttgaaagatgtcacctggggcagctctgctcttgctggcgggatggcagcctggctgccaaacgtgttgttcttgtttatagcctggcgcctgcaagggcaaactccggcttcggggcgcgtcgcgtggagcttcgctttgggtgaaatagccaaagtgttcgcgaccattattttgctcattgtggcgttgggcgtattcgatgcggtcttttggccggtcgggatcacctggttatcggtgctggtcgttcagatgttggcaccggcggtaattaacaacaaagggtaagaggcatcatggctgcaggagaaatctctactccgcaagagtacattggtcaccacctgactcatcttcagttggacctgcgtaccttcgagttagtgaatgctcacgacgctcccgcgacgttctgggtattaaatatcgattccatgtttttctctctggtgctgggagttatcttcctggtgttgttccgtagcgtggcgaaaagcgccaccagcggtgtgccagggaaaatgcaggcggctatcgaactggttgtcggtttcgttgatagcaacgtgcgcgacatgtatcacggtaagagcaaacttatcgccccgctggctctgacaatttttgtctgggtctttctgatgaacttcatggatctgctgccaatcgatttgctgccctatattggtgagcactggttggggttaccggcgctgcgcgtggtaccttctgcagacgtgaacatcacgttatcaatggcgttgggcgtctttattttgattctgttctacagcatcaaaatgaaaggcattggcggcttcacgaaagagctgacgctgcagccttttaatcacccgatctttatccccgttaaccttattctggaaggtgttagcctgctgtccaaaccggtttctctcggtctgcgactgttcggcaacatgtatgcgggtgaactgatctttatccttattgccggtctgttgccgtggtggtcacagtggattctgaatgtgccttgggccattttccacatcctgattatttcgctacaggctttcatcttcatggtcctcacgattgtctatctgtcgatggcatctgaagaacattgatttttttctcaacaatacgcgtttaactgaaacaaactggagactgtcatggaaaacctgaatatggatctgctgtacatggctgccgctgtgatgatgggcctggcggcaatcggtgctgcgatcggtatcggcatcctcggaggaaaattcctggaaggcgctgctcgtcagcctgacctgattcctctgctgcgtacgcagttctttgttgtaatgggtctggtggatgcaatcccaatgatcgctgttggtctgggcctctacgtgatgttcgctgtcgcctaaagcccccgtgttcactccgcacctggtgtgagagtgaacggattctgccgtttatcgttgatagcggcagaaaagttaaatacttaattagaggcattgtgctgtgaacattaatgcaacaatcctcggccaggccatcgcgttcatcctgtttgtcgcgttctgcatgaagtacgtatggccaccgattatggctgccatcgaaaagcgccagaaagaaattgctgaaggccttgcttctgctgaacgcgcgaagaaagatttggatctcgcgcaggctaatgcgaccgaccagctgaaaaaagcgaaagaggaagctcaggtcattatcgagcaggcgaacaagcgtcgcacgcagattctggacgaagccaagactgaagctgataacgaacgcactcgcattgttgcacaagcgcaggccgaaattgacgccgaacgcaaacgtgcacgtgaagaactgcgtaagcaagtcgcgttgctggctatggctggtgccgagaagatcatcgaacgttccgtggatgaagctgctaacagcgacatcgttgataaactggtcgctgaactgtaaggagggaggggctgatgtctgatctgattactgtagctcgcccctacgccaaagcagcttttgactttgctgttgagcatcaaagtattgaacgctggcaaaagatgctggcgtttgccgcagaagtggctgccaatgaacagatggccgacctgctttctggtgctttagcacctgaagcactggctgcctcgtttaatgcagtctgtggtgatcaactggatgaacccgcacagaacctgattaaggtgatggcggaaaacggacgtttgacagcgcttccggctgttctggcgcaattcattcaactgcgagacgcttatgaagcgactgccgaagtggatgttatttctgccagcacgctgagtgacgaccagctgactaaaatcagcgccgcgatggaaaaacgtctgtcacgcaaagttaagctgaattgcaaaattgataagtctgtgatggcaggcgtgatcatccgttcgggtgatctggttattgatggcagcgtacgcggccgtcttgaccgtctggctgacgtcttgcagtcttaaggggactggagcatatgcaactgaattccaccgaaatcagcgaactgatcaagcagcgcattgctcagttcaatgtcgtgagtgaagctcacaacgaaggtactattgtttctgtaagtgacggtatcatccgcgtacacggcctggccgatgttatgcagggtgagatgatttccctgccgggaaaccgttacgctatcgccctgaacctcgagcgtgactctgtaggtgcggtggtgatgggtccgtatgctgacctggccgaaggcatgaaggtcaagtgtactggccgtattcttgaagtaccggttggccgtggcctgctgggccgcgtggtgaacaccctgggtgcacctatcgacggtaaaggcgcaatcgacaacgacggcttctcgccagttgaagtcattgcacctggtgttatcgaccgtcagtctgtcgaccagcctgttcagaccggttacaaatctgtcgatgcgatgattccaatcggccgtggccagcgtgagctgatcatcggtgaccgtcagaccggtaaaaccgcaatggcaatcgacgccatcatcaaccagcgcgattcaggcatcaaatgtgtctacgttgcgattggtcagaaagcgtcaaccatttccaacgtggttcgtaaactggaagagcacggtgcgctggctaacaccatcgtcgtcgtagcgtctgcgtctgagtctgctgcactgcagtatctggctccgtatgcaggttgcgccatgggcgaatacttccgtgaccgcggtgaagatgcgctgatcgtatacgatgacctgtctaaacaggctgttgcttaccgtcagatttcgctgctgctgcgccgtccaccaggccgtgaagctttcccaggcgacgtgttctatctccactctcgtctgctggagcgtgcatcacgcgtgagcgctgactacgttgagcgcttcactaatggtgaagtgaaaggccagaccggttctctgaccgcgctgccaatcatcgaaactcaggcgggtgacgtttctgcgttcgttccgaccaacgtaatctcgattactgatggtcagatcttcctggaatctaacctgttcaactccggtatccgtccggctgttaacccgggtatctctgtatcccgtgttggtggtgctgcacagaccaagatcatcaagaaactgtccggtggtattcgtaccgcgctggcacagtatcgtgaactggcagcattctcccagttcgcttctgatctggacgatgcaacccgtaaacagctgagccacggtcagaaagtgaccgagctgctgaagcagaaacagtatgcgccgatgtctgtcgcgcagcagggtctggttcttttcgcagcggaacgcggctatctgaacgacgttgagctggcaaaaattggtagcttcgaagctgctctgctggcgttcgcagatcgcgatcacgccgagctgatggctgaaatcaaccagtctggtaacttcaataacgacatcgaagagaagctgaaaggcctcctcgagacgtttaaagcaacccagtcctggtaatgtctggcggcttgtctgaaaaggcaggccgcaaggctttgaggagaagctaatggccggcgcaaaagaaatacgtaccaagatcggaagcgtaaaaaatacgcagaagatcaccaaagcgatggaaatggtcgccgcctccaaaatgcgtaaaacgcaggaacgcatggcggccagccgtccgtatgcagataccatgcgcaaagtgattggtcaccttgcgttaggtaatctggaatacaagcacccttacctggatgagcgcgacgttaagcgcgtcggctacctggtcgtttcgactgaccgcgggctttgtggtggtttgaacattaacctgttcaaaaaattgctggcagagatgaaggcctggtccgacaaaggcgtccagagcgatctggcgattgtgggatcgaaaggcgtgtcattcttcggcgctgttggtggcaacgtcgtggcacaggtcactggcatgggcgataagcctgcgctctctgatcttatcggcccggtaaaagtgatgttgcaggcctatgatgaaggccgcatcgacaagctgtacattgtcagcaataagttcaacaacaccatgtctcagactccgaccattacccaactgctgccgttaccgccagcggaaggtgaagaagagatgaaggcgaagacctgggattacctgtacgagcccgatccgaaagcgctgctggatacgctgctgcgtcgctatgtcgaatcgcaggtttatcagggtgtggtggaaaacctggccagtgagcaggccgcacgtatggtggcaatgaaagctgcaaccgataacggcggaaatctgatcaaagagctgcagttggtttacaacaaagctcgtcaggccagcatcacccaggaacttaccgagatcgtctcgggagcctccgcggtttaaccaggtttggaattaggtagaggattcaagatggcagctggaaagattgtccagattatcggcgccgtagttgacgtcgaattccctcaggatgcagtaccgcaagtgtacagcgctcttgaggttatgaatggtgatgctcgtctggtgctggaagttcagcagcagctgggtggtggcgtggttcgtaccatcgccatgggtacttctgacggcctgaagcgcggtctgaacgtcaccgacctgaaaaaaccgatccaggtaccggttggtaaagcaaccctcggccgtatcatgaacgtgctgggcgagcctatcgacatgaaaggcgacctgaaagaagaagacggcagcgtcgtagaggtctcctctattcaccgccctgcgccttcttatgaagatcagtctaactcgcaggaactgctggaaaccggcatcaaggttatcgacctgatgtgtccgttcgctaagggcggtaaagtcggtctgttcggtggtgcgggtgtaggtaaaaccgtaaacatgatggagcttatccgtaacatcgcggctgagcactcaggttattcggtctttgctggcgtgggtgaacgtactcgtgagggtaacgacttctaccacgaaatgactgactccaacgttatcgataaagtcgcgctggtgtatggccagatgaacgagccgccgggtaaccgtctgcgcgtggcgctgaccggtctgaccatggcggagaaattccgtgatgaaggccgtgacgttctgctgttcatcgacaacatctaccgttataccctggccggtacggaagtatcagcactgctgggtcgtatgccatctgcggtaggttatcagccaacgctggcagaagagatgggtgtgttgcaggagcgtattacctccactaagacaggttcaatcacctccgtacaggccgtttacgtgccagcggatgacttgactgacccgtcaccagcaaccacctttgctcacttagactcaacagtcaccctgagccgtcagatcgcctctctgggtatctacccggcagttgatccgctggactccaccagccgtcagctggacccattagttgtgggtcaggagcactatgacgttgcacgtggcgtacagtcactgctgcagcgttatcaggaactgaaagacatcatcgccatcctgggtatggacgaactgtctgaagaagacaaactgctggtggcacgtgcgcgtaagatccagcgcttcctgtctcagccgttcttcgtagcagaagtgttcaccggttctccaggtaaatacgtgacgctgaaagacaccatccgtggctttaaaggcatcatggaaggtgaatttgaccacctgccagagcaggccttctacatggttggcgccatcgaagaagcggtcgaaaaagcgaagaaactgtaataacggtttcccaggaggaaaattatggctatgacttatcacctggatgttgtcagtgcagagagccaactgttctctggtctggtgcagaaaattcaggtgtcaggtagcgaaggtgaactgggaatttttcctggtcacgccccgctgctgactgccattaagcctggaatgatccgtatcgtgaaacagcacggcgaagaggagtttatttacctctctggcggcgtgctggaagtgcagcctggcagcaccactgttctggccgataccgcgatccgcggtaccgatctggatgaagcgcgtgcgctggaagcaaaacgtaaagcagaagagcatatgaacagcagccacggcgacgtggactacgctcaggcctctgcggagctggcgaaagccattgcgaaactgcgcgtgatcgagctgaccaaaaaagcgatgtaatccggctttatgcgtcacgaaatgccagccctttgggttggcatttttttttgcctgccgtaggggtaacaagattctggctaatttcgggacaagaaaaatgtagtaatctcagtgctaaatcgtttaactttcttcagtctacaatcagtcaggatggatatgtctaacagtgcgatgagcgtggtaattcttgccgctggcaagggcacccgtatgtattccgatctgccaaaagtgttgcatacgctggcaggtaaaccgatggttcagcacgtgattgatgccgcaaaagggctgggtgcacagcaggtgcacctggtatacggacacggcggcgatcaactgaaagcaacgttaactgacagcgcagtcaactgggtgctgcaggcagaacaactgggtacgggtcatgctatgcagcaggcggccccgcactttgctgatgacgaagacatcatgatgctctatggtgacgttccgctgatttctgaagccaccttacagcgtttgcgcgaggctaagcccgcgggcggtatcggattattgacggttgtactggatgacccgacaggttacggccgcatcgtgcgtgaaaatggcaccatcgtcggtattgttgagcaaaaagatgctaacccttctcaactgactatcaatgaaattaataccggtattctgatcgccaacggcggtgatcttaagcgctggctgtccaggctaaataacaataatgcccaaggcgagtattacattaccgacatcatcgcattagcgcacggtgaaggtcgggtaattaatgccgtccatccggcccgcaatagcgaaactgacggcgtcaacaatcgcctgcaactggctacgcttgagcgtacttatcaacacgagcaggctgaaaaactgctgttggctggcgttatgcttcgcgatcctgcacgtttcgacctgcgcggaacgctgcagcacggtcgggatattgaaattgataccaacgtcattattgaaggccaggtgacgctgggcaaccgggttaaaattggcgcgggctgtattatcaaaaacagcgttatcggggatgactgtgacatcagcccttattcggtgatcgaggatgcaaatctggccactgactgtaccgtaggaccattcgcgcgtctgcgcccgggtagtgaactggctcaggctgcgcacgtgggcaattttgttgagatgaagaaagcgcgtctcggcaaagggtccaaagcgggtcacctctcttaccttggcgatgctgaaattggtgccaatgtgaacattggcgccgggacaatcacctgtaattacgatggtgccaacaaatttaaaacgatcattggcgataacgtctttgtgggatcggacacgcaactcgttgcgccggtcaccgtggcggcaggcgcaacgattgcggcaggtaccacggtgatgaaagatatttccggcgctgatctggtctataaccgtaaagagcagaatcacaaagccgactggcagcgtccgcagaagaaaaaataatttttacggcccgtattaacgggccgctgtagtaccaaaactataatccccactctctacaaggctcggggaaccggcaaagccggactatcaggtcatatgacaacgcaatggcttaacgccatgaagtcaggaaataactatgtgtggaattgttggtgcagtagcacaacgtgatatcgcagaaattttattagaaggtttacgccgcctggaataccgcggttatgactcagccggtctggccgtcgtcgatcagcaggggcacataacgcgcctgcgtcgcctgggtaaggtgcagatgctggctgctgccgcagaagaacagcccctggtgggtggaaccggtattgcccacacgcgctgggcaacgcatggcgagccctcagaagccaacgcgcacccgcacgtttctgagcacatcgttatcgtacataacggcatcatcgaaaaccatgagcctcttcgcgaagcgctgatggctcagggttatcactttgcctcagaaaccgatactgaagtcgtggcgcatctggtccatctggaacagaaacaaggtggctctttgcgtgaagtcgtgcagcgcgtgatccctcaactgcgcggtgcttatggcatggtgatcatggacagccgcgatccgtcgctgctggtagcggcccgttccggtagtccgctggtcattgggcgcggtgtgggcgaaaactttatcgcgtctgaccaactggcactgctaccggtcacccgtcgcttcatctatctggaagagggtgatatcgctgaagtgagtcgccgtgatgtcaccattattgatggtgccggtaaccaggtccgtcgcgaagagatcgaatccagcgtgcagtacgatgccggtgacaaaggcctgtatcgtcactacatgcagaaagagatttacgagcagcctaacgcgattaaaaacaccttaaccggtcgttttaatcacggcgaagtggatctcagcgagctcggcccgcatgcagaaacgctgctcagcaaagttgagcatatccagatcattgcctgcggtacgtcttataactcaggcatggtttcgcgctactggtttgaagcactggctaatctcccttgtgatgtcgaaatcgcgtctgaattccgctatcgcaaatcggcggtgcgtaaaaacagcctgctgattacgctgtctcagtcgggtgaaactgcggatacgctggctgcgttgcgcctgtcaaaagagctgggttatctgggatcgctggctatctgtaacgtcgccggttcgtccctggtacgagaatctgacctggcgctgatgaccaaagcgggcacggaaattggtgtcgcgtcgaccaaagcctttaccacccagctcaccgtgctgctgatgctggtggcaaaactgggtcgcctgaacggtatgccagcggaaaaagagcatgagattgttcatggtctgcaggcactgccaagccgcattgaacaaatgctggcgcaggataagctgattgaagatctggcagaagatttctctgataaacatcatgcgctgttcctgggccgtggcgatcaatatccgattgcgatggaaggcgcgctgaagttaaaagagatctcttatattcatgccgaggcttatgctgctggtgagctcaaacacgggccgctggcgctgattgatgccgatatgccggttatcgtcgtggcaccgaataacgagctgttagagaagctgaaatcgaatatcgaagaagtgcgcgcgcgcggcggtctgctgtacgtgtttgctgatgaagatgctggttttagcgacagcgatggaatgaagatcattcccctgccgcacgtggaagaagcgattgcgcctatcttctataccgtgccgctgcagctgctctcctatcacgtggccctgattaaagggaccgatgtggatcagccgcgtaatctggcgaaatcggtgacggtcgagtaatgcgtcttacgcgtgaatccctggcgggattcacgcgtttcttttatttaattttgctgctgacttgctcaagtgcgcgctgctgatcgctgattttgcggttagcctcatcgagtgaacgttgcaggttagtgatcacatcttcatttttgcttagcttttgtgagagcgtattgagggtatcagtctggttttcttgcgtttttattaacgcttgtacttgtttcttcgtttcactcacatcctcagcattgacagaagattgtctgaccgcgccactactgtcaattgtggccagagtgcctctgttatctgtcattgcaaaagattcattcgaatgaatctgcggtacgtcgtacgcatgggcgctggccagcgtacagaggaggacgacattgcataccagaagcttcttcataaatgtcattgaacatgtccttttcaatagtgggcttgtaaaaatgagcaataattgtgtctgtcatataactgtaatattaactacatttttctgtcactaaactgtcctattttccctcctgcagcaatcactgactcttactaaaaaggcattgagcctgaattttctcccctggagggaacatgacactgatgcgtagcaccgtagcccgaatccttgccgcctcttttgccgttagcgcggtttctgcctttgcagccaccgatctgacgggtgcgggcgggactttcccggcgccggtttatgccaagtgggcagcagaatatcagcaagccaccggtagcaaaatcaactatcaaggcattggttcatctggcggtgtaaaacaaattatcgccaaaaccgttgatttcggtgcgtctgatgcgcctatgaaagacgaagatttgcagaaaaatggcctgtttcagttcccaaccgtgatcggtggtgtggtgctggcggttaacctgccgggcatcaaatcaggtcaactgacgctggacggtaaaaccgttggcgacatctatctgggtaacatcaaaaagtggaacgatcctgcgattgttaaactgaacccaggcgtgaaactgccagacactaacatcaacgtggtacgccgcgcggatggttccggtacctctttcgtgttcaccagctatctggcaaaagtgaacgaagagtggaacagcaaaattggtaagggcaatactgttaactggccaaccggtctgggcggtaaaggtaacgacggcgtcgccgccttcgtacagcgtctgccaggctcaatcggctacgttgaatatgcttatgccaaacaaaataatctgacctacaccaggctggtggatgcggatggtaaagcggttgcgccaagcgaaaccagcttctctaacgcggcgaaaggcgcggactggagcaaatcttttgctcaggacctgactttccagaaaggcaacgacgcatggccaatcacctcaaccacgtttatcctgatttacaaagaccaggctaacgcggcgaaaggtgccgaagtgctgaaattcttcgactgggcttacaaagacggcggcaaaacggcaaacgcgctggattatgccaccctgcctgacagcgtagttcagcagatccgcgctgcatggaaagccaatatcaaagacagttcaggtaaagcgctttataagtaagtgaatgaccctggccagaccgacgtctggtcagccttcaggggcggcgtctgccgccctgataacttctgaggactgagacttctatggctgcaacgaagtcggcattcaaagccccaggcaagcaaggcgacagaattttcggtgcactggtaaaactcgctgcgctgatcgtcctgttactgatgggcggcatcattgtctccctgatcttctcttcctggccaagcatacagaaatttggtttcgcgtttttgtggaccaaaacctgggacgcccctaacgaacaatttggtgcgctggtaccgatttacggtacgcttgtcacctcaattattgccctgattattgcggtaccggtcagtttcggtattgcgcttttccttactgaactcgcaccaggctggttacgtcgtccactgggtaccgccattgagctgttagcggcgatccccagcattgtttacggcatgtggggcttatttgtttttgcgccactgttcgcacagtacttccagacgccggttggcgatgtgatgtcgggcattcctgtcattggcgagctgttttctggccccgcatttggtatcggtatcctggccgcaggcgttatcctggccatcatgatcatcccgtatatcgcctcggtaatgcgtgacgtgtttgaacagacgccggtgatgatgaaagagtcggcttatggcattggctgcacgacctgggaagtgatttggcgcattgttctgcccttcactaaaaatggggtgatcggcggtgtcatgctcggtctgggacgtgcactgggtgaaaccatggccgtgacctttattatcggtaacacctaccagttagacagcgcctcgctgtttatgcctggcaacagtatcacctcagcgctggcgaacgaattcgctgaagcagaatcaggcgtacacgttgcggctctgatggagctgggcctgattctgtttgttatcacctttatcgtgctggcgatttcaaagttaatgattatgcggctggccaaaagtgaaggaacgcgatcatgacaacgatggaagtgcaggctcgcgcagaactggaagcgtcacgtcgtaagatgcagtcatggcgcagtaccaagaataaaattgcgctgacgatgtcgttactgaccatggcttttggcctgttctggttagtgtggattctgtttactacggtaagccgtggcatcgatggtttgtcatggtcgctgtttacagagtccactccgccgccaaacaccgcgggtggtggcttagccaacgccctggcaggaagtggtttactgattttctggtctaccttcttcggtacgccgctgggcattatggccggcgtttatctggcggaatacggacgcaaatcagcactggcagaagtgattcgttttattaatgacattctgctgtcagcgccgtcgattgtggttggcctgtttgtctacaccatcgtcgtggcgcaaatgcaccacttctccggctgggcgggcgtgattgcgctggcgctgctgcaggttccgatagtgattcgaaccacggaaaacatgttgcgactggtaccagacagcatgcgcgaagccgcctatgcgttgggcacgccgaaatggaagatgatctcggctattacgcttaaagcgtcggtttccggcatcatcactggtgtgctgttagcgattgcccgtatcgctggtgaaaccgcgccgctgctgtttactgcgctgtcgaatcagttctggagcaccgacatgatgcagcccgtggctaacctcccggtcaccatatttaaattcgccatgagcccgtttgccgagtggcaaagtctggcctgggctggcgtactgattattaccctgtgcgtgctgctgctgaatatcgtagcaagagttgttttcgccaagggcaaacacggttaactaccgacactgccctgcgcggtgttgattaagagagaaaaacaatgagtactgcgactgcatcagccggaaaaatcgaggttcgtaatctgaatttctattacggcaagtttcacgctctgaaaaatatcaacctggatattgctaaaaaccaggtcacggcgtttattgggccatcaggctgtggtaagtccaccctgctgcgcactttcaacaaaatgtattcgctctatccggatcagcgagcagagggtgatattctgctggatggcgacaatattctggcgtcgcatcaggatatcgcactgttacgcgcccgggttggcatggtattccagaagccgacgcctttcccgatgtcgatttatgacaatatcgctttcggcgtgcgcctgttcgagaagctgtctcgtgccgacatggatgagcgcgtgcagtgggcgctgaccaaagcggccctgtggaacgaaaccaaagacaagctgcaccagagtggctacagcctgtctggtggacagcagcagcgtctgtgcattgcccgcggcatcgctatccgtccggaagtgctgttgctggatgagccatgctctgcactggaccccatttctaccggccgtatcgaagaattaattaccgaactgaagcaggattacacggtggtgatcgtgacccataacatgcagcaggctgcacgttgttccgatcacacggcgtttatgtatctgggcgaactgattgagttcagcgacactgacacgctgttcaccaagccggcacagaaacaaacagaagactacatcacaggtcgctacggctgattcgacaggagatcgccatggacagtttaaatctgaataaacacatctccggtcagttcaatgctgagctggagcacatacgcactcaggtgatgatcatgggcgggctggtcgaacagcaactgaccgatgcgatcaccgcgatgcataatctggacggtgatctggcccagcgcgtcattgatggcgaccagaaggtcaacatgatggaagtggagattgatgaggcctgcgtgcgcatcatcgccaaacgtcagcctaccgctatcgacctgcgcctggtgatggcaattatcaagaccatttccgagctggaacgcattggcgatgtggccgagaaaatcagccgtaccgcactggagaagtttggtcagcaacatctgccgctgctggttagcctggaatccctgggccgccacaccgtacagatgctgcatgacgtgctggacgcgtttgcgcgtatggatcttaacgaagccgttcagatctaccgcgaagacaaaaaagtggataaagagtacgaaggtatcgtgcgtcagttgatgacttacatgatggaagatccgcgcaccatccccagtgtattaacggcactgttctgcgcccgcgccattgagcgtatcggtgaccgctgccagaacatctgcgaaatcattttctacttcgtaaaaggacaggatttccgtcacgtcggcggtgacaggcttgatgagctgttatccggcgacgacggcagcaataagccgtcttgatcctgggcaaccgtgtgcgattccggcacacggttgcggctattctgcatagaccccatcatcgtagctctttatacttgcgccagttttttaaccaacgggtgctgactcatgtcctcttcttccccttctaaacagagcattacgcctgctaaagcgatgctggccgccatcagtggttatgccatggatggattcgacctgcttattctggggtttatgctgcccgcgattagcctgtctctggcacttgatccctcccaggccggttcactggtgacctggacgctgattggtgccgtaattggcggcatcgtgtttggtcatctcagcgatcgctatggtcgcattcgtgtgttaaccctcaccattttgatgttttccctttttaccggtctgtgtgcggtggcccaggggtactgggatctgctggcctatcgcacgctggcgggaatggggcttggcggtgagtttggcatcggcatggcgctgattgcggaagcctggccggcagagaaacgcaaccgcgcctcggcgtgggtcgggatcggctggcaactgggtgttctgctggcggcatttatcacgccaccgctgctgagtgttattggctggcgcgggatgttcctggtgggactgctgcccgcgctggtgtcgtttgtcattcgccgcagtatgggtgagcctgagagctttacccgtcagatccaacatgttccctcactgtcctttcccgcccgactgaaactgctgtttaaagaccgcgccaccagtaaagccagcctggggatctttattctctgctccgtccagaacttcggttattacggcctgatgatctggatgccaagttacctttcctcaaactttggttttagtctgacgaaatccggcatctggacggcggtcactgtcgtaggtatgaccttcgggatttggttgtttggcgtgctggcagatcgctttgcgcgctggaaaattttcctgctatatcagttcggcgcagttgtgatggtggtggtttatgcgcaactgcgcgatcccactgttatgctgttcaccggcgccttgatggggctgtttgttaacggcatgatcggcggttacggggcattaatctcggatacctttccaccgcaggtgcgcgccaccgcgcaaaatgtgttgtttaacctgggacgtggcgtcggtgggtttggcccgctggttatcggcctgctggcaggcaagttctcttttgtggcggccattaccttactggcgcttatctacctgctggatattgtggcaacgctgttcctgctgccgaagaagcagagccaggacgatgcactgggggcaattggttaagtaacctgactgacgtaaaccggcctcacaaagaagctggtttacgtggtgatccggggcgatacctgatgcacctctcaccatttcaactttcaggctactttttcgcatgaatcgcgcgatttgcatcgttggtcgcgcagggtcagattctgctgcaacaacctttatgaaccctcaggaaatgatgagggcaagatagcccgacagtgccactgtggcagattgttgcgagcatgacgggagacatcgctcaaataaaagggcaacgtcgttgccctcgggttggattactgctgcatcaacggcagcagctgctgatacagccggctgaacgtctcacgtctcggctgatagtgcgcatgacgcgccgggttgggctggtggcgctgcacctgcttcagggcaggcacggtcagattctcatccagcgccatttgcgccagacgtgcagcgcccagtgcgggtccgacatcgccgccttcgcagtaatccagcgtctgtccgctgatatcggccagcatctgtcgccagtaaccgcttcgggcaccgccgccaatcagcatgatgctgctgggcgtgacgccgcagtcgtgtaccacatccatcccttcggccagtgcaaaccccacgccttccagcaccgcccgcgccagttcgggtcgtccatgctggtgggtaaagccaaagaagctgccgcaggcgtgcggattattatgcggggtgcgttctcccgacagataaggcaaaaaccacagcgacggcgcatcctgttttgcccgctctgcctccgccagcagatgcggaacatcgtcacagccggtcagcgcagccgcccagtcaaggcaggacgcggcactgagcatcacggacatcagatgccagcgctgcggcagagcgtggcaaaagctgtgaacagcacgttgcggattactgagatagccgtcgctgacgacaaaataaaccccggatgtccccagcgacagcatgccttgtcccggcgatgtcatgccgacgccaactgcacctgccgcattatcgccaccgcccgccaccaggggcacctgcggcagtgtccagcgctgtgcaatagccgccgacaaggtaccggtaatctgattaccttcaaacagcgcaggcatctggcgtcgttccagcccgcaggccgccagcatcacatcgctccagtcacgcttttctacgtccagccacattgtgcccgccgcatccgacatatcgctggcaaattcgccgctcagccgccagcgtaggtaatctttgggcaacagcacttttgcgacctgagcaaagacgtcaggttcatgctcttttacccacagcagctttggcgcagtgaaacccggcatcatcaggttgccggtaatctgacgcgattcaggcacgcgctgctccagcgtatggcactgatcgccgctgcgcccgtcattccagagaatggccgggcgcaacacctgatgttgtgcaccaagcagcgtagcaccgtgcatttgcccggtcaggccaatcgcttttacgctactcaggtcatgctgatgggtcagggcctgtacggcgcggtccgtggccagccaccagctttcgggatcttgttcgctccacaacggatgcgggcgggaaaccgtcaagggggaggtttccactgccacaacctgcccgtgttcatccagcagcaccaccttgacgccggatgtgccgatatcgatcccgattaccatgtcgcgctccttacggattaaaagtcataaagatagtgattcaccaggttttccagctgttcctggcgtccactgttgtgctgcggattaaactgctgctgatgtgcatgagccgccagcgcatccagcgagaattcacctttcaaaatctgctgaccaaattcgccgttccagccgctgtagcgctgtgctacgcgtttatccagctcaccgtcagccagcatgcgtgccgccactttcagcgccagcgccatggtgtccatcgcgccgatatggccatagaacaggtcatatttatcggtgctctgacggcgtactttggcatcaaagtttaggccgccggtagtgaaaccgcctgctttgatgatttcgtacatcaccaatgcgttttcttccacgctgaccgggaactggtccgtatcccagccgcactgcggatcgccacggttagcatccaccgaaccaaacacgccaagggcaattgccgtcgcaatttcatgatggaatgagtggccggccagcgtcgcatggttcgcttcgacgttcactttaatctctttttccagaccaaactgcttcaggaagccataaaccgtggccacatcataatcatactggtgtttggtgggttcctgcggcttaggttcgatcagcagcgtgccctgaaatccgattttgtgcttgtgctcaaccaccatctgcataaagcggccgatctgctcgcgctcctggcgcaggtcagtatttaacagggtttcgtatccttcgcgaccgccccacagcacatagttttcgccgcccagcgtctgggtcgctttcatggcactgcatacctggctggctgcccaggaaaacacctccggatcgggactggtcgcagcacctgcaccgtagcgcggatgcgtaaagcagttcgccgtgccccacagcagtttaattccggtttcctgctgtttttcctgcagtttatcggtcatgacggccaggttttcgcgatagcttttcagcgactccccttctggtgacacgtctacatcgtggaagcagtaatagggcacattcagtttgtgaaaaaactcaaacgccacgtccgctttcagttttgccagatccagcgcttcgcccgttttttgccacggacgatcaaacgcgcccgcgccaaacatatccgcaccgttccagcagaacgtatgccagtaacaggcggcgaagcgcagatgctcggccatggttttacccatgatcacttcatccggattgtaatggcggaacgccaggggattggtggtttttgttccttcgtagcgaacgcgatcaagctggtcaaaataagcgtgcatgattggctccttagcatcggccccgaatgggttacccggaagcgttattgtgcgtacccgctctcagcgcgctcaattacgatatttcacacagccagtaagataattatttattgtgcacttgctcgcaaaaaaatatgaaggctttatgacgcctgacaggtcttatgtcgcgatcggcgagtctgaaaatgtaaaattttcgatcgcgctcaaaaatacagaaataaaccaaaaaacgtaatagcgggataaaaatcagtaattgctggcagctgaaaataaggtgaacaattcatccgcctggttcatagccttacaacgacaataaccgttccctacaggatgaccatgatgaaaatgaaacctgcattactcgctgcctttgcggcgctggccctgttcagtcaggccagtctggcaaaagaagtcaaaatcggtatggcaatcgatgatttacgcctggagcgctggcaaaaagaccgtgacatctttgttaaacaggctgaggcgcaaggcgcaaaagtatttgtgcagtcagccaatggcaacgaagaaacccagatgtcgcaaattgaaaatatgatcaaccgcggcgttgatgtgctggttatcattccctacaacggtcaggtattaagtaacgtggtggcagaagccaaacgtgaagggattaaagtgctggcctatgaccgtatgataaataacgccgatatcgacttttatatttcctttgataatgaaaaagtgggtgaaatgcaggcggaaagtctggtgaaaaaggtgccaaaaggaaattacttcctgatgggcggatcacctgtagacaataacgcacgcctgttccgcgaagggcagatgaaggtgttaaaaccctatatcgataacggcagcattaaaatcgtcggcgaccagtgggttgatgcctggctaccggaaaacgcgctgaagatcatggaaaacgccctgactgccaataaaaacaatatcgatgcggttgtcgcctctaacgatgccaccgcgggcggcgcgattcaggcgctgagtgctcagggactggccggtaaagtcgctatttccgggcaggacgcggatctggccgccatcaagcgcattatgaacggcgcccagaccatgaccgtgtacaaacccatcaaagaactggctaccgaagccgcgaagattgccatcgagctgggcaatggtcagacgccagccagcaatgccaaactcaacaacggcctgaaagatgtgccagcgcgcctgctgacaccgattgaggtgaacaaagacaacattgacagcaccgtggtgaaagacggtttccacaagaaaagcgaactctaatcgcgttacgcgaaggagagtaaacgatgttgctggaaatgaagaacatcaccaagcgctttggcgcggtgaaggcgctggataacgtcagcctgcagctggatgcgggtgaagtgctatcgttgtgcggtgaaaacggatcgggcaaatcaacgttgatgaaaatcctgtgcggactctatccgcacggggatttcgacgggcagatccactttgccggggacgctattcaggcgcagaccattcgcgataccgagcgcaaaggtattgtgattatccaccaggagctggcgctggtgcggcaacttacggtgatggagaacatctttctcggcgcagagttggggcgcttcggcatggtggatgatgaaaccatgacgctgcgctgccagcagctgctggagcgcgtcaaactcaacgtctccccggatacgcgcgtgggcgaactgggccttgggcaacaacagctggtggagattgcccgtgcccttaacaagcaggtgcgcctgcttatcctggatgagcccacctcttcgctgaccgagcaggagacgacagtgctgctcagcatcatccagaacctgcgcgaacatggcattgcctgcgtgtatatctcgcacaagctcaacgaagtgaaggctatctcggacacgatctgtgtcattcgcgatggtcagcacattgccacccgacctgctgcgggcctgagtgaggatgacatcatcaccatgatggtgggacgcgaactcacggcgctttatccccattcgccccacgagattggcgacacggtgttgcaggtcgataacctgacggcctggcatccggttaaccgtcacgtgaagcgggttaataacgtctcttttaccctgcgaaagggggaaatcctcggcattgccggattagtgggcgcgggtcgaacggaaaccgtgcagtgcctgtttggcgtctggcccggccgctggcaaggggagatagcgattcacggcaaaaaagtcacgattcgcgactgccagcacgccatcgcgcacggcattgccatggtgccggaagatcgtaaaaaagacggcatcgtgccgctgatgggcgtaggcaaaaacatcacgctggccgcgctggaccagttcagtcatcggctttccaccattgatgaggccgaagaactgcacgccatcaacgccgccattgcacgactgcgggtgaaaacctcttcgcctgagctgccgattggtcgcctcagcggcggcaatcagcaaaaagcgattctggcgaagtgcctgctactcaacccaaaaatcctgattctggacgagccgacgcgcggcattgatgttggggcgcgtcaggagatctatgtgctgatcaacgccctggtacagcagggcatctcggtgattgtgatttcgtctgagctgcctgaagtgctgggcctgagcgatcgcattctggttatgcatgaagggcaaatcaaagccgatctgattaacgacaatctgactcaggagcaggtgatggaagccgccctacggagtgaacattatgcttaacagcgagagtaaacctgccgtagcggcaccggctaacaagcacgtatccagcaagctcggcctgcgtaacctgcaggtgttggtgatgctgggggcgattgtcttgattgccctgttctttacctggacgaccgacggtgcctggctcagtccgcgcaacgtttctaacctgctgcgccagacggcgatcaccggcattctggcggtgggcatggtgtttgtaattatctccgccgagatcgatctgtccgtcggctccatgatggggctgttgggcggcgcggcggcaatctttgacgtctggctgggctggtcgctgccgctgactatcgtggtcacgctggtgctggggctgttgctcggcacctggaacggctggtgggtggcttaccgcaaggtgccatcatttattgtgaccctggccggcatgctggcgtttcgcggcattctggtgggcatcaccaatggcaccaccgtggccccaacgagcccggcgatgtcgcagattgggcaaagttatctgcccggcggtatcggttttggctttggtgttgcgggcctggcgctgtttattctgtggcagtggcgcctacgactgcgtcgtcagcaactgggtctggctcaacctgccgcctccggcaccgtagcacgacaggccattaccgccgttctggtactgggcgcgatctggctgctgaacgactatcgtggcgtaccgacaccggttctgttgctggcattgctgctgctggtggggatgtttatggccactcgcactgcctttggacgccgtatctatgccattggcggcaatattgatgccgcgcggctctctggtattaacgtggcgcgcaccaagctggcggtgtttgccatcaatggcctgatggtggcgattgccgggctgattctcagctcgcggctcggcgcgggttccccttccgccgggaacattgccgagctggatgccattgcggcctgcgtgattggcggcaccagcctggcgggtggcgtggggtcggtagcgggcgccgtgatgggcgcgtttatcatggcctcactggacaacggtatgagcatgatggatgtaccgactttctggcagtacatcgtcaaaggggccattttactgttagcggtgtggatggataccgccacgcgtcgccgcctgtaatcgtgtgaacgatcacactgtggcgcaaaccatttctgtggcgcatccagctgtgttatgcaatgcgctgggagttaaagggactgtgccactatgcatgaaaaacgataccgcattaccctgctgttcaacgccaacaaggtttacgatcgtcaggtagtagaaggcgttggcgagtatttgcaagcttcgcagaccaactgggatattttcattgaggaggacttccgttgccgcattgataatattcaggaatggctgggtgacggggttgttgcggattatgacgatagttcgattcagcgctctctggccgacgtggctgtgccgattgtcggcgtgggcggttcgtatcacagggaagaagactatccaccagtgcactatattgccaccgataacactgcgctggtggaaagcgcctttctgcatctgaaagagcgcggcatcaaccgtttcgccttttacggtttaccggcctccagcggtaaacgctgggcgcaggagcgtgaactggcgttccgcaaaatggtgatgcgcgagcgttacatgggcgtggtctatcagggcatggagactgcctctgagaactggcagcacgcacaaaaccgtctggccgactggctgcaaacgcttcctccccataccggcattatcgccgttaccgacgcccgtgcgcgccatctgctgcaggcctgcgaatacctgaagattccggtgccggagaagctgtgcgtcatcgggatcgataacgaagagctgacgcgttacctgtcccgcgtggcgctgtcctcagtcgttcagggatcgcggcagatgggttaccaggccgctaaactgctgcatcgtctgctcgatcaacaatctctgccgttacagcgcatcttagtgccgccggtaaaagtcattgcccgccgttccaccgatttccgctcgttgcacgatcccgctgtcattcaggcgatgcactttatccgcttcaacgcctgcaagggcatcaaggttgagcaggtgctggatgccattggcatgtcgcgctcaaacctggagaagcgtttccgggatgaaactggcgatacgattcacgccatgatccaccgcgagaaactggagaaggccagggaactgttggcgggttcgtcgctgagtatcaatgagatctcacagatgtgcggctatccgtcgttgcagtatttctattcggtgtttaagaagagctatgccacgacgccaaaggagtaccgccaggagcatggagaggtggtggtttagtagatatatttttagtttggttacattactgtgattttgttaatgattttatcaaattaggaactataagatgtttatgcccattatcattcttcaatctggcgtgctcataacttgtagtatgctaacactaagtgcaaaaaatgataataaaaattatattttctaattattgctttaagaattattaatttaatcgccgggagatcaaaaaaatattttttcttgaagttaggaatagaaaaggcataatgctacttttgaaggaattgattttttttgctgattctattagattaaactagacgtaaaaaagacctttgcagttttaactgaaagataaaaaagtatcatgataatttatgtttaattgattttttaacacttttcttaaaaaaggattgctatgaaaagcattgatttcccgagaaataaaaaaacttacctgtctttaagatttttattaattaagcttaatagggatattatggacatcacttctattgtcgaacgaggaccttatgttttcgatgagtttgattatctcgttatggccctagaggataggcgttatcttaagcatagaggtatagatataatctcaataattcgcgaaattttgaaaatgattacgttccgaaaatatggaggtgcaagcactattaatatgcaaatggttagaacattaactaactataaagatttaacttttcgacgaaaaatatatgaaatgatactggctttacttgttaattttagatttactaagagtgaaattatgaagtgctatatggataatgcctactttggtcaccgtgcaaccggggtaaccaaagcatgcattattgaatatggtagaatgttgagcgaacttagctataatgaaaaagccagacttgcagcgatgttgctaaatccaagacctgagtcgccttcacataaatggtattcgattatcgaagttagagcgaggtatgcgcaatctatgaggggaagagtgaaaaagtgcccttaataatgtcagtgtacttgcatactctaaatgatggtagttaaacgaaattgtatctgcatttttaatttcatcccatcttgaatcagaggtttcagtcaattgagttgttacattttttattttttcataagctctgttaattgcatttagtgcggtttttagggatgctcccgaacttccagttcgctgttctttatgtttatggatttcttttttaatttctaaatgagcattataaaactctttctgaatgctatcctcaataacattggccagacttgataattgttggctattaagatcgaaataaagcctattcaacttcgtattccaatttacaactgatgaaatataggattcgatttcagagtcgttcgtttttccttccctgaaggaatttatcaatgttttacttctgtatattctttcgctagctaatgcttcaaaactatttctaacttcttttaactcaatagctttcatttctgcttttttgaaaaagtattgattttgaaactgtttcttctgaaagcggtaagtgatgaaaacgcctacacaaccggagagtaaaaaagtcacaacaatttttattaaatcaaacatttttattccgtctctgagtgatttcagttttttagcattaattgattctgagttaacattctatgatagatgctgatgggtttcatatacaactcctttcttgtagggtttttattttttataatttaaccttggatttaaattttttggagacctattttgaataactgtttatatcaaaatcgcatgaattgcaactagttttgaaaatattatgaatgtctcatgggtttttacaatgatttgagagtagtgtcttgttttttcttagagccgtatttttatctacgatggtttttttgaaaattattattagagagagatgatttatgactatttttaaaaaatgaattcatcctggtccggtattacgagcacctaaccagagtaactacacgaactatctaaggagttgattatagctgacacgcgttttcacatagacctccccacgactgaatccaatcaaaagttaactttaggttatcgctcaagtaggctggaaagatccacgccgcaaatcactgattgcaagaagttaattacgtaaggtaggatttaataagcactattacgccgcagttaaggttaggctaacttactctgattatgataaacgactgatagctgctcgctagcatgcatttattacttctggacctaaacgtagcactaataatagtggtgcagggtgcgcataaattagcatgcgcatcttaattttttggcttgaattattttctgaagcaaatctgaaatcagcattcacatttaattatccactgccatttataaatttagtatggtaataaatactgtaatcaatattctgaatttaattgtctcctacctaataaaattaacctgtcccctaatgctcaaggtccgcaaagccctgccggacaattaccctgcctggcgaatcctcgggaaggtgatctgcatttttatgaacaggagctggaggacgccgtcaccttatccacctgacggagaatacagtcgcccgaatcagcgctgatgtgttggttcgccgaacttgaggggaaggtggctggcttcgtggtctgcgtgatacataaaggtacatggttcacacagcctgtgtgctatctggaagatctcttcgttgaagagagtgtgagtggtctgggggcgggaaaagtgctcatcacggcggtctgcgatgaagcccgcgaaaaaggctgagcaaaggtgtactgggtgacaaatgaaaataaccccgcgcgtaaactctacgacaagctagcccaggttgatgatgtggtccgctacaacatcaggttctgaagatcggtctctctgttacatgcccgcggtgccgtcctgatcgttatgaatactgctcttatcaaaataataagggcagagatgactcacctctttccccatcattattggcacatgccaatactaaaaataatctgtgattaatatctcaatattattctaataagcgtaattgcgaccattcttaatgtttcctgctttgtcatcaccgcagaacgttttttccaacggctggtatcccgaaaatcgaaaaagcccattgaaataaaatggagccgatcacaatatgaatgggtttactaaaaaataacaatcagtaaattccgaggccgattatgcaacgcactctgtcacctactgtcttccagcttcacaagtcttttttccgtactcaacccctggagatcgtcaatgctgcgggatgcagcgcggaactttttatctatgaatcaggcattgaggccgtgcggctgaaaaacgcccgtggctatctggtggtgctcccttactatggtcagatgatctggcaggccatgtttgatggcgtcgacctgacaatgcaaagccgttttaccgagccgcgtcctgccagcgacattgttggaacctatggctgctttatgtatcactccgggctgctgcgcaacggtaacccaacagcggaagacaaccatgccctgcacggtgaaatgcccatcgcaccgatgcagcgggcgcgcattgaaactggcgaggatgcgcaagggccctggctggcgctggtgagcgagcgcgagtacctgatgggatttggcgaccattatctggcccagcctcgggtggttatccgtccggacagcgccacctttgaggtatgcatggcagtagagaacttatcgctcaacgccatggacctgatgtacatgtgccatgccaactttgcctatgttgaaggtgcacgcatcattcagcccgctgcttttaccgcggccgacacggttatccgttcgtcagtgcccgccatcgtgaaagcgaatgatgcctatctggcaaggcttaagcagcttaagcaagatcccgccagcacagaagtcatcactgccgagttgcagcccgatcccgaactggttttctacattaaaaatctgcgtaaagcgcaggatggccatgtgcacgtcatgctacgtcggccagacggcgatgcttttacggtgaactacaaccccgacaatttcccctttctgactcgctggattctggcaaaccctatgcagaaggtgtgcgcttttgcgatgccggcgacctgcggcgttgaaggctatcaggccgaaaaacgggccgggcatatacggtcactggctggcggggaaaaggcctttttcagcatgacgctcggctatcttaatgcgcaggaaagccagcacgaagaggcgctgatccgtgcgtcggtgtgatcggcacaccggaattgttaatggaatgtgtgagctttatcaaagaagagatctttattggcatcaggtaatttactttacttttctttgcagtaaattcggtgctgcacccggacaatttatgcggtttgttttgggaaacgggaaaaaaagactaaccggctgaacggtttattttctcatttttattaatacgaatacccagtgttcagaaatgattatttatctgctgttttattgctggcagcggcatctttatatcaatttctggcaagagaaaatctcatcatattaatgataaccaggggtagtaaaatgaatcgccgcaatctaattaaaatgttaagcatctctacgctgttatcggtctctgtgagtttagcgtttcccatgtccgcgctggcctccgaaaccaaaaccatggtgacggtggtcaaagaagccggtgtgccctggttcaacatccttaatcagggactcaaagagggcggagaaaaaaataatcttaaaacctctatggtgggacccacgcgtgccgatcctgcgcagcaggtgaaactgattgaagatctgatcgccaagaaagtcgatgtgattggtctggtaccgctcgataccaaagtgacggcgcaggtggtgaagcgcgcgcgtgacgcgggcatcatggtgatcacgcaggaaggccctaaccaggaaggcaaaacctgggatgtggagctgatgagcgcgaaagcctacggtgaagcacagatgaaagccctggcgcgtgaaatgggtgaaaaaggcgaatacgtcgtgctggtcggcacgttaaccaccaccggtcataatcagtgggccgatgccgcgatcgcgtatcaaaaagagcactacccgaatatgaaactggccgccgaccgctttcctggcgcggactttatcgatgaatccgaacgcgttactcaggatatcctgaaagcgcatccgaacgtgacaggcattatgtcgatgggctcgaacgggccgatcggggcgggcaacgtgctgaagaaacgccatctggagaaaaaaatcgccctggtgggcaccactattccctcacaggcgcgcgcatacattatgtctggcgtgattcgtgaaggtttcctgtggagtccaaaagaagccggactggcgatgaccgatgtcgcacgcctggcgctggataacgaggaatttaaaaccggcatgaccatccctgggctgggtgaagccaccgtggataacgaaaacaaagtgatcatggtggatcgcatcctccaaatcaccaaagccaacgtcaacgatctcgtcaagctcggcctgtaagtcacaccatcaatgttgctgctggccgggttcaacagaatccggtcagcctccccgtattctgattagataagggatagtgctatgcctgcatttttacaactcgatggcatatcgaaaatattcggcggcgtccacgcgctttcggatgtcagcctcacgctggaagaaggcgaggtacattgtctgtgcggacagaatggatgcggtaagtcgacgttgatcaaggtgatgtctggcgtgcaccagcccgagccgggcggccgtattattattagcggtaatgaagtctcgccgctgacgcccgtggaaagtactcgcctgggcgtgcaggtgatctatcaggacctgtcgctgttccccaatttaaccgtggcggagaacattgccgtcggccagcataccggccgctttaaacgggttaactggaaaaagatttatgagatagcggccgacgcggttgcgcgcattggcgtttcgctcgacctgaatgacaaagtggcggatatctccattgctcagcgtcagctggtggcaatttgccgggcgatggcggcgaatgcccggctggtgattatggatgaacctacatcctccctgacgcgccatgaagtggacgccttactgaagctcaccctgcagcttaaacaacgcggtatcacgattgtttttgtcagccatcgtctggatgaagtgctggaaattgctgaccgcgttaccgtgatgcgcgatggcgtgaagctgggcacctacgatgcccgcgagatgtcagaccgtaaactggccacgctgatgacgggtaaagagttccattatgaatccgttgccaaagacagaccacaaaccgaaacggtgctcgaagtcagcaacctgtcccgtaaaggcgagtaccggaatatttcatttgatattcggcggggcgaaattctcggcctcactggcctgttgggatcggggcgaaccgaattagcgctgagcctgtttggcctgaagcgtccgcatcagggcgaaataaaacttcacggccaggccgtgcagatgcgatctaaccgcgacgccattgagtacggcattgcctatttgtcagaagaccgtctgggactgggcttagttctggagcagtcaatcagcgccaacatcacgctctccgtggtggagaagctggtgaataaagccggactgattcgtgacgatctctatgagcaaacggtcaacgaggcaattgcctcactgtctattaaagccggtaatcccgacaacaaagtcaaaaccctgtcaggcggtaaccagcagcgagtggtgctggcaaaatggctggcgacccaacccaaactcctgattctcgacagccccacagtaggcgttgatatccatgccaaagacggtatttacgccattgtgcgcaaactcgccgccagcggtattgccatcatcatgatttccgatgagattcccgaaatttattaccacagcgatcgggtgttagtgatgcgcggcggcaggcttaatggggaatatttccctggccgctgtagcgaagaagaattaaaggaggcagtaaatgcgtgatttcctccagcgctttattcatacccacgaatgccgcctgctggcggtgatgaccctgatgattgtgttcctgaccgtattcaccacggagttcgcaacgttacaaaatctcttagacgtttcaggtgcaacggcctttattggcattatggccgcaggcctgttggtggtgattattactggcggcatcgatctctctttcgccgctaccgcctctatcacccagtacgttgccctgaccttagcgaacaatatgggcctgggctgggtgggcatttttgccgttgccatcggcctgggcatcgtgctgggttttatcaatggcgtgctggtaaacgtacttcggacctccgcgctgattatcaccattgcgaccctgaacgttttcttcggcatcctgctgacggtaaccagcggccaggacatcttcatgctgcctgactggtttaacgccggctttgaactggtgttctataccgatgcacaaggtgccacctatgcgctgaacttccagattatcgccctggtcctggcgtttgttttgacgtggctactgctcaacagaagcaataccggccgacaaatttatgccaccggtggcaatccggatgccgcgcaacgcgtcggcttcaacgtattcaaactgaatatgctggtttatggctacatgggggcgctggctggtctggcgtcgctggttcaggcacagcttgcccagtcggtatccccgacggcgctggttggcagggaactggatgtggtggctgcggtggttatcggtggggcgagcctcactggcggtaaggggacggtgttgggcaccgtactgggcgtggtactgattgccgtgatgcagaatggcctgatcctgctgggtgtttcatcttactggtcgttattcagtaccggcctggtgatcatcgccgccatgatcatgatggccagagaaacccgcaaacagaacaagctcgtcaatgaaggggcgatatcatgaagcagactggcaatgtgttagcgcaggtggaaaaacggttgggaacgaccaacgtccggctgttgtttatcctgatagtcatggtgatcggtcttgggctacttgagggcgacaagctgtttgcggcggcgggattgcgatcgatgggcttccagttgccggagctggggtttcttgcgctcgccatgatgattcctatgctttccggcggtatcgatctttccatcatctccaccgccaacctgtgcgccttaacggtcgcctacacgttgaccaccttcatgcctgaaatgcagggcgcatccggggatctgctacaaattggcgcactgttgctgggcctggtgttgtcggccctggtggggttactgaatggcgtgctggtggcttatctgcgcgtgccgccaatgctggcaacgctgggtacgatgacggcggtgaaaggcattgcaatcggattcagccatggggatgttatttccggttttccggcaccgattgtgtttatcggtaacggcaccctgttcggcattcctttcgcccttatcatctttgccctggcgattattccgttaagtattttcgtcaacaaaaccccgctgggtaagtcgatagccatgatcggctccaatgagcgagcggcccattattccggcattaacacgcgtaaaagcctggtgtgggtgtatctgatttctggcttatttgccggtatcgcgggcatcatcatgatggcacgcttcgactcggccaacgcggcgtacggtgaaagctacctgttggtcgctatcctggctgcggtactgggcggtgtcgatccgttggggggatttggccgggtcagcggcgtgattctgtcactgctgattctgcagttggtctctaccgcctcgattttgctggatctcagtcagttcatcacgctggcgctgtggggcgcaattttgattgtggcatcgggcggcgtcgtgctcaaagaatggcactctgagcggcggaaactgcgtaaaaaagtgcccgcgatgacacgaaaggcgtaaattctgtaaaccctgttactgcatcaccacgtcgcacctgaggcggcgtggctatcgggcctcatgacatgatagatttaaaaaataatcattcaataaggtatgtcatgagtaatcgagctgatgatgtcagtgctataggtccccggttacgactaatgatcgcctcattaacctctctggaagcccggttggttcatgccgtgttatcaagcgattttgatgagaatgtctcaatcaaagccattgccagccgttgtgagatgtctgaggcgatggtggtgaaaacagcaaagaagttgggtttctccggtttcaaagagttacgcataaaagccgccctgtataaccgcctgcccatcaccgaaatgcatcaggagctttctcccagcgatacgacacgtgagatcgtcagtaaggtgtttcgcacctccgtccaggcgattgaggaaacgctggccattctggatatggcggcttttgaaaaagccgcggatctgctggccagggcacgtcagcgtgatttttacggcttcggcggttcggcgcaaatcgcgcgggatgcggtgcataagtttctgcgtatcggtacccgttcggccgcttatgacgatccccatatgatgctgatgtcggctgcgttactgaacgagcaggatgtggttgtcgctatttcccattccggccggacgaaggacatcatcgaagcggtaaaagccgcgcagcttcagggcgtaccggtgattgccatcaccaattccattggctcgccgctggctaaccttgccgacaccgtgatctgctccaccgctcagggttcgccgctgaccggtgaaaacgcggctgcgcgcattgcacagttaaatattctggatgccctttttgttgtggtcgcacagcgcgactatgcacaggccgaacgccagctgggccgcaccatgctggccgtcgcccataaacgaaaatagccagagcaaccactttcactatcctcaacgattccaaaggaacatcgaatggcaaaacgggagcatcactaccaggtcaacgtgcgctggagcggtaatcgaggggatggcacgcagtcctataccgcttatgatcgaaacggcgagctgtcggttgaaggtaaagccacggttgcgctcagtgccgatcccgcttttcgtggtgatgccacgcgctggaatccagaggagcttttactggcgtcagcgtcggcctgccataagctgtggtatctgcatctttgcgccgatgcggacatcattgtggaagcctatgaagacacggcagaaggcaccatggttgaaggcgaaaggggccatttcactcagatcaccctgaaacccgtggtgacattgcgtaataaggacgacgcagcccgagccgaagcgctgcatcatcatgcccatgaagcctgctttattgcgaactcgctgaattttccggtgcgttttgagccgatgtttatttaacggtgagatttcgcctgtcggcagttagtgataacgcgggatctaaccagcataagaacaggcgaaacagcgtttcgcctgtgaatgtcagtacataatcaaaatcggtactgcaatcctgctgtcacggtatagttatggttggcaatacctgccgcatcgccgtcaatcgttcctgactggccgctgacgttatcaaaaatctgtgtaccacctttgccttcttcgtatttactgtaggtaaattcagcaaaaactttagcattaggggtaacgtaataacctgcgtcaactgaagcaccgtagtaacgcgaacttgatgttttttcacggaacgtcaactggcgaacatagtgttcgtcgttatcatgggcattaacccagtcgctgaatttaagaagagtaccgaattcaaagttatttattctgtagcgcccggtcagtcctacgtacggcattgaaaagcgctgactgtaacctatgcctgtttgatcacgtggaaaatcacctaccagagtgccattattgtaatcaaatgagccgccaatagcagtccagctgaagcgggtctcctgatagccagccaccgcacctatccgatagctgtctccctgtataaaccagcctttcagattaagatcgtactcattagcatgattcatacgcgtatagggatgtgaagaatggtcggtccagttaccctgattactgttttgccagtcataatcgtccagatgaccagaaccgctggcaagagaagtccatccacgtgcattgagtgtcaggaatgagtaggcatcccacgaaatgtcgcctttcaaaatggccacatttttgatcttccagtccagctgactaattttacgacccgtgtcagggtcgtaaacaagttccccggatttcccacctagcatacctgttgaggcagatatactaagactatccgcggagatattaggtgaaagtgatatctctttagcctgaacgccagctgaaaaccctgccatcatcattacaaaaaagcattttttcatttttaccaccctgttttttattagaaaaaatcctaaaagcagtttcagaataaaatagagatgtctgcttaaacaagtaaaaaattgtagttgatggcagggtttaataactttcaaacaacgcaaatcaaaaaaatattcaaccctacacctgagtctggcaccgaaaatgaagagttaaataggctgttttaccatgttgccctttattctacaaatgaatatcactctgtttaatcatggagttttctcccttacatcgtaagtttgacgctcaacatgctaattaaacgtagttaagaacgtcaggattaacgcttaaattaacttttacgacgaccagccgcaggcgtcagccattgatgaggcgtctatacccagttgcgtaagaaatgcacccattagcactaattcgccgataaacgcagcgccatcggttgctaacaatgccaccgcttgggcagtaatcacggttgccatgagcacccagttataccaggccatgttatcctcaattgctcccaggatttggcggatacctgttaatttataaatggcagaaataaggttgaagattgccgttgcagtattcaatgccccctctgcattactgattgcctggaataaactggagagtccgtccagttgagttcgggtaaggccgttaacaacttctgtagcggcttcaccacaaactttacctgtgatgccaagaaactgaaaaaaaacggtaaaacaatcaatcgccacgattatttctttacttgtgcattcactaatcgcaaccgatcttccggctgttgatacagaacgcgaacctggcgaatccgaccatggaatatcatactgaccgtgaaccaagtcaaacatgtcacgaattgctttatctttatccagcgtttcaccagcgggaggcggattttctgcaacgattttgtcgagaaaaggcgatgttacgttttgaaatgttaaaaagtctaattcttttaaactgttatcagaaagaggctggctcatgagtgactattccttttgatatttactaagaaagtggctgtttccgggtatgctaacgggtaatcctgttcgtaattttatttaaagttagcccttttctttaaaagttaagatggttgtttgcctattaatttttcaatatcaataggtgttttttattttttatgcgtttttgagcattagttaagtttatatagtttaatgtttttaaagagtgtgggaaaataaaaaaatatagtttattattctttttaaaattttttatttattttattcagttggttgcaccttttttatacgacggtggtggttaaggtgggtagagtttttcgctcataattttcatattttatataagtttattttttcagaatctcaatttcacgaaattactatgagcgcgctgatatcactatcctaaaatcctgtgtggtgcttaaatctggaagaaatttccctcttttcgtattcattcgtcagagttattaaagtattttagccccaggccgatactttatgcgcaactggcgaaatccgtcgccagtattatgtgacccccatctggggctcagtcaacataaggagcaactgcatggatatacagcaactcaccactctgtctgcaggtttagaacaatggcaggctcgcggtgaagccaatgcgaatctgttgaaaaaaacgctgaatcaacaggcagataccatcactacgcttgttgagggtgtgacagcacttccctctaatccggctgtagggcgtaacatcaacaccaccgcctgataatgccgttacggatccccgggcggctttcgctgtgccgcccgttttaatgcatggcgcggtttattcccttgtctgaatctggctgagtcaacggccttgactcaacgctttcatcacagcaatttcttccaatatccgtgaacctcacctggattaaataggttatcgctcatctgttgcctgggaatgctatgtcttcgcgcctgttatcgattggttattcaatgcctaaaacacgtttaatcgcgacgtaccctttagatgttcttcgcacgacattgaggggttttttgaccgctatatgcttcttcactatcacggcccacgcagagcgccttaaatctgaggagccattgttatgatgtctttttcaacgggtttcctgttgagcctgtcactgtgccttgatatcgggattgccaacattgccatgattacgctggcgatgcagcgtggctattttcaggggttctggttgggagtcggcacctgtgtgggcgatttgatctatgccgttctggcgctggctggcatggcggtgttgctgcagttcgaggtcgtacggtggatcatctggataggtggtggtgctttgctggtggggtttaccatcaaaatgctgctgtccgcctttcgtaacgtcaacgatatcgataccacgctgagtgcggccagacggtcaatgtggcgtgagttccggcacggtatcgtgctggcaatatcgtcgccgactgccattttgtggtttgccacggtgggtggtgcattgatttcccgattcgggcagcaaagcattacgggatcggcactgtttctgagcggtttttttctggcggggatcgtatggacagcggccctgtgcctggtcggtagcctcggcggcaggttgttagggcaaaagctattgagatattcctatatggcttccgcgctcatctttgcctactttgccttatatgtgatcgtgtcaggatataaagaatttattctttcctgaacccacctgtgaagcatagtgatggggtgttatccccatcacttttcgaaacgcattgataaaatggctctgatcgtaaaatcccagctgataagccgtatcaagaggatggctgttttgccggagtaaatcccgtgccgcacacaggcgaagctgcatgtgatactgcagaggaggaagcccggtgtactgcgtaaaacgtctgaccagataatattttccgatacccgcaacctgtgccagtgtttccagcgaaagttttacgctcagatgctgccgcataaatacttttacccgatccatcttcttatctgaaaaggtccccaagggggcatttgtggatagcagctcagcgcacagcagcagcaatgcctgctcttcctcggcgcagtcatgatgttgggtcaggctggcatagcggcatatggcgttaaataatgcctgatcggtgaaaacgccttcaggcaacacgggtgccgcatggctgctgctaaggttctggctaatgctgagcgttttcaacacgcactgcggaatatgaatgctcaggaactccgccccatggtgatcgaagcgcgaggactgaacgcttgcagggttatacagggtgatctggcctgcgttaacccactgtgtctgaccattgagcgcaatttcctcaatgcccgccaggttagcgctgataacgtattcatcatgcgtatgtctaggaaacacggcgtcattggcgttcacgcgagagcactccatgccattgcggctaaaccagtccagagcgtgcagcgccataagaagccctcttacgttaagcatcagagcgatgtggctctgacaagaccattcaggcaggctatattaaccttatttcgggacggatatgtgtgtacccgccagcgcaagagagatgttgaacctgaccggtagtgaggcattttttcgatgtgttctttcgatgaaaatcggggggaggtgaagatggatgattttttaaacctgatagcgaactgttgcctgcttttctcatttggaaagaagaaagaggtgaatacgtccatcaccgcgctaaaatacaagccgttagtgaatatgggcgtctgtgagccgaagacgcataagaagggcccgtccgctaagtgatggctacgcgtaaaatgaaaccgcgcgtgaagatgcagggcactgagacgtccctcatgggtgtcggtctttcagacagagataaaccggcctggcgtccgccccatcctgttctctggctcccgaccacgttgttgtgctgaatgacaacggcccgctggctcctcagcacgagcaggcgatagccacaggtttttagtcctgtcacggcctgtccgtttgcaaagacgtttcctcacgccacccactgtgtcttgatagatatcccgttcagccacggccaacatgatcttctgccaggccacgcgccaccgatcacaggcgagagctatcagtgcaatagatagcatgatcacaataactgcacttattgttaactttgtattaataacattggttatcataaccccatcgaaagcgaattgctttcacacttacaacattaaggaacaggattatgaaaaccattaaaacactgtcgattgctgccgttgctgcactgtcattcatgtcggcctcagcttttgcacaaaccgttaccgcaacgggttcaacgctggacggtacagaagccaaaattgccgctcaggccgagcagcagggcgcacagtacaaaatcatcgaagccaatacgaacgatcgcgttcacatgacagctgagctgtataaataagcgttacggatgcgccggcgcgaaaaagggctgcttaatgagcagccctttttgtgtctgcacagacagcagcgcaccaaccttgtcagattgaatcgccgccgtgcgccgtttgcgctctgcaagcagcgtcatgattaaaaggtcaggcttccccgcacataaaccgcgtcagatcagcataatgtcgatgccgtaaccgcttcattcagccataacgtaaattttacagaagagggttagcccggtcacaatcttatggttgtttattcgccattgtctcaagcccgttctttatcctgccgataaaccctccagaccactcaacatggcagtataaaaaatgacaatttttaaaaaaatattttctatttttcctaaacaccagcataaacacgccgccgattcgctcagagctttggacgatgcggttccaatcatcgaatttaccccggatggcaccatccttcgggccaatgcactgtttctaagcaagatgggttacgaagcgcaagagatcgtcggccatcaccacagtatgttttgcccgccatcaatggtgaactcatctgagtaccgccagttctggcagcgccttgccagcggcaagagcttcagcggcaaatatttgcgtctgggcaaagacagccatccggtctggctggaagccagctatgtcccggtgaaagacaaacatggccgcgtcatcaaggtcatcaagctggcggcagatatctccgagcgcatcagtgaggcacagcagcaggatgccctggtgcaggcgatcagccgctcaatggcggtcatcgcatttaacaaagccggggaagtgttagaggttaacgaaaacttcctcaaagcaacgggctataaagccgacgagattctgggcaggcatcaccgtatgttctgttccgaggaactgcgcagcagcaaggaataccagcagttttggcagcgtctcaatcagggcgaatttttctctgggcagtatccgcgacttaatcgtcatggcgaaactatctggctgcgcgcgacgtataacccggttttcgatgccgatggccggttatataagattgtaaaattcgccagcgatgttaccgagcaggtgctgcaaaaccagcaagaaaatgaagcggctcagcacgcgtggaagatggcgcagcaaacccgcgaaagctcggtaacgggtgcggatgtgattgaagacagcgtcagaaccatggccgagatcgccaaagagatgaacagcgtttccgctgacgtctttgggttaaacggccagtcagatcgcattgccgatatggtgcacaccattcgcaacatcgctgagcagacgcgatttatcgcattaaacgcggcaattgaggcagcccgtgccggcacgtccggccgcagttttgccatcgtggccgccgaggtgcgtactctggctgcccgcatcaatgaagccactgaagagataggtcgcgtggtatccagcaataatcagctggcaaaaaaggtgctggaagatatcgaaaataacctgaaaaacaccgctcgcggcgtcaacctgatgcgccaggccggagaggttatcgccagcattcagagcaattcggagcgggcagaagaggcggtcagaaacgtttcacgctcgacgtcgcctatttagcgcttaaccctgcagcagcaggtcacccgtctgcgcgggtgacctgctgcctgtccggctgttttctgtcaggcgctccgccaacatttcactttgtttgccgccattcgataaggcactattagccctctctgtccctgccacatcattgttgaaaggaacgccagcccacatgcccgtcaatttcgatctcaacgatctgtatgcgtttcgcgccctggttgaatatggcaatttccgtatcgccgcggaatccatctgcctgtcccagtcggcgctgagccgcaggattgagaagctggaaacggcgttggggataaagctgtttgacaggaccacccgccgggtcacgctgacgctttacggccagacgttcgccgcgcgttcagagcaactactgaccaactttgaagaagtgatggcggatatcagtaaagtcagccaggacagaaccggactggtgacggttgccacggtgccttccgccgcctattactttatgccggatgtgattcgccgctttcaggtgcgctatcctcgggtgcgggtcaagattattgacagtagcgcaggcaacgttattgaagctgtcaccagtggtcaggcagattttggcatttgtttctcgggcaacccgccacccaatactgagtttttaccgctggtggaggatgtttacgtcgtggcttgccgacacgatcatccccttgctaaccgcaaaagcctgacgtggcaggagttttaccagcaggattatgtcggactggataagacctctggcaatcgaaatctactggattccgcactgggccatgttgttccggcgcgcccgagcatctgcgaaacccggcatgtaacaacgatgctgggcatggtcgaagcgggaatcggcattgctgccgttcccgcgatgtcgatgccgtcatcaggccattcggtgctggttcacctgccgcttaccgatccggtcgtgaaacgcaccgttggcctgatcaggcgcagtggacgcatacagtcttatatcgctgcagagctggaaaagctgattactgaacagtatcactctgcttaacgggttgctgcgcgttgaccgagtgcaaacccgtggcatggacgacttcctgagccggggcagacgccaggaaatccagtaacgctttgccttcctcaggatggtctgctttggcaggaaccgcgccggcaaaccgggtgatgtactgcacgtcctcaggcagttcacctacaaaggtcacgcccggcacgggcaggagttcactgacctgctggaagcccagcgcatagtggccttttgccacttcagacgctaccgggatgcgttccacctcgtgcgctttgtctttcaccttgtcttcaatgcctaactttttaaacaactggctgctaatgtactgaccgctggcgctgtctgagtaggcaatcgacttcgcatttaacagggttttacgcagatcggcatccgttttgatattgggtttagcatcccctttcttcacgacaatcccgatcggcgagtcagccagctcaacgcgggagtccggttttatccacttacctttttccagctgactaagcgcatcgccgaccataatcaccacatcggctttttccccgcgcgccagacggttgggaatcgcctgcggtgttttacccatcgacggcccggacaccagaataatgttgtcgccacttttagcttcaaactgcggtgtgagtttttccagtgcggctttaaagccgccagaaatcatcacggtcacctcttttgccagcacactggtgctgacggaggaaaggaccagcgtggcaaggagtgaacggtaaattattttcattatggaatccctgacttagtgtttaacggcggtttgaagatttacagtgctgcgacggtacagatacagcgttgccagtaaggcgcagacggcagcaaagctcatccagtaacccggggaggctttatcgcctgtgtactcaatcaatgcggttgaaatcaccggtgtaaagccgccaaagacggcggttgccaggctgtaggccagtgaaaagcccgccacccgaacttccgctggcatgatttcagtcagtgccggaatcatcgcgccgttatacagaccatagataaatgacagccacagcagaacgctgagcatcatggaaaagctgggtgcagcagccagcatcgacagggctgggtaggcggtcgccagcgcgatcagcgtcatggtaaccagtacaggtttacgtccgaaacggtcagacagcgccccgccaaccggtaaccaaaggaagttagagatggcaaccagcagcgtgactaacaggctatcggaggcgctgagcatcagcactttcttgccgaaggtcggcgcataaacggtgatcagataaaacgctgtggtggtcatggccaccatcagcatgcctgcaatcacaacctgccagttggccagcagagttttaaacacgtcgcgcatcgccagatgatgacggcgggcgttgaactcctgggtttcttccagcttgcggcgcaggaagaaaatgaaaggcacaatcatgcagccaaacagaaacggaatccgccagccccattcacgaatcgcgctctcttccagcacggcgttcagggcaaagcccatcgcggcggcgaccataatggccacctgctggctacctgactgccagctggtataaaagcctttgcggcccggtgtggcgatctcagccagatacacagaaacgccacccaactccgctccagcggagaaaccctgcagcaggcggccgattaacaccagcatcggtgcccaaagcccaatgctttgataagacggaatcaggacgatcagaaaagtacctgccgccataatcgacagggtgacgatcaggcctttacgtctgccgaccttatcaatgtaagcgcccagcaccactgcgccgacaggacgcatcagaaagcccgcgccgaagacggcgaaggtcatcatcagcgaggcaaattcactgctcgccggaaagaaagtgtgggcgatataggtggcatagaacccaaacagaaaaaagtcgaactgttccagaaagttgcccgaggtaacgcgtaatattgcgccggctctggcgcgggtggtcatcggtgaagtcgaggaatgcatcggtatctccagtttatcgttgacgctttttgccgcgtctgttgctgaagactggatcaggtaaataaagtaaataagcgcaataaactcatcgactaatgcgcactgtgcatcaatggcagttaacaattacctgaggctatgcgcaacaagcctttaacaagatggcgagataagcgcttacagatcagggccgggaaacttaatgcgcgttttgtgacagggttcatacgggtatttgaatcagaaagcacagcgtaaagcgtttgtaaggctatatcagtcgatgcgggcgctcagggcgtaatggccgcaaaaaagggagagcagtaagacgtgccagcgccgctaaccaggcgatcagcgcggctgaaaaagcgccgtttccacggtgcctcgcgctatcaacgttctgcccagccctgaccacacaggcgagaaaatccccgtatgtcgacatatctggcttcgctgtcctgaatagcctgaaccgatgacgttgttgctgatagccatcagggtacatttcttatctgaggtcatgatgtgaaacagcagggataccgttgagacagcagggcgtgacagcaagcgtgatcctgacgacataaaagccgatcgggcatacggcagaaacgcccgaacggagcggttttatcaacgttgcggataaacttctgtgcctgtcattcgtgagaacggggtcataaggcttgtcgcctgtcctcagaaccaggcttcccacattgcacccagattgaagtcgtcctggatgtcgttttcacgaccattcacgcgcgcggtgcgcgcatcgtcgactttgccgccggtgacatagaagcgcagcatggggcggaactccggtcccatatcaatggcgatgttttgcgacagggtcaatttccagccattgttactgccgccttcatcatagtttacgcgctgataaccggcttccagccaggttgaatggacgtcattccagaaatacatcgggcgaacaatcgcggcgtagtttttccgattatcgcttttcagtcgacggttgtcgtaatcgtgataacccagcaaatactccacctgtgcctgctgggtaaactgatgcttaccttcaaagctggtgtagacagtgcgaaggccctcggttttgctgaaaacgctgttatccgagttgtcagagtagcgggtaatcactttattcacgccgtggtcgttggtgtggctcagcacaaacgcgccctgccaggctttcaggcgatcgtcactgtccaccgctttggagtcgaaaccgtaattagcgtagatctccagatccagtgcgcccagcttcatgccgtgaattttagacgtcgcggcgtagttgcctttatccccggtacccgaaccgcccgtacaggtgatgcgcgacggattggactcgtcgctgagcacttcagggctacaggattccacggcagcaacagcagcgacgtcaaattttatcccgcccacgtcgaagtttttcacccccgcgccctgaccatcatggttcatccagaaataatcattgatgttctgctgtggacgctgatgaaagtcccgtccggcccagagataggcgtcaggatttgatgccagcacattggtgacgccggcataggcttttttcaggttaacttcatcgccccagtgatcgatcatcacattgacgtcccagagggcaccactttggctcttaaatgctttggagagctggaactcgccaccgttgccttcgttgcccaggcggccaataccggaggccccgttgtaagagccgtccacgccaacatatttctgatcgccgctttggtaatgcgcaccgtagcgtgcgtagccgctgaacgtcaccccaaacggaatagcccggtccggtgactgaaccggactttgtggttcggtcacctcatccgttgtcttcgccactgctgcatccctctttgcctgacgttctgccagggctttatcgacggctttggcgacgatggcgtcgatttgttcctgcgtaaattcctgtgctgcgctcacagcagggcacagcgcggcgaccaccgccagaggtaatggaaggtttcgaataatattcatggttgtctcgtttgcacagcgtccttcaggttgattatgttcaatccgaataacggcgtgtgttaatgaacagacaataaccatcctgcaccggtcaattgatcaccagaacaagttgatttttatattatggttttttccagaggacgcttatttttccgtttttctcctgtgatatatatttttattgccgttgatagagatgaataatttcttctgagagttcacgcgccagtaacgacgtcattaaatgatcctgagcatgaaccataattaacgtcataggctgtcgcccttcgccagcgtcctgctcaattaatcgggtttgcatttgatgagccagacgagaatagtcatcggcttcccttagtcgatctttggcctcgtcgacgttaccctttcttgccgcctgcagggcttcgaaacacaggctgcgggcatgtcctgcattgacgatgatcgtcattacggcctcttcaagttcaatcataatcgctgctctcaattaaaaccgttatttgcggcaacctcagcaaaccatttgccgctctttttaatcgtacgtttttgcgttgccaaatctaactgcacaaaaccgtaacggtttttatagccgttcagccatgaccagttatcgataaatgtccacatatgataacccaggcagttacagccttcgctaatgcctttatggagccatttaagatgttcggaaacaaattcgatacgataatcatccagtatttcaccgttctggataaaacgctgttcattctctacgcccatgccattttcagaaataaaacagcgtggattcccataattaacgcgtaggttggtcagaatatcgtaaataccgggcgcgtaaatttcccatccgcggtatggattcatttttcgtcctggcatttcgtaatgatcgaataaccattccggcataaaaggtgcctcaggattgacggcactatcccgacacttaacacggcgcggctgataatagttaacgcccagcaggtcgatgatgccatcggccatgacttcgcggtccccgggctggcagcgcggaagctgatggtactgactcagtaaactcatcagatccattgggtattcgcccttaagaaccggatctaaaaagctgcggttaaacagcaggtctgcatgatgcgcggcttgtacatctgccggattcgccgagcgcggataggacggcgtgagattcagcaccacgccaatctcgccgtcataaccgccgttacgccaggcccgcaccgccagcgcgtgagccagcacagtgtgccaggccacggtcgcggcgcgtctgaaatccaccacgttcgggtagtgaaaatcatacagatagccaccttcgaccggcacaatcggctcgttaaaggtaaaccagtgcttcaccctgtcaccgaacaggtcgaaacagcgctgggcgtagcggctaaacgcttccaccacttcacggttctcccagccgcctttttcctgcatggccaacggcatatcgaaatgaaacagggtgataaagggcgtaatgccttgcgccagtaacgcatcgatcaccttgttataaaaatccacggcttcgggattcactgtgtcggtgccgtcaggcatcaggcgcgcccagctcagcgacgtacgaaagctgttgtgtcctaactgcttcagtaacgcgatatcgtgctgccagtgctggtaaaagccagaggtgttctgcgggccaatgccctgatggaaacggtggggttgccgtgcaaaccagcgatcccaggtggtcgggcttttaccgccattcaggctgtcaccttcggtttgcaacgccgaactggcgctgccccaccagaaattttcaggaaaacggtagttcatgtcactggctccttaagcgtgtggatgaccgtgcacgggatggcctgctggcgcggcatccttgatttttttctcttcagccttaatcagactgcgttcataggctcgcaggaagggtaggtacatcagcgccgacatcagcatacaaacaaggcacattaccagcgggctgagcgcccagttggctgcccaggatgcaccaatcggggcgggtgtggtccagggcgtgagcgaaaccacctgagcgatccagccgagttttgtcgcggtgtacgccagcacggcgttaatcatcggaacgcacacgaaggggataaacagcagtggattcataatgaccggggcaccaaacaggatcggttcattgatattaaaaaagctgggtaccacgcccattttaccgatggtgcgcagatgcagcacccggctacgcagcaggaggaaggccaggggtaaggtggaacccacgccgccaatcagcaggtagtgatcccaaaagccctgcaggtaaacatgcggcagggcggcaccggctgccagagctgcctggttagcagacaggttagccatccaaaaggggttcataatgccggtgacgatcagggcaccgtgaataccggcaaaccagaaaatctgacagagcagtacggaaagtaaaatggcgggcaaggagtccgaagcagagaccagcggctccagtaaatgcatgatggcctgcggcataatcatgccggtttgcgcttcgataaacaggttgagcggatgtaacgttgcgataatcaccaggactgggatcagaatctcaaaggagcgggccacgccggtgggcacttctttaggcagtcggatagtgacattattttgctttagccaggcataaacccgggtggcgtaaatggcggtaatcaaggcagtaaaaatcccctgaccggaaagatactgggttgagatcttttcatccgcatagggcgcggccaccagtaaaaacgccataaacgccagcaaacccgacatgatgggatcaaggttaaactgacggcccaggctggcaccaatcccgaccgagatgaaaaaggtcataacgcccatgctgagattaaatggcagcatcagctgttggcgataggtgatggaaaagtcgagccacgcacgggcaacgctgttagtggtgtccgctgaaaatggcgggaagataaataccaacataaacgacccgataatcataaacggcagtgccgccgtaaagccgtcacgaatcgctatcacatacttttgctgacctaactttccggcgagtggcgtaatggactgttcaattaccgtcaccatcgactgatataacgaactcataatgacacctttctagtgtgccgcttcaataagcgacagagcgtaatccagcaccttgtcaccgcgttgcatgccgtaatccgtcatatcaatagcccggacaggaatgccgtgggtggcagctttttcagagagcatggctaacatgtactttacttgtgggccgagcaggacaacctgatagtgtggaaactgcgtatcaaattctgaaacgccccaggcatcgatctgcacactgagaccacgctgttccgcaacctctaccattttacgtaccagcaggctggtggacatgcccgctgaacaacacaacataatcctgatcatgagtaacgctcctttaaatgaaaacgtggacggatatgatttgatacgatacggaaaccggtttccatttgtcgcaaaaggaactgtgacaggcgtcatgatcttaaggaaacgaggtgttttattacgattcagatcacgtaattggggttttttgtcggaaattgagaagagatggaaaatcggtttccacaaaaaaatgaaaacgctatactgccaatggtgataatttgagccgcagcgttagtcagtaattcagggggcctgtggtttttttaggggaaaatgatgtctactatcaacgatgtatcgcgtctggctggtgtgtcaaaagccacggtgtcacgcgtgttgagtgggtcacgcggcgtaaaagaagccagccgcgtcgcagtattaaaagcggtggatgaactgaattatcgtccaaacgtgatcgctcagtcattgctgagtcagtccaccggttgtattggcgtaatttgcgcgcaggacaatattaaccagacgaccggttatctttatgcgctggaaaaacatcttagtcagcaccaaaaacacctgttgctccgtttcgcgaacagcaaatcagaagtgatgcactgtctgaatgagctgacctgtggcttgtgtgatgatgtattgattatcggcgctcgcttcccgctcaatcttcagcaaaaaaacgtgattctggtggattgtctggaaacaggggatgacgtgagcagtattcagttcgatcacgctttcgctgctgaaaccgcctgtcactatctgataagccagaatcgccgccagatcgccctgatccattctgacggaatgggtttttccgagcaggtgctgctgggctataagcacgccctggaaaaaaactttctgccttttaaccgtaacctggtgtttatggactccacatcctcctcggtcgccctacaggagttgttgaataacgcgtccacgctgaactttagcgcattgctggtggcggatgaacagcaggcccaaaaagtcattccacagttgcaggcattcaacaaacaggttcccaccgatattatggtttttagcctggctggatcgctgaatttgcctggcatcccaaccattccggcgattgagtattcaatggacgccatggctgcgcgcatcgtgaaggcactgacggaacagacgcgaagcgtgctaaacgcctatgtgatgcggggtgacctgattattcccgattttcgccagcgcgagcaccgttaatccatacgttgctccatctgctcaatgattgccagcgccaggcctgttgccggcgcaagatgtgaggtcaggaaatgcacctgagtatgagcggcaataaacgccagtttgtttgcctgcgtctgattgagtacggcctggcaaaatgtcggactgatgctccaggggcaatcaataatgatattggcgggattcagtaacaacatgatctggctgagcgcgatgcccagatagttgcccgccagttgcatgacttcgttcaccacgttaggtgcgctgtcacggctttgccaggtcaatcccggctgacgctgagccagttgctgattaatggcgggtttgctgatcatggcttccagacaaccctgacggttgcagctacagcgagggccattaggttgcacagtaaggtgaccggcttcacctgcggtccaactgttgcccgtgaaaacgacaccgtgctgtaccagcgcaccgccaatgccttcagcgatacgtaaataaaaatgcccgctctcggcgggcaatttgagttgttgcacagacagcagcgcagccgctctgacgttattcataatgcgaatcggcaactgaacctgtttgcgtaggttgctcgccaggtcaacgtcctgccagcccaaatgggtggataaatgcatccagccccgcctgggatcaacgacgccaggaaaacccagcccgatgcctaacagacccggccacgcctcggtaagtttgtcacataaggcggccacctcggccaacagcggctccggcctgctggtatctgtacgcagggtttgctcggcaatcgtctgggaaaaataatcacacacctgccagtgaatcaggttcttttccaccatgatgccggcgctgaccagcttttccgggcgcagggtgatatggattttagggcggcccgccgcagagacgctggcctttcccagctcctgcactaaatcctgttccagcaggtcatcaataatctgcgacacggtatttttactgattgccagtatgtgtgccagatcctgacgcgacgtgatacgcagctgacgcagttgtgccatcacccgcttttggttattcagccgcattaatgcaggccctttgccagttactttcatggcggcttaccccagatgtgaaaatcggtagcggacctaccaacgatgaagtcttattagtttgatgtctaatcaaaacttagcattgggcagataggctgccaaacggcaatagcatctggacgggggaattaagtcagaaatgggtgccaggccacacgatcctgtaacggcaggataacgcgctggcccgccttagcgggcagcaaatatcagtattcatcaccgcgaacgcggctgcgatagctttcccagtcaaagcgaacccacaaactgttgcccaggcgcatacgatccataacgcgctcacccagcaacgcattcataccggcgtgatcaaggttagagagcatacctgtggggcgttttgaggatgaacggcggtccacgatctggttaataatcactttctcgtagcgcgattcactttgcataccgatctcatcgatcaccagcaaatcaacgctgctgagatcctgaatcagtcgctcttccgtgattccgctgctgccgctaaaggtgcctttcatgctcgacatcaggtcagctaccgtgacgatgagcacgctcttaccgcgtaaaatcaggtcgttaccaatggctgccgccaggtgatttttaccggtaccgggacggcctgagaaaacgaagctggcaatactgccgtcaaattctgccgcgtactggcgagcaagttccagggctttgcgctggccttcgttttcaacccgatagttatcgaacgagcaattgatgtgtaactcgcgaataccagaacggcccatgatgcgctgcattttcatggcgcggttctcacgcacaatggattctgagcgcaggcggccttgttcctgattccaggccagtaactcttcaccattggtgaactttgggcgagtgcccgcgggcatcatccgtttcagacggttaaacagatcgttcggcgttttcattattcaccccggaaaccatcaggaattgtgctgtcaggattcggcaactgtgtaatatcacgtctgggctgtccgccattcgcggcgcggttcatctgcaggctgcgcgccagtttctgctgccactgcacatgatgaaacagacggccttcggcctgccagtaagccacaaaggcagccagttcggccgccgtgaccggctcgcttagcgccacgccccagatggccgcctgacgcgtaaagtcagcgtccggttgccagccatcatacatggcaaatttacccactggtgtatgcagcgtagcagaaacatcgtcatacaggctgtcatccagcgccacatcagtgggttgctgagaggctgcctcaagtgccagcagccgtgccagacgtgctggcgtgatggcgtacatcacgggcgtgtaattttccagcaccgccagcgtgccgtcttcagcctgctgcaaggcgctgagtggatcctgacggaaagcctcaagaccaataagcgttgacgttaagattttgactgacatgaaaagacctgcggttaacttacaccgaacaccggataaaataacccggtgcagaagcgcatattgtaccttttttaacgcgcaggatcgctgaaaaagcgttgtggatagcaacccaacctaatgcgttagcacaaccgttgggttgacgtggcagtgtttacctggcgcgtttagcgccgggtttgccacagatagcgaagcccggccagccagcacaggctgtaacccagcagttcaacgccttcttcagccatatttttgacgcctcgattatagtgatcgggcatcaggtgctcccacagcgtgttcataccaaacagccgggagaaaaccagcacaatcatcaatccggccgccatgacgggccagcgattgtgattcagcagatccgccagcgcgctgatggtttgcttcggggttcgcatggctaccgctacactgcccagcgcaatcgccagcgcaaaccacacccagctaccatgacggatgagatcgaagaaaaaatccagttcacggataagcatacaactgtaaaaaccggcaattaaggttaatccaccccgttgttcgggccgatgacgggcggcaataaaaaacagcgcggcaagactgaccaataacaattcctgcacggtttcggtaaaagacgcttcatgcagcgcattatccatccagaccacatccacatagagggggccgatcattaaggtgataaacagagaagtaaaaagaaataccgtgagctcacggccaataaggattacatcgttacgcatggagttacctgaaaatgactatcgttatcattatatttttattcgtcgcacctgccttcgctttttatgcgtgatcgattcagcgaacaacataacctgcgttgatagccgaagcggtctcgcaaattacgcgccttagggttcaaaacgtcagggattgcctctactatcggggaaatcaaaatagcgcgctatataaggactaatgcaatgcaacgatgtggctgggtaacgcaagatcctgtctatctggcctaccatgacaaggagtggggcatcgcgcagagagataaacaggcgctgtttgaaatgctgtgcctggaaggccagcaggcggggttgtcctggattaccgtgctgaaaaaacgccaaaattaccgcgccgcgtttcaccagtttgatccgcaggccattgcgttgatggatgagcaggatatcgcgcagcttatgcagaacagcggcattatccgtcatccaggcaaaatcgcggcgattattgcaaatgcccgagccatgttggcaatggaagcagaaggcgaggattttgcccgttttgtctggcagttcgtcgataatcagcccattgtccatcacttcgccgactataaacagagcccgacaacctccgcgcaggccattgcgctttcaaaagcactcaaaacacgtggttttaaattcatcggcccgacaatttgttattcatttatgcaggcctgcggcctgattaacgatcatcaaaccaactgtttttgccatcctgacaacatttaacgccgatcctttacaaaataagacattgtctcaggattttcctcacttttgcgcggcataatcagtaccacttaggggataagatgcctcgttgtgatgaacgtaagggataaataatgcagaaaaagttaattgctctcaccctgttgttaagcggtagcctggtgatatcgggttgtaccaccaatccttacactggcgaatctcaggccggtaaatccggtgtaggtgcaggccttggcgcattagtgggcgcaggcgttggcgtactttcttcctcgaagaaagatcgcggtaaaggggcattaattggtgcggccagcggcgcggcattaggcggcggcgtgggttattacatggatgtccaggaagcgaagctgcgcgacaaaatgaaaggaaccggcgttagtgtgacccgtcagggcgataacatcgtgctgaacatgccgaacaatgtgacctttgattccagcagcagcagcctgaaaccggcgggggccaatacactgaccggtgtggcaatggtgctgaaagagtatcccaaaacggccgtcaatgttgtgggacatactgacagcaccggctcgcgtgcgttaaacatgcgtctgtcgcagcagcgtgccgagagcgttgccagtgccctgatcgttcagggtgtcgcagagaatcgtttgcatactcagggcgcagggccagacagcccgattgccactaacagtactgaagccggtaaagcgcagaaccgtcgcgttgaaattacgctcagtccgttgaattgattatcccgcccccgtctccgggggcgaaatacggctcgctgtcattttttcgacaattttcggtaataaaattggcaagggttccagttgggaacctgcgcacggtgcctgtcaacgctttatgccagaatgattcaaattgaacaatggataacgcatcatgtcactgaaagccattgcgtcagtattaggtctctccgttaccacagtgagccgtgcactcaacggttatgaggatgtggccaaacaaacacgccagcgtgtggaagaagaagcacagcgacgcggctaccgtcccaatgttgccgcccgacgtttaaaaaccgggcgtgccaacgcggtaggactggtttatccgatgagcgctccgccactcagcgacacgcactttaacaagatattagtggcgctcgatcagcgtctttctcactacgatatcgatctcctgttattaaccgataaaccgcatgacgggcagcgttcactgattcgcatgctgcgcagccgggcggtcgatgcgatcgtcgtgacgcacaccttacctcatgacgagcgcctgctcagcctgcagcagaaaggttttaattttcttacgctgggacggagtgatgcacagcaggatcatgcctggtttgacgtcgacaatgccgccggttcggttctggccgtgaagcactgtctggcgctcggcatgcaacgtatcgcctggctcggtggcaacgagacctgcacgtttgtgcgcgatcgccgccagggttatctgaatgcgctggattccgtgccaccttatgccaccgccgtggttgaaccgtcgcgtcgggcgggttatcaacaaattacagactggctggcgcaagggctgcaacctgaggcaattatcaccgattgcagtgcgctggcggaaggcgcgctaatggcattgcagcaggcgggtcgcctgcagggtaaagacgccatcaccttaattgcgtgggacgggctaccggctgatgccattatcgattacccgattatcgccattcgccaggccagcgagcagcagagaggggagcaggtagcgacgatgataatgcgcctgctggaaggcgcgccgttggcgcaactgcaggtactgtggcaaccctggctgcaacttccccaatgacgctatcttttttgccatgttgtatgcctgtggtagtctcgccggatgcttaatttgcggaagactttatgaaaaccaggccgtctcgcgccacgatcagcgatgttgctcacgcggcaaaaaccggtaaaaccagcgtctcacgctatttaaacggcgagcaacatttgctctctgccgatttaaaagcgcgcatcgagcaggcgattagcgatcttaactatcggccaagtcagatggcgcgtggcctgaaacgcgggcgtacccgactgattggcctgatcatcgccgatattacgaatccctattctgtggacgtgatgtgcggcattgaagccgcctgccgcgaatgtggctttacattgctgatgtgtaataccaataacgaagtcgatctggagcaacattacctgcagttgctgagcagctatcaggttgaaggcattgtggtcaatgcggttggcatgcatgaaaaggtcctgagccggttacaacagtcgttgctgcccatggtactgatcgatcgaaaaatccctgatttcccgtgcgatgttgtcgggctgaataatgccgaagcggcagaaacggccaccggccatcttattgataacggctatgagtcactgctgtttctcagtgaaccgcttggaagcgtgaatacgcgtcgggaacggctacaggcgtttcgccagcgtttggctgcgcatcccgcgatcgtccatgagaacgctgaggtcgcgctgcaccaaccggagctgatggataacgtcctgcgcgactttcatcagcgccatgcgggaaaacgctgtgcggtaatggttgccaatggcgcgctaaccctgcaggtggcccgctctctccagcgtcttgcgctgcactggggcagcgacattggtctgctgggatttgacgagcttgagtgggctgcattggccggggtgggtattaccaccttaaagcagccgacctggcaaatcggttatcacgcgcttgagcgtcttatttcccgtatcgacggtcacgatcatcccccttgcgaacaggttttttcgggcgaactgattgttcgcggttccagccaacgcctgcgctgattttcagactcttcctttcgattacgtgctcacttcgtgagcacgatcataattccgcgttttgctactttgctttggaaccggttccatttaacgtttttgtaacgcaaatgccgattttcacatcaggagcccgtaatgaagcccgaaatcatcgtcgtgaccgctgcttatggtcatcaacaggttgctgcactgggcgggcagttagcgcttttgcccattatccagcaggccggtgccgacggtgtggaaatccgccgtgaactgtgtgatgacaccacgctaacgcatttacccgcgctggcgcaggcggcgcggcagcaccagttacgcgtcagttattcggtgcccgacaccttgttcagcgaggacggcaggctaaacccactgttgaaaagctactttagcgaagcacttcagctcaatgcacaacggttgaaagtggcgctgggaaacttcacaggtgcgctgtacagcgaaatgctgcgtaagcttatgacggaatatggcattcccctcaccgtagaaaatgatcaaacgcgctttggtaagcagcagcccatgttgcgtttcttcaacactgcccaggaggcggcgctgccgatcggcatgacgtttgatatgggcaactggtactggacggatgaagacccgcgccaggcggcggacctgctggcgggccatgtgggttacgtgcatgtcaaagcggcggcgccgcaggggaccagctaccgcgcgatagcgctggatgacgctccgcctggctggcaaagcctgttacaccggttacctgcaacagcgcctcgcggcattgagtttccgctggaaggcaacgatttgattgcggttacgcgccattacgtgacgctgctgcgtaacgtctgaggagtacatatgacaacccatccaaacggcacgcttgatgtgatcaccatcggtgaggccatggccatgtttgtcgcccgtgaaacgggcgatttggctgctgtagaaacctttgttaagcgcgccgctggcgctgaactgaatgtggcaatcggtctggcgcgccttggcctgaaagtgggctgggtaagccgcattgggcaggacgcctttggtcgctttatctgtcaggtgctggataaggaaaatattgaccaccgccaggtgatcgtcgactcgcactatcccaccggtttccagcttaaatccaaagtcgatgacggttcagatccgcttgtggagtacttccgtaaaggctccgctgccagtcatctgtcgccaaaggattttgaccacgactatttcggttccgcgcgccatttgcatcttagcggcgtggcggcggcgatttcagacagctcgcttgcgctgacaaagcatgcggctaaagagatgcgggcacgaggcaaaactatttcgtttgaccccaatctgcgacctgtgttgtggcgcagcgaagatgaaatgcgcaagcagctcaatctgttcgcggaatacgcggactgggtactgcctggagaaaaagagggctatatcttaaccggctatcgtcagccgcaggatattgccgatttttatctcgataagggcgtgaaagcggtcatcattaaaaccggttgtgacggtgcctggtacaaaacggccagcggtgagcagggccaggttgaggcgatgaaagtcgataacgtcgttgatactgtgggggcgggagatggttttgccgtgggtgtggtgagtgcgttgctggaagggaagccactggtacaggcgattcgccggggtaacaaaataggctcactggcgattcaggttattggcgatagcgaaggtttgccgacacgtcagcagttaggcgatgcgtagcccagcccgcaaacacagacagaggagtttccgatgaaaacgcagactatcgcgccaaaacgctggtggttcatcatgcccatcgtgtttattacttacagccttgcctacctcgaccgggcaaattttagttttgcgtcggcagcgggcattaatgacgatttgggcatcacgaaaggcatgtcatcattactgggcgccctgttctttctgggatatttctttttccagatccccggggcaatttatgccgaacgccgcagtgtaaaaaaactgattttctggtgcctgattctgtggggcggctgtgcttcactgaccggtatcgtcagtaacattcccatgctggcggccattcgttttgttcttggcgttgtcgaagccgctgtgatgcccgccatgctgatttatatcagtaactggtttactaaatctgaacgctcgcgggccaatacctttctgatcctgggcaatccggtcacggtattgtggatgtcagtggtgtccggttatttaatcgaggccttcggctggcgggaaatgttcatttttgaaggcattcccgcggttatctgggccgtggcctggtggttcttagtgcaggacaaaccgtcgcaggcgcgctggatgagcgaggcagaaaaagccgcgctgcaggctgagctgcaaaaagagcaggaaagtattaaggcggtacgcaactacggcgaagccttccgcaaccgcaatgtcatcattctctgtttgcaatattttgcctggagcattggcgtttacggtttcgtactgtggttgccttcaattttgcgtaatggcactcaaatgggcatggttgaagccggctggctgtcagccgtaccttatctggcggccaccattgcgatggtgctggtttcctgggcctcagacaaaacgcaaaaccgtaagctgtttgtctggccactgctgctgattggtgcactggcgttcctgggctcgtatctggtcggctccggcaatttctggctatcctatacattactggtgattgcgggggcggcgatgtacgcgccatatggaccgttctttgccattattccggaaatgttgccgcgtaatgtcgcgggtggtgcaatggcattgattaacagtatgggcgcgctgggttcctttatcggttcctggattgtgggttatctgaatggtgcgaccggcagtccttctgcctcctatatctttatgggtggcgcgttactgctgtcagtggtactgacgcttatcgtcaaacccgcacagaataagacgccgccgcttcacggggcgaaaccggcctgaaagcgtaagcgttagcaccttctccgggcgaccttagcgttgcccgtcattcatttacagggagctatctgatgaaacccgccgtcattctctataaaaaattgcctgacgatctgcgtgcgcgccttgcagaacatgccacggtgaccgaaatcgacgatctgtcgccagaaagccagcagcagcatgaaaaggcgctgcaacaggccgaaggattattaggctcgggcggtaaagtcaatgaggcgctgctggcaaaaatgcctaagctacgggcctgttccagcgtttctgtgggctatgacaactttgatgtagatgcgctaaatcaacgtggcgtggtgctaatgcatacgccaacggtgctgacagaaacagtcgctgataccattatggcgctggtcctcagcagcgcacgacgcattccggaactggatgcctgggtaaaggcgggtaactggcaaaaaggcattggcccggatcgctttggcaccgatgtgcaccataaaaccttgggaatccttgggatgggccgcattggaatggcgctggcccagcgggcgcatttcggttttggcatgaaaattatctaccaggctcgccgccagcatgagcaggccgaatcacagttcgcggcgcaacgctgtgaattggaaacgctgctaaaacagagcgactttgtctgcatcagcctgccgctgaccgaagaaacccaccatttgattggcgcggaacagttaaagctgatgaagcctgatgccatactgatcaatgccggtcgtggcccggtggtggatgaaaaggcgctgattgccgccctgcaggacggtactattcgtgccgccggactggatgtgttcgagaaagagcccttacccactgactcgccactgctgtcgttgccgaatgtggtgacgctgccgcacattggttcagcaacccatgaaacccgatacgggatgatgcaggatgcggtagaaaatctgatcgcagcgctgaacggcaaggtagaaaaaaactgcgttaatccgcatgtgctgacgtaatccctacggctttccattgcgcccgccgggagcgggcgttatggtggttcacccattctttattacaaatttttaaccgttatggccttttctcagttcggcgacaaatttactcagcattctggcatctcacgtctgatggaagacatgggcgcaggcttacgtacgcctggcactatcatgctcggcggcggcaatcctgcgcagatcccggcaatgaacgactattttcagcagttgctgcagcatatgcatgacgagggcaagctgagtgaggccctgtgcaattacgatggcccacgcggtaaagcggtgctgctggatgcgctggcggcgatgctgcgcgagcagcttggctggtccatcactgcacagaatatcgccctgaccaatggtagccagagcgcgtttttctatctgtttaatctgtttgcgggccgccgcagtgacggcagcaaaaaacgtgtgctgttcccactggcaccagaatacctgggttatgccgatgcgggcctggatgaggacctgtttatttcggctaaaccgaatattgagttgttgccggaaggacagttcaagtatcacgtcgactttgaacatttacctatgaatgacgacgtcggcctgatttgtgtctcgcgcccaacgaatcccaccggcaatgtgattactgatgatgaactgctgcagttggatgcgctggcgcagcagcatgaggttccgctactgatcgacaatgcttatggtgtgccgtttccgggcattatttttagcgatgtccggcctctgtggaatcccaatatcattctttgcatgagtctgtccaagctcggtctgcctggcgcgcgctgcggcattatcatcgctgatgaaagcaccattgcggcgattggtaacatgaacggcattatcagtctggcaccgggcagtattggcccggccatcgcctgtgaaatgatccagcgtggcgatttgctgcgactgtctgaagcggtgatcaagcctttctatcaggacaaggttaggcagacgatcgccattattcgtcgttacttaactgcggatcgctgcctgatacataaacccgaaggggcaattttcctctggctgtggtttcgcgatttgccgatcagtacggagttgctgtatcaacgacttaaggcgcgaggtgtgctgatggtacccggacactttttcttccctgggctggaacatgactggccgcacacgcatcagtgcatgcgtatgaactatgtgccggatgctgaaaatattgaaaaagcggtacagatccttgcagaagaagtggaaaacgcctggcgcgacagctgattttgcgcctgcatcatcacaaaaggccgccgtgtgcccatggctaacctgtgctttaacgtgaagctgcctcaacctggtgttgccgggcagtagacgactatttttgcattatcggtcaacgcggttgggctcatggctgttgtggcctgagacgagcaaaaggagtgtgctgtgtcgggaaaagatatgctgttggccctttgcgtggtggttgcctggggcgtgaactttgtggtgatcaaactgggcctgcagaatatgccgcccttcttgctggccggactgcgttttgctctggtcgcctttcccgccattttgctggtgcgtcgtcctgccgtaccactgcgctggattttactgtacggcatgaccatcagttttgggcagtttgcgtttctgtttttggcgatcaagctgggcatgccggcaggcctggcctcgctggtgcttcaggcacaggcgttctttacgttgctactcggggcgctgtttctggcagagaaactccgctggaatcatatcgtgggtattattatcgccactctgggtatgtttttgttggcgacctcgggaatggcgggccagagtgcagccggtattacgctgacgacgatgatgctgatgctggcggcggcgttctcctggggactgggcaatatcaccaataagatcattacgcgtcactatcccgtaccggtgatgtcattggtggtctggagcgccctggttccggttcttccttttattggctgttcgctgctgttcgacggtgaatcggcgataatgagtagtctgacgcagattaacctgcaaacgatactggcgctcgtttatctggcgtttgtcgcgaccattatgggctacggcatctggagtaccttgctcagccgctatgaaacatggcgcgttgcgccgttgtctctgctggtgcctgtggtggggatcgtcagtgcggccttgttgttgggggaaacgctatcactccagcaggttgtgggcgcagcggtaattattgtcgggctcctggtgaatatgtttggtggcatgatcaggcagcgatggtttatgcgttcgcaaacataaatcatccggctgagattgcaggcatctgatgagcgtaccatctcctttactgcatgtttatccgagggcgcggttatcaaagccgtagagctcagatgggttatcacgcagaattaacatcctgtctgcggacgagggtgcccatcgcgccagtaaatcgagtatggcggcatcatcgggcttatcgtgttcttcttttgtaggatgtggccagtcacttccccacaacaggcggttaggccgaatccttaccagttccgcggcgacctgacccacgtcctcatagcccggtgagccgacgcgggacttgatgtatggcccagacagttttacccaggtgttacctgcttcaaggagacgggttactgtctggaaacaaggagatgtgattccctctggttgcggaatatgccccatatgatcgataaccagttttgtgggcagcgccgccaggcgcgattccagctcagccagtttttcgccgggcgcaacgacctgaatatgccatccccactgtgctattcgggaagcaagaggctccagattatccagagatgttcctcctctgctcagattaaaacgaataccacgtacgccatgccgatccatttcttgtagctctgcatcactcactgacgtatcgataacggccacgccccttgcgcggcctgcactctgcttaaggccctccatcaacagccggttatctgtgccgtaggttgaaggcgtgacaatgaccatgcggtgaagtcccaggcgggcttgcaacgaggagtaatcggcaagcgatgcattggcgtgttgtaagcttgcaccgggtgcagcaggatatttatcgtcataaaggtgcatatggcagtccacgctgcctacggggacgttcaacacaggttgtttttcccctgagctaaaaggcgtgttgctgagggcgttaaaaacggtaagcgcacttagtgcacctccggcttgtaaaataaagcgtcgggttattgccataaagagactccacgtatgtcggaaaggacgtttaatgcagtgtcgtattcgataataatctaacctgtccttttggtagcctttagcaataagcgtttttcgtcaacatgattgatcaggctaaacgtgatcctgtatgagcctatgggaattaaacagtataattttttcaaaaaattaattcttatgatcaacttctgaataagttgttattacatacacatgatttacatgaaaatatagattaagttatctaagtattattcatcatggaattttttgtgatgtatctgcttttttaaaatcatggcggcgctggtcttttttagtagaacccgattggcaagcgctaatatggaacccattgctcataaaagagcgttaacctggacacctcgccttctgcatgaaagtatcaccctccctggcaagataaaagaccagatacatcgcacgacgctctcaaccttttgcgttattcccgggctgagaaacgctgattcttatcattcaggcccgatgccatgaagaagaaaaactcaacgccaacaccacacgatgcgactttccgccagtttttaacccagcctgagattgcgcgcgatttcatgaatcttcatcttcctgacgagctgcatgctatttgtgatctgagtaccttaaagctggagtcaggttcctttgtcgaagcggatctgcgtcagtatttcagcgatgtgctttatagcctgaaaaccgcatgcggtgagggatatattcatgtgctgattgagcaccagtcttcacccgataaacatatggcgttccggcttctgcgctatgcggttgcggcgatgcagcgccatctcgacgccggtcataaaaagctgccgctggttataccggtgctgttttatatgggtaaacgccggccctatccttattccacctgctggctggatgaatttatccagccggcgctggccagcaaactgtacagtacatgttttcccctggttgatatcacggttatacctgatgatgaaatcgcgggccatcgcagtatggccgcactgaccctgctgcaaaagcacatccatcagcgcgatctcgccgatctgatggacagacttgtccctgtgctgctgtccggttatctttcatcatcacaggtcgtatccttagtacattatattatgcaggcgggggaaaccctggccgtcgaggcttttattcaggaactcgcccggcgggtaccgcaacacggagacgcgctaatgactatcgcacagcagcttgaacaaaaaggcattcagaaaggcattcagaaaggcattgagcgagggattcagctcggacgacaggaaggccgcaatgaaggtaaacgcgaagtcgcgcgaaccatgctgcagaatggtctcgatctctctaccgtaatgaaaatgacgggcctgagcgaagaagagctggcacagattcagcactgattttaacgccactgcaacgtgctccatgaggctattgcaaacctgatgcctcattatgcttcgctttgcccgttcccgcgtcagtcgccgcatcgccctgatacacgcttcaacgaggcagggctgcaaaacgtctttattgccaatgtcatccataaaaaaacggccacagcagcaatgctgtggccgttctccagaatgactcagccgttacggccgttttatttcagaatttcaatccggcgtggttttgcttcttcaggcaccagacgctcaagatcgatgctcaataacccattttccagacgcgcatcacgcacgacgatatggtcagccagctggaatttgcgctcgaaattacgctcggcgatgccctgatagagatacttacgttcagtctgctcttctggatgggcaccacgcacgatcagcacgttatcgtgggcagtaatatcaagttcactctgggcaaaaccggccaccgcgatggtaatgcgataatggttttcatcaaccagttcgacattataaggaggataacccccgttgctctgattttgattggactcaagcaggttgaacaaacgatcaaaaccgatagcagagcgataaagtggagacagatcaaagttacgcataaaaatactcctgaatgtcagcaagttttggcaaccttccagcagtggacaggttgtgtcgtaccgcattgccccttacggcggcaaccttaacggcctgctataaaaatgggtgcaggtaacatgctttcaaggtgccgtacgtatttttttcgccaaatcggtgaaatgacatacactcaggggtacatagccggaccagaacggacttcactagcgggtgataaggtattctggcgagccaactcagtcaggtgttgccaggactgaagggatgacgatatgaaaatgatgaaaaggttaccgctggcaggcgtgatgtgctgcgcggtcgtttcaagtggatgttccagtgtgatgacgcataccggagcaagccagggctattatccgggcacgcgcgccagcgctgatatccttaccgacagcaatgccagttgggcgcttaagccgctggcgctggttgacctgcctttttctgcggtaatggatacgctgttgttaccctgggattattatcgtagcgatagcgaccaacgtctggattcaccgcgcgcccgggtgctgcagagcgaaaagctggcgcacaccgaggaaaacctgtcccatgctcaacccatgcccgctatgcaaccgcaacggtaaacagttgccgccagccctctttttcacgcataaaagcaatctgctttccgtctggtgaccagaccacggcctcaccggacggtgcctcacgacgtcgtaccgttaagcgttgacactcaccggttgccacgcggcaaagcataacgctgttatcgcagataaaggcaatggcttcgccacagggccgccagctaaacgccgactggatgctgctgggcaggcgggttacctgacggggtttgccgccgttaggcgacacgtgccaaagctggatcacctgctggctgtctgccattaaaaacgctatcgcactgccatctggcgaacttcgcagccagtggcgaggttgtaacgccagtccttgagtcgtcgttatgcggcgttgccgaacgccagccggcggcgcaggtagatgatcgttatcaccttccagcggtaaacctcccggcattgcatacgcttccagcgattcaggcagatcgacgacaaacacttcgggacacttttcccctgtagcggaaagggtgtcaccgataaaggcgatggcccagcgttgccagctaccgtcaggtttttgatagccctggttgccaatccagcactcttcatatgcccggttgatgtggtcgctacccggctgcggactggcggttgtttcactaattaacacgcaaaaatggctgccatcgtattcgcgcgggtgctgcttttctggcttaaccgatcgcagtggtacggcgattccgacattacgcaggtcaagacgctgatcccgttcgtgcattacgtgatcgttataggtgaagctaatgcgtgtgccatccgggctaaaaacatgcacgtgggagccgccacgcagggcacctggcgtgaagggcggcgtgatatcgcatgcatccaggttttcggcctggccctctgccacgatcacgccgcgccgatgatgaaaatcgtaatgccagctttcgtcaggatgctcaggcccatggatacaaacgtaacgtgggggcaatgtcggacttacggtgacgacgccaacgtgcgcgtcatcctttgcctgatataccacctccacttcgcccgtgttcacattcacgcgctcaatggtctggctggtaaaagaagcgccggaaggccgcacatcaaatgccagccactggctgtcagcggtccagacgttgatgttcgtcaactgatggtggcgcgatgcaaaggtgatctgtttttcagacatagcaaaatccagtgaacagggggcggcaaattacgcgcgtgtatttatggatgaaacagcctcataagaggcaatcaacggcggcctcaccctgcgtcagaacaggctaaagcacccatttttcaatcgcgtgcgcaacaccatcttccctgttggttttggtgacgaactgcgcaatctgcttaaccgattcaatggcattgcccattgccacaccggtgcctgcgtattcaatcatggccagatcgttttcctgatcgcctatcgccatcacttcttccgctttaagtcccagtttttcagccagcatttttacaccgtagcctttattcacccggcgatcgaggatctccaggtaatagggcgcactcttcaggatggtgtaagtttgatgtgcatgttgaggtaactttgcaatcgccgcatcgagcagggcgggcttatcaatcatcatcagtttcgggaagcgagtggtcgggtccatctcttccacggcgcgatagcgtaccggaataccggtcaggctggattcgtgaatagtgaattcgctgatgtctttgtttggcgtgtaaagatgcgacttatcaaaggcttgaaaatgcacgcccagttcccgagccagcttctcgacatacagataatcgtcataacccagcgtcacatccgcgaccacctcgccatcttcggcccggtgaaccagggcaccattattgctgatgcagaactgtccgctggtttgcagatccagctccatcagataacgttcaatgccaacgaaaggcctgccggtcgctaacacaatggaaacacccttttcccgggcgcggttcagcgctgtttttacccctggcgtgatctcatgctgcggattcagcagcgtgccatccatatcaattgcgatcagttttatagccatagcatcctcgttgtgtcaggtttgctgcaatgctagcgcgattcagcgcatattgaccagttcgtcggcgctttatcgcacgcttacaccataatctggccaccgcccgtctggcgatgcgcaaatcgggcagcggtatcaggcaaaaaaaaacccttccagaggaagggttttgctcatcgcagggcgattagatatcaatatttgcggctttcagcgcattctcttcgatgaaggcgcggcgtggttcaaccgcgtcgcccatcagtgtggtgaacagctgatcggcagcaatcgcatctttgatggtcacgcgtaacatacggcggctgtccgggtccatggtcgtttcccacagctgctccgggttcatctcgcccagacctttatagcgctggaccgacagaccgcgacgcgactctttctccagccagtcaatcgcctgttcaaaactgctgacaggctgacggcgttcgccgcgttcgatataggcatcttcttccagcaaaccgcgcagtttgccgcccagagtgcaaatcttgcggtattctgcaccctgcaggaactcggcatccagaggatagtcggtatccacgccatgcgtacggacgcgtaaaactggctcaaagacgctctgctcacggttttcacgaacctgtgccagataggtgctgccgtgcgcttcgcgttcggtcaggtagctaaccaggccgttgatccacagggtcacttgcgcttcgttgctgatatcgctcagggtatcgtgataaatcagcgcacgcagcatggcgaccggataacggcgctccatacgtttgatcatcttctgggtgctgttgaattcagccaccagcgtttccagtggttcgccgcctaacgccggtgcgctggcggtggtgtgcagcgaggtaccgtcaagggcaatagcaatctggtactgaagcattgcctcatcgtccttgatgtactgctcctgcttgccttttttcaccttgtacagcggcggctgcgcgatataaacgtggccacgctcgataatttctggcatctggcgatagaagaaggtcaacagcagcgtacgaatgtgtgagccgtcgacgtccgcatcggtcatgatgatgatgctgtgataacgcagtttatctggattatattcatcgcgaccgatgccgcagccgagcgcggtaatcagcgttgccacttcctgagaagccagcatcttatcgaagcgcgccttctcgacgttcaggatcttacctttaagcggcaggatggcctgattcttacggttacggccttgcttggcagaaccgcctgcggaatcaccctccaccaggtagatttctgacagcgccggatcgcgctcctgacaatccgccagtttgcctggcaggccagccagatccagcgcgcctttacggcgggtcatctcacgggcacgacgtgcagcttcacgggcgcgtgcagcatcaataattttgccgacaacgatttttgcatcgcccggattttccagcagatattcagccagcagttcgttcatctgctgttcaacggccgatttcacttctgaagaaaccagtttgtctttggtctgtgaagagaatttcggatccggtacttttaccgaaaccactgcaatcagcccttcacgcgcatcgtcaccggttgcgctgactttggctttcttgctgtaaccctctttatccatataggcattcagggtgcgcgtcatcgccgcgcggaaaccggcaaggtgcgtaccgccgtcgcgctgtggaatattgttggtaaagcagtaaatgttttcctggaagccgtcattccactgcagtgccacttctacgccaatgccatctttctcggtcgagaaatagaatacggtggggtgaataggcgttttgttcttattcagatactcaacaaaagcacgaatgccgccttcatagtggaagtggtcatttcttgcatcacgcttgtcttccagacggatcgacacgccagagttcaggaaggacagttcacgcaggcgtttcgccagaatgtcgtattcgaaatcggtaacgttggtaaaggtgtcatgacttggccagaaacggatgcgggtaccggttgcgtcggtatcgccagtggccgccagtggcgcttgaggcaccccgtgcacatagatctgctgatgcactttgccttcgcgacgaatggtcagctccagcttctgcgacagggcgttaacaacggaaacacccacgccgtgcaggccgccagacactttataagagttgtcatcaaacttaccaccggcgtgcaggacggtcatgatgacttccgctgccgacacaccttcttcttcgtggatgccggttgggataccacgtccgtcatcctgtacggagacagagttatccgcatggatggtgacgacgatatctttacagtgaccggcgagcgcttcgtcgattgcgttatccacgacctcgaataccatgtgatgcagaccggttccgtcatcggtatcgccgatgtacatgcccgggcgtttgcgtaccgcatcaagccctttcaggactttgatacttgaagagtcataagaattcgacatcaacgtttctcgctcatttaatctttaggttgaaccgctattttaccctgttccacgcggaacatcttgcccttttcgtcagtcatgtcgattacatgctccgaagagatggcgctgacaaagacctgtgcctgggtagctttcagtcgttgcgccagcaggcgacgacggctgtcatccagttcagaagcaaagtcatcaatgaggtaaacacaacggcgtccgctctggcgggtcaggaactcgccctgcgccagacgcaatgcacacatcagtagcttaagctgaccgcgtgagagtaaatcttccaccggcgtaccttcggcacgaatacggaaatccgctttgtgcgggccgctggcggtataagtcagggcacgatcgcgttcgaagttgcgttcaagcagctcgccgtaatcgctttctttgtcccagccacgctggaacgaaaaacgcagatcaaattcgggtaagaactgtccacaggtggtgacaatttcggctgagatggccgcgctgtattcagcgcgccactggctgatctgctcggccagcgggaccagttcctgatcccaggggcgaatctggctgtagcgcgtgacctgacgcaacgccgcattgcgttgcttaagcaggcggcggaggttgctccaggcattaaaaaagcctggcgtattatgaaaacagccccagtccacataggctctgcgatatttggggccaccgtttagtagagtaaaaccttctggcgtaattaactgcatcggcaacagctgcgccagctcagcgactttgtgaccatcgctgccatcaatgcggactttgctttctccggcccggtttttactcagccccaccgagagctcgcgttcctgaccttccagccgaccatgcagcacaaacgctgcctgatcgtgacgaatcacccggcccgcctgtaaactgcggaaagcacggccgtgtcccagtgtataaatcgcctcaagcacgctggttttaccgctaccattcgcacccaccagaaaattaaaccctggcgctaacgctaagtcggcctgttcaatattacgaaaatcttttatcagcaggcgggttaaagccatgaatcaatccagcgtgaagggcaaatgaggtttatcaaatctcagtggttccggacgttagcggttctgcttgttttcacacgctcagcgcgcctggcgcatacaacgtatgtaaccagagaggcgcactgaacggatgaaaatagcgaaccgatgagcccgtgttctacaaacgcattggcatgacgacataggccgctgccggacttaccacatcttcgatctgcacgcttgataccgaatccgtcagcaacagacgcacattctcgcacttaagggcattcagcacatccagtacgtaactgacgttgaagccaatttcgagttcgctgccgttatagctgacatccagcatctcttccgcttcttcctgctcaggattattggcggtaattttcagctgattttcggtgatatgcagccgaacgccgcgaaatttctcattagagagaatcgccgcacgggcaaaagcctgtttcagcagatcgcagcctgcttccagggctttatccgggttcttaggcaatacccgacgataatcagggaaacgaccatctaccagcttggaggtaaaaatatagtcgccaacgtgcgcgcggatattactgctgccaatctgcacctgaagcggcgtatcgccgccgtccagcaggcgtaacagctcgatgacccctttacgcggcacaatcactgaatggcttggcagcgcctggccaatgggcattgagcagaccgccagacggtgtccgtcggtagcaaccgtacgcagctcttcgccttccgtctcaaacatcatgccgttcaggtaataacgtacatcctggtgggccatagagaactgggtggcttcgatcaggcgttttagcgtggcctgaggcagcgtgaattcaacttcgttctgccagtcatccagattggggaaatcgctggcgggcagcgtagagagcgaaaagcggctacggccagagcgcactaacatgcgctcgccttccagcgttacgtttatctccgcgccttccggcaggccacggcaaatatccaggaatttgcgtgccggaacggtcgtcgcgccggtctcgtgcgcctgggttagcgcaacccgtgcgaccatttccatttctaaatcggtgccggtcagcaacaaagagccttcattaacctgcatcagcaggttgccgaggattggcagcgtcgggcgaccacctaatggaccactgacttgctgcagcggctttagcaactgttcacgttcaacaataaatttcatagcgtcacgaagataatgttctgatgagatttgagaaatcttctttgatgtcgtggctttcttcacgcaactgctcaatcttacggcaagcgtgaagcaccgtggtatggtcgcgaccaccaaaagcgtcgccgatttccggcaaactgtggttggtcagctctttagccatcgccatcgccatttgacgcggacgtgctaccgagcgcgaacggcgcttagagagcaggtctgcgactttaattttgtagtactcagcaacggtcttctgaatattatcaatagtgaccagcttctcttgcaacgccaggagatcccgcagcgcttcgcgaacgaaatcgatcgtaatcgcccggccggtaaaattggcgttggcgatgacccggttcagtgccccttccagctcgcgcacgttggaacgtaaacgcttggcaataaagaaggctacttcgcccggcaggcggatatcgttttcatccgcctttttcatcaggatcgcgacgcgggtttccagttctggcggttcgatcgctaccgttaagccccagccaaagcgtgacttcagacgatcttcgacgccgttgatctctttaggataacgatccgaggtcaggatgatctgctgattgccttctaacagggcattaaaggtatggaaaaactcttcttgagaacgctctttgttggcaaagaactgaatgtcatcgatcagcagcgcgtcaaccgaacggtagtagcgcttaaactcttcgatagcattattttgcagcgctttaaccatgtcctgcacaaagcgctcggagtgcatgtaaaccactttggcattgggtttacgcgcaataatgccgttacctaccgcatgcaacaggtgggttttacccaggcccgtaccgccatagagaaacagtgggttataggccccgccaggattgtcagccacctggcgtgccgccgcgcgtgccagctggttcgatttaccttcgacaaagttatcgaagttatggcgattattgacgttagaacgataagtcacatccgctggcgcaggcacattatcccagcttgggcgcataatctgcgcaggcgccgggcggttttgaacgggtgcagccggagcgctgacgctggccatgacaggctgattgaccgctgcggcttgttgaaccgggcgcgtgcccacctcaaaacgcaacaacggtacgttgacaccgcagaattcattcagcaatgcattgatgctattaaggtatttatcccgaacccagtcgagtacgaagcggttaggagcatataaggcaagcgtattgtcgtttaattcagcctgaagtggacggatccacatgctgaattcggtggcaggaagctcatcctgcaaacgggcaagacactgttgccaaagcgtaagtgacacggcggactccactcgtacaaattcgataagaaaagtaggcgctaatctaagaaacgttcatttttgacacagacgaaagaaagcgcctgcgaccgctatcagcggttttccatcctgcaatcattggaggatcgtcagaggaagggcggatcatagcgcaaagcgcgacagagatcttccctttctacacagtttttatcctttttatccacaggacatgaacgcggaagaaagtttacgcttgtggtagaaaaaaccacctgggatcgcgctgaatgattcaatttttcggacgagctctcgtttttgcttactaacgcgcccatttgatcgcaataagatcctgcgcgatccttgcgctttaacacagaccccgtataattcttcccccggcgttgtcgcgtcatgctcaatgcccggactcagcgggctgtaatccgggtttctggtaccgcgacaagcgaagtaaattgactcgggactgtacaattattacaatcccgcctctttattaaagacacattgaggcgtcggtctgttttttggtccggaaacgcgtcacccagtgaaaattttcaagtttaggtagaaatcgccatgaaacgcacttttcaaccgtccgtactgaagcgcaaccgttcacacggcttccgtgctcgtatggcaactaaaaatggtcgtcaggttctggcacgtcgtcgtgctaaaggccgctctcgtctgaccgtttctaagtaataaagctaaccctggtgggtaagctcgcatttcccagggagttacgtttgttaactcccactcatttcactttcgtctttcagcagccacaacgggctggcacgccgcaaattactattctcggccgcctcaacgcgctggggtatccccgcatcggtcttactgtcgcgaaaaaacatgtgaaacgcgcccacgaacgcaaccggatcaagcgattgacccgcgaaagctttcgtctgcgtcagcatgaattaccgtcgatggactttgtggtggttgcgaagaagggtgttgccgatctcgataaccgtatgttggcggaagcgttggagaaattatggcgtcgtcactgtcgcctggcgcgcggttcctgatcgtcctgatacgcgtttatcaacgcggcatcagtccattactggggccacactgtcggtttcatccgacctgctctcaatacggaattgaggccttacgcaggtttggcgtgataaaaggcagttggttgactttaaaacgcgtattaaaatgccaccctttgaacccgggtggtgacgatcctgtgccgccaaaaacctttgataccagagaacattaacgatggattcgcaacgcaatctctttctcatcgcttttctgttcgtgtctttcatgatctggcaagcctggcagacggaccatgctccgaagcctttgcagacccagaccacgcagaacacaaacagtgcagccggtgatgctgcaggccagggtgtaccggccagcggccagggtaaaacgatcaccgttaagactgatgtcctgtcattaactatcaacacccgcggtggcgatgttgaccaggcacaactgctgacttacccagataagctgggttctgataagccgttcgagctgctggaaaccacaccgtcgtttgtttaccaggcgcaaagtggcttaacgggtcgtaatggtccggataatcctaacaatggtgcgcgtccgctgtataacaccgcccaggaccatttcgaactggctgacggtcagagcgaactgcgtgtgccgatgacgttcaccgctgaaaacggcgttgtctataccaagacattcgtgttcaagcgtggcgactatgcggttaatgttgactacaacatcaacaataccagccagcagccgctggagttgtcgatgtttggccagttaaagcagaccatcgatttgcctaaacaccgtgataccggcagcaacaactttgcgttgcacaccttccgcggtacggcttactccaccagcgaatcgaaatacgaaaagattaagttcgataccatcgcggataacgaaaacctcaataccaataccagcaatggttgggtagcgatgttgcagcagtattttgccaccgcatgggtgccgcgcacccagggcgcgaatacgctttacaccagtaatctgggtaatggcgttgccgccatcggctataaatccgcgccggtaaccgttgcgccgggtgcacaacagacgctggatgccacgctgtgggttggcccggaaattcaggacaagatggctgccattgcgcctcaccttgacctgacggttgactacggttggttatggtttatctctcagccactgtttaaactgttgaagttcattcacagctttatcggtaactggggcttctccatcatcatcatcacgttcatcgtgcgtggcatcatgtacccgctgaccaaagcgcagtacacctcgatggcgaaaatgcgcatgctgcagccgaagattcaggcgatgcgtgagcgtttaggtgacgataagcagaagcagagccaggaaatgatggcgctgtataaagcagaaaaagtgaatccgctgggtggctgtttgccgctggtgattcagatgcctatcttccttgccttgtactacatgctgtccggctcggtagaactgcgtcatgcgccgttcattttatggatccacgatctgtcagcacaggatccgtactatattctgccgattctgatgggcatcaccatgttcttcattcagaagatgtcaccgaccaccgtgaccgatccgatgcagcagaagatcatgacgtatatgcctgtgattttcaccgtgttcttcctgtggttcccgtcaggtctggtgctgtactacatcgtcagtaacctggtgaccatcctccagcagcagctgatttatcgcgggctggaaaaacgtggcttacacagccgcgacaagaagaaagcgtaaagccgtcgcgggaggtctcccgcgataaaaacggttatgctcaggcggtcaaagcgaccgcctttgttttttgtagtgagagagaatttatgagccatagcgataccattgttgctcaggcaaccccgcccggacgcggcggcgttggcattttgcgtatttccggtccgcgagccgccgaggttgcgcagcagatattgggtaaactgcccaaaccgcgttatgccgactatttatcgtttaacgatagtgacggcagcgtgttggatcaggggatcgcgctatggtttcccggcccccactcattcaccggggaagacgtgctggaattgcaggggcacggcggcccggtgattctggatctgctgctgaaacggattgtggcgctgccgggtctgcgcattgcccaaccgggtgaattctctgagcgtgcctttctgaacgacaaactcgatttagcgcaggcagaagccattgccgatctgattgatgccagctcagaacaggcggcacgatcggcggtcaactcactgcagggcgcattctctgtccgtattaatcatctggtggaagcactgactcatctgcgtatctatgttgaggcggcgattgatttccccgatgaggagatcgattttctgtctgacggtaaaatcgaagggcagctgaataaggtcatcagcgatcttgatgccgtgcgtgccgaagccaaacagggcagcctgttgcgcgaaggcatgaaggttgtcattgccggtcggccgaatgccggaaaatccagcctgcttaatgcgcttgccggacgtgaggcggccatcgtgaccgatatcgccggtacgacgcgcgatgtactgcgtgagcacattcatattgacggtatgccgttgcatatcattgataccgccgggttacgtgaagccagcgatgaagtggagcgtattggtattgaacgcgcctggcacgaaatcgaacaggccgacagagtgctgtttatggtcgatggcaccactactcacgcaaccgaaccggctgagatctggccagattttgtcgcacgcttgccgccccagttgccgattaccgtggtgcgcaataaagccgacatcaccggtgaaacactgggcctgacagaagtcgatggtcattcgcttatcaggctttcagccagaaccagcgaaggcctggacacattgcgcgaccatctcaaacagaccatgggctttgccgataatatggaaggtggcttcctggcacgccgtcgtcatctgcaggcactggagcgtgctgcgacgcatctggaacagggcaaatctcagctcttaggtgcctgggcaggcgagttgctggcagaggagttgcgccttgcgcagcaggcgctcagcgaaattaccggtgaatttacctcggacgatttgctgggacgcattttttcgagcttctgtatcggcaaatgatgtacagcacgtaacccgtcagcggcatggcaaaaacagaacgccgccgctcaggggataaaccgtaatgtgttgcttattcgttattgtggcgtaggttattattgttaaggatgctctgccccgcgttttttgctgtgcattgacggtcaaaaaacgtgataagacgggccggaatgcatccaaaaacctgaactcaccgtataggttgaatactggatgtcttccctggagagttataatgactacatcgcttgatgataacgcgctcaatacccttttttaccatgcccgcactcacaatcactggcagcaaaaacccgtggacccggccctgctggagcaactctatcagctcgttgccctggccccaacttctgcaaactgctcgccgggacgcttcgtttttgtcacctcagcggaggggaaagaaaagctgaaaccggcgctggcgtcaggcaaccttgagaaaaccatgaatgccccggtcaccgttattattgcctgggacagcgaattttatcagcacctgacgatgctgtttcaacatgccgatgcgcgtaactggtttaccaacacaccggatttagtcaaagagacggcctttcgtaacagtagcctgcaggcaggatattttattctggcagcgcgcgcgttggggctggatgccgggccgatgtcgggtttcgatccgttaaaagtgaacgaggccttttttgccgataccacctggcaggccaatctgttaattaatttgggctatggcatcccggataagcttcatccccgtttaccccgtctgagccttgagcaggcgtgccagttcgtctgatatccacgagcgttgcggtcgtttcgtagcgcccatccctgacggtttatgctgcctgccgtgcgggtgtcagcctgatgcttttctgaaaagcgaagggtttacggtatgccgaatgcggcagccagagaaagcgcttataatcctgctgatgattatctgaccattctcatggagcgacagatggctggtcattttgttcgttgggcaggcaaccccggccaacggctcgttgacatgacaatgacgcaggacgttatcgacagcgtgcgacacgtggcggataaacgtcgcgagcgctttctggcggcgcgcattatattgaagcagctcatgcaacgcgtttatggccttcatcatcttcctccgatagttaactgccataacggccgcccggccttcgtggaccccgatctcccggactttaatattgcctacgcagggaataccgttggcgtactgctggctgaagagcgcagtcaggttgggctggagattgatatcgtgcgggcgcacagtcgtcagacgcaggagcagatgatgcagggcttaagttcgggagaaatcacctggattaatgcccagcaagacgtgcctgaggcggtgacgcagatttggacgctacgtcgcagcgtgatgaaactccaggggggagatgaaacaggactgacgtcgctccagctgttacccggcgccggacgcctgcgttcaacgcttcataccgatctgcaaattctgtgtgatgccgagcccacgctggtgtggtcctgtgctttatcacctcagatacggcacttgcacttatgggaaataaccggcgacggccagtggtctgaactgcgtgatatcaccctggacaagccggatgccggtacgcagatgatacgtctgacgacgctgaatggacgcgcgctggccttatcctgaccgctgaggccagtcgccagcacgcgcaaagtcgtttatcgccgcttagtgtccgtcgataaacgcgattttaagcacaaacagtaatgcgacgatcaccacgcagggactgatttcacgccagcgccccgtgcccagcttcatcacacagtaagcaataaagcccagcgcgatgccttcggtgattgagaagctaaagggcatcattgctgccgtaacgaacgcagggacggcttccgtcagatcgtcccatttcacccgagacaggctggccgtcatcagtacgccaacgtagatcagcgcgcctgctgcggcataagccggaaccatggccgccagcggcgacaaaaacgtcaccagcaggaacagaagaccggtaaccactgccatcaggccggtacgaccgcctacggcgacgccagaggtactttcaatataggccgtaacggacgaggtgcccgccagcgcgccggtcacagagcttatactgtcgacatacagcgcctgcttcatccgtggaaaagtacccttttcatcggcgattccggctttatcggtaacaccaatgagcgtaccggacgagtcaaacagattgaccagcataaaagagaagataatgccggccatgccaacattaaatgcacctttaatatcgacctgaccgaccaccgaggtgatggaagggggcgcagagaatacgccaacaaacttaacgtcgcccagcatccagccaatcgccgtggtgacgatcatcgaaatcagcacggcggcgtgaatattgcgtgacgccagaatggcgataataaagaaacccaatgcgcccagcaggacatgatgtgagctgagattacccacagtgaccagcgtatccgggttcgccacaatgatgccggcgttttttagccccatcatcgcaataaataacccaatgccagcggtaatgccgacgcgcaggctgagcggaatgttggcgatcatccagtagcggacgcgcagcagcgtcaggatcaacagccccagcgccccccaaaagattgcgcccattcctacctgccatgagtagcccatggcccccacgacgacgaaagcaaaaaaggcattgaggcccatcgcgggtgccagcgccaccggcaggttagcgaacaggcccatcagaatgctaccgaacgcggcaatcagacaggtggtcacaaacaccgcctgggtattcatgcctgcgacacccaaaatctgtgggttaacaaagacgatgtagaccatggtcaaaaacgtggtaatgcctgcgatgacctcggtacgaaccgttgtaccatgttcctgcagcttaaatacgcgctgaaaaaggccgtgtttgttcatgccatttatccagaagaaaatttcaccggcgcgtatcctggcgattttgcccctgcaatacaatgatttttcgcaaccgattgccattatcgcaattcgacagggttacgttaaagtgtaagggcacccacataaaaggattgagtcagatgtcagcagaatgcgtctttttcgattgcgatggtaccctggtagacagtgaagtactgtgcacccgcgcttatgtcaccacgtttgcccgttacggtattacgctctccctgcaggagatgtttgaaaagtataaaggggtaaaactgtatgacattatccgcgatgtcgcggaatcgcaccggataaccttaccgctggaggaggttgaacctgcctaccgcagcgaagtggcgcgattatttgatcttgaactgaagccgatcgccggggcgaaggcgctggtggagcagatgaaggtgccggtgtgtgtggtatccaacggcacggtcaagaagatgcagcactcgctgggcttgaccggcatgctggactattttgccgatcatctttacagcggttacgacattggccactggaaacccgagccagaactcatgtttcacgccgcccggcacatgcaggtccctgttgaacgctgtattttggtggatgactctgaagcgggcgcgcaggccggtatcgccgccggcatgccggtgttctattactgtgccgatgcacataacccggcgcttgatcatccactggtcacggtgttcacggatatggccgcgttgcccgggctatggcgcgcccggggttggaatctgacaacatagccctcaggtcacccagtgccgtctgtctatccgactgagtatcatcgccaggagtaaactgcctgccagggtgacggtgaacacggcaggcagatccagccagggccgcgtcatatcgtcatagtggttggtgcggatgaaatgaataaacagcgcgtgaaaaccgtaaatgggcagcgagtaacgtgaaatcgtcgctaaaccgggcaaggttcgttgattaaaggcatttttgaacaccagcagggcgctgatagccgcaataaaaaccagcggtccgcagtagagataccaggtgtcgttaaacgcgccgttgacgattagcgcccgtttggtgccaagcataatgccggtcacgcaggccaggaaagccaccgccgcgagcgcagtcacgccgcgcctgtctgtttccatggttccgatagcccggcctaacagcgcgtagagcaggtagtaaatactgtctccgctcatatacaggttaatcggcaaccagtggaatcgtccccatgactgatccatggtattgggattcgccagcaccaccaaaaccaacaccagcaacgcgacgtagcgcggtcgtacgctttttacctgaatcagtggcgacagcaggtaaatgccgatcagcgcgaagaaaaaccacagatggtaaaacaccggcttctgcagcatttttaaaatcgagcgtccttcaccgatgggcgtcagcaggctgatatagaccagcgagacggcactgtaaaacagcaggcaccccacaagccgccataaatgacgtggctgcgcactgcgctccccaaagaacaggtagccggaaatcataaaaaacagcggcacacagatgcgcgacgtcgagttgaacaggttggcaacgtcccaccagtgaccttttatcgccatcggcccggccagataccaggtggtagtgtgaatgacgatgaccatcaggcaggcaatcgcccgcaaattatctatccagtaaatcttttgcgacatggtttcctctggcgcagtgcgtcccggtgcaaagcgtagccagtcgcgtcgcagtcaacaagcgcgttgacagggattcagaaccctctgtgcgcaagatcgcatgaaaaaagccaaacggcacaggttaatttcgccgttcagcggcgcttgggtgccgaacggcgtcctaaaatctacgtttggggctgcacggcaggatttccggctgcacatcgcgcggtcaaagggtatactgtcgcactctttttttatctagccgaaccgcgtgcgaactcatcatgcaaaagtttgataccaagacctttcagggcctgatcctgacattgcaagattactgggcgcgccagggctgcaccattgttcagccactggacatggaagtgggcgctggtacttcacacccaatgacctgcctgcgtgcacttggcccggagccgattgccgctgcctatgtgcagccgtcccgccgtcctaccgacggtcgctacggcgaaaacccgaatcgcttacagcactattaccagtttcaggtgatcatcaagccctcgccagacaacattcaggagctgtaccttgggtcgctgaaagagttgggtatggatccgactgtgcacgatattcgctttgtcgaagacaactgggaaaacccgacgctgggcgcctggggactcggctgggaagtgtggctgaacggcatggaagtgacgcagtttacctatttccagcaggtcggcggcctggagtgcaaaccggtgaccggcgagatcacatatggtctcgagcgccttgccatgtacattcaaggcgttgacagcgtttatgatctggtctggagcgacggtccgctaggcaaaacgacctacggcgacgtgttccaccagaacgaagtcgagcagtctacttacaacttcgaatacgccgatgtggattttctcttcacctgttttgaacagtatgagaaagaagcgcagcatttgctggcgctggaaaaaccgctgccactgcctgcttacgagcgcatcctgaaagccgcgcacagctttaacctgctggacgcgcgtaaagcgatctcggtgactgaacgtcagcgctacattctgcgtattcgcaccctgaccaaagccgtggctgaagcctattacgcttctcgtgaagcgctgggcttcccgatgtgcaataacaaaaagtaagaggcagccatgactgagaaaacgttcctggtggaaatcggcaccgaagagctgccaccgaaagcattacgtagcctggcggaagccttcgcggcgcaggttacggccgagctggatgcggccaatctgaaccatggcgaggtgctctggttcgccgcgccgcgtcgcctggcgctgaaaatcgcgaatctgagtgccgcccaacctgaccgtgaagttgaaaagcgcgggcctgcagtagccgcagcgtttgatgcagacggcaacgcgacgaaagccgcagaaggctgggcgcgcggtaatggcattacggttgatcaggctgaacgcctgagcaccgataaaggcgaatggctggtttatcgtgcccaggttaaaggtgaggccgctcaggcattactgccgggaatgattgccacggccctgagcaaactgcctgtgcctaaactgatgcgctggggtaacagcgacgtgcagtttgtgcgtccggtgcacaccgttaccatgctgctcggtgatgaactgatccccggtacgattctgggcattcagtcagaccgcgttattcgtggtcatcgctttatgggcgaaagtgaaatcacgctcgagaacgccgatcagtatccggatgtgcttgaaaagcgcggccaggtgattgccgactatcaggtccgcaaagccatgatcaaagccgatgcggaagccgcggcacgtcgtttaggcggcgtagccgacctgagtgacagcctgctggaagaggtaacgtcgctggtggaatggccggttgtattaactgccacctttgaggaaaaattcctcaaagtaccttctgaagcgctggtttacaccatgaagggcgatcagaaatacttcccggtttatgacgccgctggcaacctgctgccgaacttcatttttgtgaccaacattgagtccagcgatccgcagcagatcatttcaggtaatgaaaaggtcgttcgcccgcgtctggcggatgccgaatttttctttaataccgaccgcaaaaaacgccttgaagatcatctgccacgcctcgacaccgtgctgttccagaaagagctgggttcgctgcgtgacaaaactgaccgcattcaggctctggcaggctgggttgcggcgcagatgggggcggatgtgaaccacgcgacgcgcgcaggcttgctgtcgaagtgtgacctgatgaccaacatggtgtttgagtttaccgacacgcaaggcgtgatgggcatgcactatgcgcgtcatgacggcgaagccgaagatgttgccgtggcgctgaacgagcagtatcagccgcgatttgcgggggatgatttgccctccagcccggtagcctgcgcactggcgatcgccgataagatggacaccctggccggtattttcggcattggtcaacatcctaaaggcgataaagatccctttgcactgcgtcgtgccgcccttggcgtactgcgcattatcgtagagaaaaatctgccgctcgacctgcaaacgctgacggaagaagccgtgcgcctgtatggcagcaagctgagcaatgctaatgcggttaatgacgtcatcgacttcatgctggggcgcttccgcacctggtatcaggaagaaggtcacagcattgatacattgcaggcggtactggcacgtcgtccgacccgtccggcagactttgatgcacgcatgaaggcggtatcacacttccgtacgctggatgaggctgccgcactggccgctgccaacaagcgcgtctctaacattctggcgaaatcgaccgaaccgctgaatgacagcgtgcaggcgtcattgttgaaagagaacgaagaaatccagctggccacttttgttaccgccctgagcagcaaactgcagccttactttgcagaaggtcgctatcaggatgcgttaattgagctggcccaactgcgtgaagcagtagacaacttctttgacaaagtcatggtgaatgcagaagaccaggcggtgcggattaatcgtctgacgctgctgtcgaaactgcgcgaactgttcctgcaggtcgccgatatttcactgctgcagtaacccatgcgaagcgctaaaaaagggacgagaaatcgtccctttttttattcagtgtgtcccgtcctgaatagcgttgagatatctcaaatttgaagaacagttagtcatgcctgaatagcattgctgctgcggcaggagattttgtgccgtccgtcttttgaacgggcatccttttcacaacagagtgcaatagcagcacattttttctttcgtcagcgtcaagacggccatttttatccgcaacccgtttcagcacgcgttgcggagatcaccgcttgatgaatcaacctcgcccggcgttatcggccagatagcccgcaaagcgaacgcccgccttaaaatgtccaggtcacaccggaagagagcgtccagtaatactgttgatccgtcatcggactgtcgcgaagtgcgccagtgaggaaggtcactttgggttgcagataaatatgcaaaggcgtaacaggatgccagtcaaatgccaaagcaagccacggcgtaacgccctgatggttccaggaagataaaccgctgcgggcagattcctgtgcgttcacaccatagtaatagcttgcctgttgcttattaagccagtcaacgccgacctgtggataaacatctagctgcatgaaagagacctgtcccgcccatgcgaccgtccccagcactccccggctttcattcagcgtatcggcagacagttcggttctgaaggcacccacaggcgttattttctggtagctaatgccgcccatcatggtgctgtggcgaatacgtaactgccgcagcgccgaatcagatgactgaccgggatcgaattcgttatccagataccaccagcgcgctttgaattgtgtggtgtcatccttgatgaaatacgcaccaacttcggtgccatcaatgtagacatgattgttgtcatagcccacataaggcaggcctgaatattgggttttgtactggtgataaggcgtaaagttcgcttcgccctgtgcacccagggtcagcccctcagcccaggcgtgcgtgatattaccgaccaggaggcaacacaatgccgttctgaagagtgattgcatgatagatatttatccggttttcgtctgcctgaggcgatggactgtcaggtctcacagcccgtaaaaggaatgcgcgtaaataacaacattcagcctgctttgtgtcgccttttcccctgatttgcggcctgcgcgtgccgttcaggctcaggaaaaggcgatggcaaaagatatatcggactcgatgccgcaatgcaagatatggcgatacttattgtcacggggttatcgtccgcttattttcgccattacgggttattaacgggctgcggtgactcaacatcaacctgttctcaatcagttctgatttaagcgactattaccctttcgtttattgtgggaatgtcgtgttttttgttaaggtcctgctccgccagatagccgttaattaccgttactttgccgtgagttaatcacgtcttttgttatctgtagtaaagctgaaaaaacggtgtctggcgtaaatagcctgttttatttcgaatgaaaaagggctgaatactatcgggctcacagcatttttcttgaaaggatcacgctgtcagtcgcagagaatgaacaggacgcgcgcgtctgtatagaggctatgcgccgcctgccttgttatatcaggacagttttatgaagaagattattatttccactcttttcctcgccttactgagtgatgcggtgccagcactggcgacgcaaaccctgtcagtaggctatgcgcagagtaaagcggaagattttaaaaatatgcccggtgtaaatctgcaatatcgctatgagtgggattcaccggttagcgtgcttgcttctttcaccacgctggagaacagtgaagacagcaaccgttcttttttctcgctaaatacgtccgatcatgtcagcgcagaatattattctttgctggcgggcccggcatatcgcctgaataacatggtgagtctttacgcgcttgcgggtttttcccataccgccatgcgccgtcattataacggttatgataatcagggaatgcctcagcatattgatttttcagacagcactaatgcgtttgcttacggtgccggcattatcattaatccggttgattatctgtctgttacgctgggttatgaaggttcccgaacccgggttgaagatgagccgcgcgcagttaatggtattaacatcggtgtgggttaccgtttctgattacacctttagtccgacggccagcactgcaagccagctgtgcatcgcatcatgcgcgaactgcaccttatgccattcagaagacgggtaatgcagaaaatgcgcactgtgtaatcctttcgaaacaggctgtcagccctgctagcggcatcagggctgatcatctgcctcgcccatcaggatgtgggtggcgcagtacgggcgaaactttcgcgctgaaacagattttctgccagtttgactaaggccgggcgttcaacacaccagtttggcacgacgcgacgaaaattcagatagccaatcatgcagcccgtggcaatatctgccaggttaagcgtgccattgttaatccattttccttccgtcacgtagccttccaggctgtccagcccacgctgaatcttctcgcgatggcgcagcaaaacctcttctgactgcatatcgccaggccgcaactgctcacgcacaatcaccagcgccgcatcactgatgccatcagccagcttctctaactgacgaaccttcagtgactcaagtgggtcacccggcagcagagcaggaacctggctgcgctgttccaggtactcagcaatgatgctggaatcaaaccaggtctgctgatcctcagtaaccagcgcagggactttccctaacggattgtattgcggaacgtggctgtcgtcgctatagggcgaagcattgacgaattcaaacatcatgcctttttccagcataatgatggagatctttcgtacaaaagggctggtatagctgccaatcagtttcattgcgtgactccggttgagcggggtttcttcagcaaaaaactattcaccgggaaacataaagggattcagactgcttcgtgcaaagccttcctgctccatgcgggcatccagcaccaatgaggcgagatcgtccgcaacgggttccattgccgggttcttctcctgatacaacattttcaggtagctaccgcaatcaccacagctttcagctttaaccgccgcatgttcactgtccagcgaccagtagtgaagatcgcgggattgctcacagttggtgcatttgctccgcaccacgtaccactcactttcgcacaggttgcaatgcaggtaacgcgccccttcatgtgagcccatgtgcaccatgctggcaaccggcatgctgttgcacaccgggcagaactggcgctggttgcccatctccgcctgagctttgccgggaatgaaggccgccatttgcgcccagtagatcgacagtgcagcccagataaagggcgctttgtcactgctgacctgagcatattcgcccgcaaagagcgcgctggccatcgtttccagctcagtggcagaggctttttccaggttctccagtaccgccagtgcctggccgctcatctcgggcttgagctcggcaatcagcgaatgcagcaggcggtgccagtgcgtgtcccgcggtaaggtatgaatatccagtggcggcttagcttcctgattgctttgcaccagacgcgcgtgcagattcatctgcaggggatggtcgtacaggacaatttcctgtgcctgtgctatcaccgcggcaaagcgtaaataatccccaaggggatttttagcagccaggtcgcgcagtcgcgcagcacgacggctatataaatttttcagccggggaaaaagtaacggcggaatcgtctccgctgggtttttttcgctcttctccaactgatcttgcgggataatgcggatgctcatagagggcattttcctgttttgttggctgattacgctactcacgacaccagcaagaatagggttctcggtactcacgcgcgccatattgacgtgcgctcttgcccgtttgctctttctgttctcgcagcttgtcacgccggctgctgacatcaaagcaatcatatttgtgagtcaggagactgcggcacggctggatgccacgatccgacccgacaggctgatcatagcagcccaaatcctgtccttctgtgtgaaatgcattttttccctgactgactgcgcgtgaaccggatgattgaacatcgacttgcataacggatgccaggccatcagggagcaatttcacgctttatgctctcggggtgacatgcgcttgttgccgcctttgacccggttcagaataggcactattcaggatagcggaatactattaccttttaatccatgcggaattagccaggatcagaacaaagtgaatcaaaacaaagcgagatgtgatgctggtgtaagcgagctggctggtctgcgtgaaactcaggtgtggcaacgtgacgatttacaccattcccaggctgactggttagcagaagaggtgccggtggcgctggtttacaatggcatttctcacgtcgtgatgatgacgacgcccaaagacctggaggcttttgccatcggtttttctctctcagagggcattattgacgcgccgacagatatcttcggtatggatgtcgtcgcgggttgcaatggtattgaggtgcagattgagctatccagccgccgttttatggcgttgaaggcgcatcggcgcgctctggcagggcgaacgggctgcggcgtttgtggcgtggagcaactggaccagattggtaagccgcttacgccgctgccgttcactcagcgcttcacgttagcgcacctggaccgcgcgctggggcaactgaagcattttcagcccgtggggcaaaaaacgggctgcactcatgctgccgcctggatacagcctgaaggtgagcttgttcacggctgcgaagatgtgggccgtcatgtcgcgctcgacaagctgttgggttatcgcagtcaggccacgtggggcgacggtgctctgctggtttccagccgcgccagctatgaaatggtgcagaaatcagccatgtgtggcgttgaaattctgtttgccgtttccgcagcaacccgactggccgtagaggttgcagaacgctgtaaccttaccctggtggggttcagtaagccgggccgtgcaaccatttacagccatccacagcggctcatgtaaatcctgttctgtgcagttgcgttgcgcgcagaaccaatgagtgcggcgacacgcgcctgctgatcagccgccgcatcggccattttgcgggcagcataaaacttaaaattgcgcagtctttgcatgttttttcaaaaccttatgtttaatagggcattgattacgcttttaccgatcatgaatttaactataatgatacgactgcttacgcggcacgtgccgatattgtcgtgctgctcaaacactaaatggagaggaagaacatgagttattcactgccatccctgccttacgcttacgacgcactggaaccgcactttgacaagcagacgatggaaatccatcacaccaaacatcatcagacctatgtcaacaacgccaatgcggcgctggaaggcactgaatttgctgatctgcctgttgatgaactgatcacgaaactggatcagctgccagcagacaaaaaaggcccactgcgtaataacgcaggtggtcatgctaaccacagtctgttctggaaaggcctgaaaacgggcacaacgcttcagggtgagctgaaggcggcgattgagaaagattttggtagcgttgaaaaattccaggaagagtttgagaaagcggcggcaacccgtttcggttctggttgggcctggctggttaaaaaaggtgacaaactggccgtggtttcgaccgctaaccaggacaacccactgatgggtgaggctatcgctggcgtttcaggttatccgatcatcggtctggatgtgtgggaacacgcatactacctgaagtaccaaaacaagcgtccagattacattaaagcattctggaacgtggttaactgggacgaagcggcagcccgctttgcctccgctaagtaagcgataaccacacgagtctcaaccggcagaatctgttctgccggttttttttcgcctgaacgtcacgttttctctcttcgccgttggcatgatgccactacgattgccgattgccgattgccgattgccggtgcagttttccgttgcaggcgggctgcctgcaaatcgccgcaatagaaaagtcccttgcgataaatcagttaaaccatttttaaacgaagcgtaagttgaccccgttaagtttttaacaatttgagtcattaacctgtcgttgatgccggtcgttttatcatcaatgccacgatcagactaataagaacttacaccatgtccatttacactacacacgatccggttgccgattcgtatacctctttattttttcaattaatcagcggaaagtacgtacccaataaaatctggctgagtcgtcgttttcgtctcaaatttgccttaaggacgctgattgcacccattaccacgttgcgctatttacagcagctctctgagttacccagaatttcgcaattaatgcgcgtacagggtttattacccgctaagttacatcgcccttatctgcacgccggaatgcgcgtagcagcacgtgcgcaggctattcttgatcactaccatttgctgagtaatctggaaaacatgtcactccgtcagatcctgcaaagcggtgaagagaatgttctggccagactgtcgggcaaaaataacgaagaattcgtcattgcctgtagtgcgggctattacgatcgcgagggggaagtaaccttagtgctgcgttatcaggatgaaggcattgcgtctctgacatttacgatcttaaatgaggaaaacgcacggactttattaatcggtggtttacagggaccgcgtaaaagcatcagtaatgatgttattcgcgatgcaaccaaagcggcgcatggcttatttcctaaacgcttactgatggaagtcgtgtttattttagcgcagcaatgcggcgtccgaaaaatagcagcggtaggagataagacgcatgtttttcgtagcctgcgttatcgccagagtaaaggggataaattccatgccagctacagtgaattttggctgacggttaacgggcaagaacgtgcagatggcatctttatactgccgctgacgttgccgcgtaaaacgctggaggacattgccagcaagaagcgtgcagagtaccgtcgtcgttatacgctgctggattcgctggcagagcaggtagggactgctactggccagcaaaatagcgaacaggccgccgcctgaccccgatattaaaaggcgcttttcgcaaatccggtcatgacgtcaagacccatttctcgtcccagcgcggtcattggatgtaccaccaccaggccgcgcacgcttttcttcaatgcgcctaaatttgcctgctcttttttggtaatcgcccggctaaacggtagcttttgcagtttctgcgcttccagactcagtttaacctcgcgctgactgcgaagacgctcgatttcagtcaccagcgtttctttctctttcagtagcgcacccagcttttcagcatcaccggattctagcaactgaggttctttacgattcagggcgtccagttgatcgctgaggcgtttaatttcgttcttttcttgctctttcatgacaacaactcgttgaggaaaacaggctaaggatacaccaaatttaacgtagattctcggtggttagcgcgaaaaggggagccgtcagactcccggcaggatttagctggctgacttcttaaaagcctgtttcaggctgatgcgggaaatcagttcggtgagtgacaggaccatggtggagcgcaccatttgcagataacgctgctgctgcatagcctgcagtgcagcatcctcagcatgtaacgcgggcaccggcggccaggccgctacgcagtgtaactcaccaaacggccccaggatttcatcgtcggtaaagcggtaatcgcctgcatcgtgattgagctcttcgcgcagggccagaagtaactcgcagtcttcatattcatgccggctaataacgccaaggccataaatcagcttgagccggacagagagttcccctaacggaccatcgcccagcaacaggggctccacggcgtatttcaccgcgtagtcatctttacggaatacctgcagtaccagcaaattgacagcttcagctaacagctcgacggcggcgaacaaaaagcttctcaccgagcgtccagcgttcaggcgttcaagcacccggttttcaaaagcctgcttctcttccattattgcctgcgtcaatgtagtgctgctgtcgagggcccgttcatcgcccccgatctgggtcgctaacatgggcctgttatgccatggcgtgccaggcactcacggcctctttgataatttcactctcaggatcgagtcctgaaacctgcgccagggtcgcctgtgggcctttttctgccagtagcgtagccagttcctgtgcctggggatcctgatcgctgtggtaatgcatggcagccgcaatcccctgcaccaggttcgcgtgtggcagaccgtattccagcgtccccagggtcggtttaatcaggcgatcgcccgcgctcagcttgcgaagtggctggcggcctacgcgctcaacgtcgtctttcagatacggattttcaaagcgaccaagaattttttgaatataggcagcatgtttatccgcttcaaaaccataacgtctgatgagcaccgcgccgctttcttccatcgcaccctgaacgacagcacgaattttaccatcgaggatcgcatcgcgaatagtctggtgacccgccaactgccccaggtaggccgtaatagcatgaccagtattcagtgtgaaaagtttacgttccacaaatgccatcaggttatctgtcagttccatgcccggaatagtaggcagctcgcctttaaactgggttttatccacaatccattcgctgaaggtttcgaccgtgacttccagcggatcctggctgcctgcttctgaaggcggaacgatacggtctaccgctgaatccacaaagccgacatgttgttcaagccagacatgatactcagagggcagcgcttgcagtacatgttgttttaactgactggtgccgcgcaccatgttttcacaggcgataatatttaacggccgaacattgccgttatcactgcgtttggccagaccttttgccacgctggcagcaatacgctcaaggatttgcggaccaacggcagtggtaacgagatcgacgtcagcgaccaattcgataatctcgtcgctggtactgttaacggcgctaacgcccttaaccacttcaactttggcctgttcacccacgacgtggacgggatattcatgacgtgcattaagggcatccagcactgcctgattgacatctgcaaaaatcagttcaataccggcatctgccaggagtttgccaataaaaccgcgaccaatgttgcctgctccgaaatgtaacgctttcataaaattgacccatatcaaatgacgatggggcgggcatgtccgccccaaaaaagtgggacgggcacaaccgccccagggaaaatgtcgaaccggattatgctacagcgggcttgcctgataacagatccagaacatcctgtacgctctcagtgtgtgccagtttttcaatgacctgatcatcatccagcgcgttcgtcaggctggtgatcacctgaatatgttcgttattgcgggcagcaataccaatcaccagacgcgccacttcatcaggttcctcgccaaactgtacgccggcaggatactgacagaaaaccacgcccgttttcagtacacgatctttcgcttcaacggtaccgtgtggcacggcaatcgactcgccaagataagtcggggtcagcttttcgcgttccagcatggcatcaatgtattcaggttctacgtagccgcctttgaccaactgctcaccggcgaagcgaatcgcctgctctttattgctggcactcagtcccaggaaaacgttgctgtgaccgagcttaaacaggttggcatggctgttatcgtagctgtcacccagcgtcttctgtacggcttcacggttggcttcactgcgattagccgcgaccaggcgctctgtcagcgtgctgtagagcgcactgtccaggaagttgtttaaggaaatatgctgagcatgaggtgcctgacggatagcccgctcagttaaatcgcgatgggtaatcaccaaatcaacatcgcccggtaacgcattaatggcgctgttggtcaccgagatattactcagcccggcatcatggactttcttacgcagcacacctgcgcccattgcactcgaccccatgcccgcatcgcaggcgacaatgattttgcgcacatggtccaggtcaacgctcatcgcatcactggcaaccggggcacctgccagactctgtcctttcgactgcgctttcatgtcgtgcatacgttgcgtcgcggcttcgatatcgtcatcttctttcactttgctcgttttcaacaaaatggcagaaataacaaaagacacggcaaaagcagcaaagatggcagcaatattggcgaagtaagcgccttttggcgtcatcgctaataccgctaaaattgaaccgggtgaagcaggcgagaccaggccaccatgcagcacggttaaggtgaatacgccggtcataccgcccaggatcaccgccagcagcaggcgcggtgccatcagcacataagggaagtagatttcgtggataccgccaaggaagtggataatcgctgcaccgccagcagactgcttagcactgccccgaccaaagaacatataggccatcagtacgcccatacccggacctgggtttgcttcgatcaggaagaaaatcgatttgcctgcttcgctcgcctgctgaatacccagcggcgagaaaatgccgtggttaatcgcattgttgaggaacaggatttttgcgggttcaacaaagatcgacgtcaatggcagcaggttgttctgcaccatcaggttaacgcccgtggcaagaatgtgtgacaggccttcaaccagtggaccaatcgccataaatgccaggatggctaacaacataccgatgataccggcagagaagttgttcaccagcatttcaaagccgcttttgattttaccgtcaaccatacggtcaaaggatttaatcgcccagccgccaagcggacccgcaatcattgagccgaggaacattggcatatcggcaccgacaatcacgcccatggttgtgattgcgcctactacaccaccgcgatcgccaccgactaaacgtccgccggtaaagccgatcagtaatggcagcaggtaggtgatcatcggggcgaccagcttcgccagcgttgcgttaggaatccagcctgttggaataaacagcgcggtgataataccccaggcgataaatgcgccaatattaggcatcaccatattactcaaaaagcgaccaaagctttgtactttgacctttactgatgaggacataagcccaccccttgttgagacgcgctgcaacaggagcgcgcgtttgtttttgtttagccactacggcgataaaccgtcagtattactgtatgcaggcggactttatcacgcgaatatggggctgcgtagtacaggcagtttgatgtgatcttaatcacgtttatggtggggtggtagggggatttttagtgatacatatcacaaaaacgggctgtttccggcctggactgaacaaatttacaccgctaacaatgtattttagtgatgctcatcacatttatagtccgtggctttgtttgataaatgagatatagatcacaaagtaatttgatgaaaaacggccctgatcacactttgatcagggccgtttaaataaatgatctttattaaatgatgttcagatcagccaggcagaacagaggttgccggagcgatgtttattgcacattcccctgaacggcatttttagcctgcgtcagcgcctgcacattggcagataagctgttcatcaggtcattatattgtgttgcctgctcctgagtcgggaactgaacgccaccgttattgaaactgactcgggtgccctgagcctgtaaaaactcaccggtctgcaccgcatcctggctgagtgcctgaagtttgggtaacagcgggataagctgactggcgggctgcgacacgactttatcgtaagcggtgtcgaagactttcttcagatcgtccgtttgtttaagcgcggctttgcttttatctgcctgcattttggcgctttccagctgctgcgtggctaccgttaatgcgctgttagcctgagcaagagagtcgcggcggctcagatagtcttgcggcacgtggatcgctgaaagttcatccactaccgggcgcatgccctgatctaccgctttgttagcctgctgcgagaagccatacagaatggcgtaatcccctgcgaaaggaccaaaactttgtttctggttttcgctcaggctgggcagatgctcgccgctacgcataacggtattttgcaggaaatcgataaacgctttgcgctggtcgccctctttgtcaccacatgcggtgagctgcaatacgagaagcacgccagtcagcaaaatgccgccgcgtgccagaatacgggaaattcctgaagccatgatgtcaactcctgtcggtaaagctggctgatgtccggaaaagcagtggcctaaagaatagaacaaacgtgaactgccacacaatgtgaaagcgctgtgtaaggccattacctgcaagaaagtttgcttgcagcgggtttataaggccatttgagacttcaggcacccgaggccgggagctgaataaggataacagggcctttacgccgcgacgaagacgggctgctgaatggactggcgcgccagcattgcgtggagcacctgcaaactgagccggaatgggccataaatacatggtctgaataattaacaccagcttaagttttaaagcgaagcacgcgcgcggtgtggtgcattaccgttaaatcttcattaacgagttgccctaaaattgttcacttgcattaaagtggtgcgggttgtgccatgtgcttgcgtctggcatgaacggcacaaattatcttagccgctataatcgtaacgtcacattgccctccgaagatagtgttgatcacccattcagcgcggctcttgctcgcactatcaggcccggtaagcgtttgctcagtatcagtgggcgagatcgaagatggctggcagtgaactgccgcatttctttgtataaaaaatgaaagcctggcgcatattttgcaaccattatgagtgacaggcacggttttcggtgtgcgttgagtcggaaaaggttggcaaggacaaaaaagcgatctgtacttttcatgtaccgcgtggcaacaaaatcaatggcttcaactggttaggttgtttaaccatttttcagaattgtaaagttaaaaaaaatgtttaatttgcactgcaaattgtcaggtatctatccataattagtctcccggcatttgttgcattgttttgacatgtttaacagcgatgcaggtcaggctgtgtcccataagggttttcttacaataaaaacaaactcttaagggatgcagcttgcttaatccggtttctgagcctgatttcaggttcatgtaccttctttcacgtgattcatagtgagtttttaaggagttctctatggaattaaaagacccaatgtttgaattgctcagcagccttgagcagattgttttgacacgtgataacagccctgtggcgctgcaagctcagcgtcaacccgcgatgccagagccgcagcgtttacgcgaaatggcaggaatgcaggttgacgaatttgccaggatcatgggcgttagcgtttcttcggttaaaagttgggaagcacagcgtacgcgcccttccgcaacggcacggaaattgatgaaattacttcacgccaatccttaccttgggcgtcagttactcgattaagtcattaagtattaaagcgttatcccggctattgttgaagccggtcacatgagtgaccggctgtttgacacctcttcccgataacgcttcccttcaaaataacgctcaggcctgccggacaatcagctcaacttgggtaaaacgttgagaacattgccaaaccagcaaacaataaccacgacaccaaataaaataacaaacacgggaattaccttgccgccccagacggtgaacgttttgtcgggaaagcgttttctggctttcaatgccagcagcgcagggacaatcactgcccatatggttgcgcataatcccgcaccaccgatgccgtagagaaagccgtcagggtagaacacatacaggatgctgggaggaagaaaggtcagcagtaccgttttaaagcgccctgcatgggaattgtcgatgttgaacaggtcagccagataatcgaataaccccagcgtcacgccaaagaaagagcttgctaccgcaaggttagaaaaaaccagcaggaagaattctatcaggctaccgggatgggttcccataaaggatttcaccagcacgtcaacatttccgcccgaggcaataatccccttaaagttttcacgcgggatatttcccattgtgcaatacagccagaaaaggtaaataagcagcgccagcaatgaacccaaaacaatacttttaaccagtttatcttttttctttccataacaaataatcaggctgggaatatttccatggaaaccaaatgaagccaggcagacaggtattgccataaatatatatgggaagtaacggttgttttcactgatgccgcgcacatcccgcagaagggacatatcgactttaaaaaatagtgaaccaaagacaatcacaaaggctaaaattttaatacctaaaaatagcgaagtgattctgctggcggccagtgaacttatccataatacacaggcaacgaaaaccgctgttcctaaaccaatcaattctgactttatattgatactggaatgcatcgaaagcgtttcgctgataattgcaccgttagcggagatataagcatatgtcagtatatacagcacaaaggcgacggtaataccgctgatgatattccacgttttacccaatagatctttggttaacgtgttgaaactcgaacctacgggatagtttaagttagcttccagtaacaataaaccggaatgaagcattgaaaaccaggcgatgattaagataaatgcgccccagaagaaccaggcacctgcgagatcgacagggagtgcaaacatcccaccaccgattaccgttcctgctataaccattacgccccagaaggaggaatgtttctgatctgtattgtcttccatggtgtcctctcaatacgcttttttacttttatcatttttataatttttcaggttgaccagcagagtgacggagcagctgttgccagacagctgctcactgtacaggtatgactattagatctctttaagttttgcggtgaagtggcgcaaaactttaggctcataggtaaacgctaagccttttatgttcgcggcattctctttcacatgcccaaatgcttcaataatgaagtccatatgcgtttgtgtgtaggtggctcggggaatggttaaacgcagcagttctgccgggcagggcaactgttcaccggttttcggatcacggccgagtaaaaacgatccgatctctactgccctgataccggccactttatacagttcgcaggcaagagcctgagcggggaagtgatccgccggtatgtgcggcaataattttccagcatcgacaaaggcggcatgaccaccggcttgttggcaggtcacgccaattgattcaagaccatcgaccagatactgaatctgactgatgcgataagccagccagtcctgattcatgccgtcatacaggccaaccgccaggcgttccattgccccaccttctaagccaccataggtggggaagccttcctgaaccacgcaaagcgttctgcaatcggtgtacacgtcaaagaagctgtcgtctttaaatgagagtaagccgcccatcggtaccatggcatcttttttggccgacatggccagcatgtcagcatatttataggtttctcgggtgatcgcttcaattgtccagtttttatagggtttttcccgttgctggataaaataggcgttttcagcaaagcgtgctgaatccatgacaacgggaatgtcatatttttgtgcaatctggtacatggcttttaaatttgccagcgatacaggctgtccacccgcggaattacaggtaatcgtggcaacaatgtagggcacattattcgcccccacgtcctgtatacccttttccagactttcaaggtcaaagtcgcctttgaagtcatggcgaaccgtcgtatcgaaagcttctttgatataaacattccttacggtacaaccatttatctggctgtggccttgggtggtatcgaaaaagtagttagaaaaggccaccattttgtttcggtccaggcctttttcttgttcgcgtttctttattaaaaccgggatataaatttgttctgcaccgcgcccctgatgcgtaggaatcgtataggcatagccaaaaatcgcttttaccgcttcagccagggcgtaataactgcggctgccactataggattcatcgccccgcatcatcgcagcctgcatattttgcgttacggctccggtgccgctatcggtgagcaaatcgataaaaacgtcttcgctgtccagcagaaatggattcattccggctttgataattgctgtgtcccggtgttcacgcgtggtacgtttgacaggctcaatcacccgaatgcgaaatggctcaggtaaatgtctaaagttattcataatgatgtcctttaaggcagacatgtcgaggccatagtttttaaccgaattaataaaaaccaggtcgaatgctgttattactgtatttcagccgataaaaggtcgtgactgcattacgtgcaacgttgcgttttcaatgccctgatcggcaaataaacggacgtcatcgacgaggcagtttttttaatgactgaatgattgaaaatacacccgataaatcacggccatatcagccggaacagaagggtgaagaaagcaaggggacgttaaggcaggtggttgacaatgatattatcaatgttaaaccattttgaaattacacaggtgctgtttaagatgatcataatatttcaactctcattaaacatagcgctaccctattatattgattgggtatgtccagggttactttaaattatcgtgattggtatcacagtaaaatctcttttcgccatgacgattatttatttatgatattaaaaatactgttttttgacagttttccagccaataaattacatttttttggattcaatccttcttaacatttctgttttacagagacatattgaggcagcgtgaaagcctcatggtttgcccttaggcacgaaagccataccgcgcccgtcggcgcgctttaagccgtataaccggctactcatttccaggctaaggtacgccgttggcatcaatgaatcagcgcatggcgaggatggcgttagcttaatccaccgtatttggccgcttgtttaacaaaccatttttcaggcacgttatagggcgcatcggccagttgagcaataccactttcaatgttggcggaagcctggcgccagagttctgcgttgccctgcttaagcaattcaatttgcacctttttttcaatcagataaacgcgggcaaaatggggatcgaagcgaacaatagagcgcgtattgtcaatgatgtcagccagcttgatggtttgtgcgtcagggctggcctgcgcagtatggcgaaaatgagccattttacgttctgtacgattccctgcactttgcggtgcggtattggtcagcatttcaaccagctttgcgacctcattaccgaagtgattttcgatatcgctaagtgtcgtcgtcgtatcttccacggtatcgtgtagccaggccgcagccagcaagacgggattatccgtaatgcttctgaccagttccacaacggctgcaggatggacgatataaggttcgtcggtgtatttacggcgttggcccgctgctgcatgggcttgcgtggcatagcgtcgcgcctgttcttccagagaatcctgcatgcactacctcgttttcataaattgcttgcaattaactagtgcgctatttatattgcgtccatgaacagtaataaagatgacaaaaaagtgaaagctgcgccactgttgctcgatcagcaactttgctttgcactgtattccgccaatctggcgatgcataaagtgtatcgtaagttacttacgcagatggatattacctatccgcaatatctggtgatgctggtattgtggcaacaggattcacttaccgtttctgagattggtgaacgcctctttctggattcagcgacattaacgccgctgttaaaacgtctggaaaatgcgggcttactcaatcgccagcgctcccgtcaggatgagcgtcaggtggtcgtcagcttaacggataccggacgtcttttgcgtcagcaggctgagaggattcccgatgaaatccagtgtgcctctgattgcagtgaggatgagatggcggcgcttaaactgcagttgaaccagttacgtgacaaactgatggtgccgcgctaaattttatctggatgtatgaaataagtcagacttcgcagctcgactgctgaccaataagtagcgagcgattaaatagtacaatggagataagatatgtctttagaacaagtggtttaccgtgcaaaagctaaagctaccggtggtcgtgatggtcgtgcaacctcatctgacggcgttctggatgtcaaactgggcgtaccaaaagagatgggcggtgcaggtggtgaagtcactaacccagagcagctttttgcagcgggctactcagcttgcttcctgggcgcaatgaagtttgttgctggccgcgacaaaattgcgatgccaaaagacgcatggattgaaggcgaagtcggtattggtccaatccctaatggttttggcattgaggcgacgctgaatattcacctgcctgagatggacgaagcagaagcacagaaactggttgatgctgctcatatcgtttgcccatactcaaatgcgacacgtaacaacatcgacgtaacgctgaatatccttcgctaaatgattaagggcctgaacaccggcccttttttcttttcacccacgctgttaattgcccctgctccagactattttctggcctaaatggatgtcacatgcttaactgtgccacttcgcgtgatgacgtgtaaaaacgttcagaatattcttctttatttaaccggcccgcttaattcgcgaactctgccgaaatatggcagtcagattaacgtttagttaagcgcttcgttccggggaaacaccatttttcatgaattatataaaatcattaacacagcaaaagctgtcgctcttgctggctctgtatctcggtatcctgctgaatttgccgatcttttaccgtcgttttgatggctttctgacgaaatcaaccgtgacaaactggctgaccgcctttaccgaggtcgtagcaattgtgttactgacgtttttcctgatgcgactgttatcattgggcggaaagtggctgtaccgtgttcttgcgaccttaattgtattgatttccgtcgctgccggttattacatggcctttttcaatgtggtcattggctacggcattgtggcatcagtcatgacgacggataccgatctgtctaaagaagtcgtgggttatcactttatcctgtggatggtgctggtcagcgcgctgccgctgtttatgatttggcgtaacaacctcagcatgacgctgaatgagcaactgcgcacgcctgggcagcgactaaaacccgttttacttttgctggcctgcgtcgcgttggtgtggttacccatccgttacttcgacaagttgcaaaaaaccaacgaggaagtgaccaatatcgacctgccgagctatggcggtattgtggcgcactcttatttgccgtctaactggctggctgcactgggtctgtttacctggacgaaggttgacgagacgctggaaaatcacgaactgttggaccctgcgcagaaatttacctatgttgcaccgccggggttagatgatacctatgtggtgtttgtcattggtgaaaccacgcgctgggatcacatgggcatgttgggttatgagcgcaataccacacctaagctgtcgaaagagaaaaacctggtcgcgtttcgtggtgaatcttgtgataccgcgaccaaactgtctttgcgttgtatgttcgtgcgtgaaggcggtaccatggacaaccctggccgtaccctgaaagagcaaaatgttttcgcggtgatgaaagagctgggctttacctctgagctgttcgcgatgcaaagtgaggtttggttctacgataatatcaatgcgaataacttctccttccgcgagcaaattggttcagagccacgcaatcagggtaaatcagtggatgatatgctgctggtcccggagttgcaggcatcactccagcgctatcccaagggtaaacacctggtggttttgcacaccaaaggctcacattacctttactcgcaacgctatccgcgcagttttgcgcgttatcagcctgaatgtatgggcgtcgatgaaacctgtagcaaagcacagctgattaatgcctacgataattcggttctctatgtcgacagtatgctggacagtgtgttggatcagctgcgtgataagaaagcgatcgtgttctatgcgtctgaccatggtgagtcgatcagcgataatatgcatctgcatggtacaccgcgtgaaatggcaccgccggagcagttccgtgttcccatgatggtgtgggcatcggataaatatctggctgacccgaccaaccgcgacaacttcgagcgtctgcaggcgcaacagcgcacgggtaaaacccatcgtcatgtcgagttgtttgatacgatcatgggctgcctgggttatacctccccagatggtggtattaaggcggccaataactggtgccaggcacccgccggaacaaccgctaaaccgctgtagtggcgtagcgatgcagcacggaacggggaaaagccgctgaccgcctgctttccaggcgatcaggcgcgaaagcgcaaaaagcggttgacgcttcccaggggtagcagtaacatgcgcccccatcggcgagtagcgcagcttggtagcgcaactggtttgggaccagtgggtcggaggttcgaatcctctctcgccgaccatatttaagaaacctgtctgaaaagacaggttttttttcgcctgaataaaatgaggatgagaacctccgaaggaggtttgcgccgagcgaagcgagacgacgttgcgaatgcaacggcccgaagggcgcgtcccgcaggggcgcgtaatcctctctcgccgaccatatttaagaaacctgtctgaaaagacaggttttttttcgcctgtgtaaaatgaggatgagaacctccaaaggaggtttgcgccgagcgaagcgagacaacgttgcgaaggcaacggcccgaagggcgcgtaatcctctctcgccgaccatatttaagaaacctgtctgaaaagacaggttttttttcgcctgaataaaatgaggatgagcacctccgaaggccgtttgcgccgggcgaagcgagacaacgttgcgaaggcaacggcctgcgcctcatcccatccctttagtaaaccgacccaggcaacgccaccgatagcggggtttttgcctgcgcgagcagctaatcggcctggcaaaaggcgttcatctcaacacaggcagggtgaaaaacgcttttcaggctttattgccccgctctgctattagaatatctcatgccagatttttccaaaaaaccaataattcttccttgaaatcaattttaccgacagacagccgtttttcggcttcatcccgacacaggccttctcgcctgagggatgtcggcggatcaaagataagttttggttatgccacaaaaagaataattgttaatttttcactcaaaaatgacagcatttttcgctagatgaacgtcataacgcacgggtaatcgttcagatatccaacatttggcgctaaatgatgcacgattttttttagcgcgaatcactactgtctgccgcctctcacagcagaatagatggcgaataaacccgtcccgctatgcaatgtatggcataacgtcagtaagggttttttttatcgttgcttgctattcctcacactctgtgtaaataactaaccgttgtattgacgttctttgcaactgttgacaaattgatgcgtcaataacagtgcagatacagatttttctgatgggtacttatcaatcagcattatcaaaagaaaactatctcactcttatcacacccgcagggtggaccgcctgaaccgcataaaaaaaccagaggtcaggcaatgcacacaacaacacatcacaatggagcaaaagcatgatcaactccctggctaaatccaggatgctgaaggtcggtctgagcctgatagccatgaccatagccgcaagtgttcaagcgaaaaccctggtttattgttctgaaggttctccggaagggttcaacccgcaactctttacctctggtacgacatacgatgccagctctgtgcctatctataaccgtctggttgaattcaaaaccggtaccaccgaactggtgccgggcctggcagaaaagtgggacgtgagcgctgacggcaaaacctacaccttccatttacgcaatggcgtgaaatggcaaaccactaaagattttaagcctacgcgtgaattcaatgctgatgacgtggtgttctctttcgagcgccagttagataaaagcaacaagtaccacaatgtctctggcggcagctatgagtactttgaaggtatggatatgccgaagctgatcagcaaaatcgaaaaagtggacgatcacacggtacgctttgtgctgacgcgccctgaagcgcctttcctggccgatctgggtatggatttcgcttccatcctgtccaaagaatatgccgacaacatgctgaaggccggtacgccagagaaagttgacctgaaccctgtcggtaccgggccatttgtgctccagcagtaccagaaagactcgcgtattctgtataaagctaacccggatttctggggaaccaagccaaaaattgatcgcctggtcttctctatcacgccagatgcgtcagttcgctatgccaagttgcagaaaggcgaatgtcagatcatgccgtatccaaatccggccgatatcgccagcatgaaaaaagacagcaaaattaacctgatggaacagcctggtctgaacgtcggttacctgtcatttaataccgagaaaaaaccgctggataacgtgaaagtgcgtcaggcgctgaccatggcggttaacaagcaagccattatcgatgcggtatatcagggcgctggccagccagcgaaaaacctgatcccaccaacaatgtggggctataacaaggacgttaaagactatgcttacgatcctgaaaaagccaaagccctgctgaaagaagcgggtatggcggacggtttctctatcgatctgtgggcaatgccggttcagcgtccttacaacccgaacgcgcgccgtatggcggagatgattcagtctgactgggcaaaaattggcgtgaaagccaaaatcgtgacctatgagtggggcgagtacctgaaacgcgccaaagcgggcgaacatcaaactgtgatgatgggctggaccggtgataacggggacccagataacttcttcgccacgctgttcagctgtgcggcggccaaagatggttcgaactattcccgctggtgctataagccgtttgaagatttgattcagccagcacgcgcagaatccgatcacaacaaacgtattgagtattacaagcaagctcaggtagtgatgcatgaccaggcgcctgcgctgatcattgctcactcaaccgtttacgagcctgtcagtaagaaagtcactggctatgtcgtcgatccattaggtaaacatcacttcgataccgtcgatattcaggaataacctttcggattattgcagtaagggccggttttgccggccctcaggcgatctcctccgatcgcctgttatctgctctttttttccggctatttacttttacctaagaagcgcttcttgcgtcgcgtccggctttcgttggatgcggttaatgagcaatgttatctctggccagggccaggggaaaacgactgagaattacgcctatgctgcagttcatactccggcgtctggggcttgtcatcccaacgttcatcggtattacattattgaccttcgcgtttgttcatatgattccgggcgatccggtgcttatcatggcaggcgagcgcggtatttccccagagcgtcatgctgaattgatggcgatgatggggctcgatcagccgctgtggaaacagtatctgcactatatctatggcgtgctgcatggtgatttaggcatttcactgaaaagccgcattcccgtctggaccgaattcgtcccgcgctttaaagccacgcttgagctggggatgtgcgcaatgctgtttgcggtctgcgtcgggattccggtcggcgttatggctgcggtgaaacgtggctcggtgtttgatcacaccgccgtcggtatttccctcacaggctactccatgccgattttctggtggggcatcatgctgattatgctggtttcggtgcagctcaaccttaccccggtttctggccgtgttgcggataccgtgttcctggacgacagccatccactgaccggtttcatgctgattgatacattgatctggggtgagcctggcgacttcaaagatgcggtcatgcacatgattttacccgctatcgtgctgggtacgattccgctggcggtcatcgtgcgtatgacgcgttcttccatgctggaagtgctgggtgaagattatatccgcacggcgcgtgcgaaaggcctgacgcgtatgcgcgtcattgtcattcacgctctgcgtaatgcgatgttgccggttgtcaccgtgattggcctgcaggtcggcaccttgctggcaggcgctatcctgaccgaaaccatcttttcctggccgggcctgggacgctggttaatcgaagcgctgcaacgccgtgactatccggttgtgcagggcggtgtgctgctgacggcaatactgattatcctggtcaatctgctggttgatctgctgtatggcgtggtgaatccgcgcatacgtcataagaaataagggggcatcatgtctgttgttgatcccgcaagcgtaaatattgcacccaagccgatgaccccgattcaggaattctggcactacttcaaacgtaataaaggtgcggtaaccggcctggtttacatcgtgttaatgctgttgatcgccatctttgcggatgtactggcaccgcacggcccagccgaacagtttcgtgatgctctgctgcatcctcctgtctggcaggaaggcggaaactggagctacatcctgggcaccgacgatgtcggccgcgatattttatcgcgcctgatgtatggcgcgcgcctgtcgttactggtgggctgcatggtggtggtgctgtcgctgatttttggcgtcatctttggtttgctggccggttatatcggcggggcggttgatgccacgattatgcgcctggtggatattatgctggcgttgccaagcctgctgttagcgctggtgctggtagccatttttggcccgtcgatcgtcaacgcttctatcgcgctgacgtttgtcgcgctgccccactatatccgtctgacgcgcgcggcggtgctggttgaagtcaaccgggactacgtgaccgcttctggtgtggcgggggccggtatgctgcgccagatgttcgtgaatattttacctaactgtctggcaccgctgatcgttcaggcttcgttaggcttttccaacgccattctcgacatggcggcgttgggctttctcggtatgggtgcgcagccgccaacgccggagtggggcaccatgctctccgacgtattgcagtatgcgcaaagtgcctggtgggtggtgactttccctgggttagtcattctgcttaccgtgctggcatttaacctgatgggcgatggtttgcgtgatgcactcgacccgaaactcaagcagtaaagaggcaccgagatggcgttattaaatatagacaaattgtcggtgcatttcggcgacgagaaggcaccgttccgggcagtcgatcgcatcagttatcaggttgagcagggccaggtcgtgggcattgtcggcgagtctggctcgggtaaatccgtcagttctctggctatcatgggattgattgattttcccggcaaagtgatggcagaaaaactcgaattcaatcaacgggatttgcagcgtatttctgaaaaagagcgtcgccagttagtgggcgctgaagtcgcgatgatttttcaggacccgatgaccagcctgaacccgtgctacaccgtgggctatcagattatggaagccattaaggtgcaccagggcggtaataaaagtacccgccgtcagcgggcaatcgacttactggatcaagtgggcattcccgatcctgcctcgcgtctggatgtttatcctcaccagctctcaggcgggatgagccagcgcgtaatgattgcgatggcgattgcctgtcgtccaaagctgctgattgctgatgagcccaccaccgcgctggacgtaacgattcaggcgcagatcattgagctgttgctggatctgcaacagcaggaaaacatggcgctgatcctgatcacgcacgatctggcgctggtggcagaagccgcacatcacattattgtgatgtacgccgggcaggttgtggagagcggcaaagcgaccgacatttttaaagcaccacgtcatccttatacgcaggctctgctcagggcgttgccggaattcgcggcggataaagcgcggctggcctccttacccggtgttgtgcctggaaaatacgatcgcccgttaggctgcctgcttaatccacgctgtccttatgccaacgatcgttgccgtaaagaagaacctgaactgcggacgattccgggacgtcagtccaaatgtcactatccgctggacgatgccgggagaccaacttatgagtcctgataatactaagcacgagtatctgctacaggccatcgacctgaaaaaacactatccggtgaagaaaggattgtttggtcaggagcggctggtaaaagcgctggatggcgtctcttttaatctggaacgtggtaaaaccctggcggttgtcggtgagtcgggttgtggcaagtctacgctgggccgtttactgaccatgatagaaacaccgacagaagggcagctctattggcacggccaggatttgttaaaacacgatcctcaggcgcagaagctgcgtcggcagaaaattcagatcgtgtttcagaatccgtacggctcgctgaatccgcgcaaaaaagtcagccagatcctggaagaacctctggtgattaatacctcactcagcaaagcggaacgtcgcgaaaaaacgctggagatgatggccaaagtgggactgaaaactgagcattacgatcgttatccgcatatgttttcgggtggtcaacgtcagcgtattgcgattgcccgtggcctgatgcttgagccagacgtgctgattgccgatgagccggtttcagcactggacgtgtcggtacgtgcacaagtgcttaacctgatgatggatctacagcaagagatggggctgtcctatgtttttatctctcatgatctttccgtggtagagcatattgccgatgaagtgatggtgatgtatctgggtcgttgtgttgaaaagggcagcaaagaggcgatttttgccaatccgcgccatccttatacacaagcgcttctctctgccacgccgcgactcaatcctgacgagcgccgcgaacgtattaagctgaccggcgaactgcccagcccgctcaatccgcctccgggctgcgcatttaacgcgcgctgccggcgtcgctttggcacctgcgttcagctgcagcctaagctcaagcagtacggtgatcagcagatcgcctgcttcgctgttgatcaggatgaaaaccagctgatggaatcaggtgaaactgccagtcagccttaacatactggcgggcggaatccttgcgggtagaaacggccaggattccgccatcaagatgcaacgctttcatcgtattacccggcccggcccgataacattacgggccttccccttctgccccgcctgtctgtaagcgccccgataatgcctggtgttttgttcaatgcgacagctcatccagtgaaaaacaccctgtgacgtattcgaatgaggtcatgcctggcgcgctgcgttaacgcaacctttgcggcaagccgaatcattagcctcactgtccagaatggagatgcagcgggttggattaaatggtcaaacaaacagcgtttttctctgtgctttttcagactttcagttccattcatttacgagagaataacctctcaatttttttaattttcggatggaagaaaaaaagtcactgtcccgaaaaggcgtaaaaggcaacgttttcaacattgaacggtttttatccggtgataattagcacagtaatactttactaaccgtaattcgataacctaaaaatctctccagccggtcacaaaaaggccagtaaaacccgaaagcgaatgaggtttttttttacctgtaaatacaaaaggttgtaacagcagctatcctgatgttagcgatcgctaagatgttaattatttgtgatgatatttaacttaaagttgtctcaacaatttttagtgatatatgtgaaaaggtactcatttattgctaaagaatggctattagcattaagctttcttattgaatatgtcggttttgtaaccagaattatctcactgtgtttaaattattatgatatattcctggaaaaatcctccctctgttgtaggccatggtctatgaaaaattacgacgacttacagcgttttaaggaaaagacaaaaacgctcgacatcgcctttcaggatatgtcaggccaatcgcaggaagcggcggataaaagtaaatggtctctcattcgtcaactggcgtgcgaagagacgcaaatgcctttcagtggtggccaacgcattgatctgccacagccacaaccgattcagggtgatgaattcagcacgactgctgtggccgcgttatctccgaatgtgaacaagcctgcagcggcgtcttccagctccatcatgagcagcctgaacggcaatgaacctcatgttgaagtggtggtgcccgtttcaacctcttccacttcatccctgttcccggcacccgcagcgcaatccgtctctgcagaggtgcagaaaacagcagaggcttctcccgtacaggagaacgcaataccgacaccgcctgtcacggcgcagccgaatcgtgacgcgcctgccgagacggacaatggccgctttagcggactgttccgcgcgcgcaacagtggatcagaaaatttaccgaaagaaacgttattaaaaccgctactggagaagattgccttatgccgttagtttgtgtgtgctcgcccaaaggtggggtggggaaaactacgttggcagccaatctggcctggagtctggcccgctcgggtagcaaagtgttggcaatcgattttgatgtacagaatgcattgcgcctccattttggcgtgccgctgcatgacgggcggggttttgttgcacgttctgaagaacaggcggactggagccagtctattctgaccaccggcgggaatatttttgttctcccctatggcaatgtcactgaatcccagcgtgaacggtttgaagagaacctggcgaaagatcctcactttatcaagcgaggtctcgacaccttactgaactatccgggtctggtcatggttgcggattttcctcccggccccgggccagcgcttaaagcaatcaaggcattagccgatatgcatttggtggtgatgttagccgataccgcctcagtgtcgttattaccccatattgaggaaaatcgcctgattggtcagccgctgaatagtaaacatgggcattattttgttctgaatcagtgtgacaatcgtcgaaatattaatcgtgatgtgaccgcttttattcagcaacgtctcggcgataatcttttgggccagattcatcgcgatgaaagcgtgggcgaagccaatgcatcacagcagtctgtttatgattttagcccttcatccgccgctgcctttgatattgaactgatcgccaaacgtgtcgccagtacgctgaatatcactgtaggtaatggcgaagttcaggctcagattcacaccagcaactactaaatgtaatgacctggcttgccaggtttaaaaaaacagctcttttcagggtgggacatgagtaaaatcgggttttacctgctgctgctggtgcttgcacctgttgccgcggtgatcattatcacgccgatggatagccaaaagcagtatatttttggcttgatcagcattggtatggtgtttttgttaggggtaagcaaaagccgtaaaataacggtggtaatggttattctgtccgccctgatgtcatcccggtatatatggtggcgaacgactgaaaccctgtattttaattcggaaatcgaagcgattcttggcatcggcttatatattgccgagctgtacgtctggctgattttaatcctgggtttcctgcaaaccacatggcccttaaaacgtactattgaacccttgccggaagacaccagcttatggccgacggttgatgtctatgtcccgacctataacgaaagcctcgacgtcgtgcgtgatacggtgctggcggctcagtgcatcgactatccacgcgataaaataaaggtttacctgcttgatgacggtaaacgcagagaatttgccgttttcgctgccgatgtcggcgtgggttatatcacacgtgacgataacagccatgctaaagccggtaatctgaatcacgcgatgaagatcaccaaaggtgagctgatctgcgtgtttgactgtgaccacgtcgcgacccgcactttcctgcaggccacggttggcccgtttctgaccgatcctaagctggctctgttgcagacgccgcactacttttattctcccgacccttttgagcgcaatctgcgtgcggctcgcagtatcccaaatgagggatcgctgttttatggcccggttcagcagggcaacgacaactggaatgcgactttcttctgtggttcctgtgccgtgattcgtcgttcagcgctggaagagatcggtggtttcgctgtagaaacggtcaccgaagatgcgcacactgcgctgaaaatgcagcgtctgggctggggctcggcgtttctggcgattccgctggcggcggggctggccacagagcgccttgggctgcatgtgattcaacgcacccgctgggcacgcggtatgacacagatttttcgcgtggataacccattgttgggacgaggcttaaaatggcagcagcggctgtgttacctgaatgccatgttgcatttccagttcggtctgccacgtgtggccttcctgaccgcaccgctggcctatctgttgtttaatctgaatatcatccattcgtcggcgtcgctgattttcgcctacgttttgccgcatctggtgctgtctctgtacgttaactcacgcatgaatggccgtttccgctacaccttctggggcgaaatttatgaaacggtgatgtgcttccatctggttatcccaacgcttatcacgctgctttcacccaaacatgggaaatttaacgtgacggataagggcggagtactggatcagggcttcttcgatttccatatcgtacgtccacacgtgattgtcgccattttgcttagcattggcattgttgcgggcgttgtacgtgccacgatgcatgactattttggcgttgacccctacgtgattgcgctcaatgtaggctgggctgtcttcagcttgatcattttaatggcggcgattgctgtggcacgcgaaaccaagcaggtacgaaaaacgattcgtattgaagtgcagattccggccattatccattacgccagcggtatctcatcccgcaccatgaccagcgacctgtcgatgggcggtgcgaatctggatgcaccggataaccgtcatgagcaggatacgattgaagagatcgatctgttactgaagtcaggcaccattactatcccggcgactaaaatctcgggcgatgaagaaagcattcgtctgagctttggcgcgatgccgctggcgcgtcgccgtgagctggtccgtgtggtgctggcacgtgctgatgcatggatccagcctgaatataagcaagacaacccgttaacctctctgggaaccatcattcgtacggttttcgaactgttttggctgacctggatagatcgtcgtgagaaacgtaagagcggcccggacgttgcggcgaaagaggacagcgcagtatgaggatcttgatacagtcgatgctggcgggttctctgtcggcagtgctgtgggtcatgccggcctcggctgaaacgcctctttcagagagcagcgtagtgccgaataacagcgcggcaccgaatagcagtgctgcgccgaataacagcgcggcaccgaatagcaatgctgcaccgaataacagtgccgcaccgaatagcagtgatgcgccgaataacagtgccgccccgaacagcagtgctgcgccgaataacagcgcggcaccgggcagcgatcctgctctgactcgccacactgacggtacgacaggtaacccggcggcaccggttggcagtacgggtttgcctgagaacagtacggcacccgccagtagcaccgcgcccgttaatgaagtgacttcgggcgcaaccgcctcggatacgccaaaaccgaatggcgaaggggtacccgcctccgtagagacatcgtccgacagtagccgttcgcccgttacccaggacagcagcgcgttatcacatgttccaccgccagccggtctcgataatgcggaaccgggtctggaggccgccgctggcgccacgccttacaggccaggcgaggccgttaccgctgtcggcacgacatccctggccagcagcatgctcaaccaaccggtgagcagcacgctgaacgtggcacagatgggacagcgccagggcattacgctgaccggcggtcagctacagtcaggcattatttttacgctgccaggcgatgaggtggtgaccaacgcccgtcttaacctgtcactgcgcgtctctcaggcgctggctgcgcgcaacacctcactgcagttgatgttaaacggacaaccgcttggcacgctcccgctggggtcgggtgacagtgatgaaagcgattatcagctggacattccggcggcgatgattgtgtctaacaacaatttgagcttcaaaattaacgacgccgataagctgctgtgtgaaaaggacagtgcagagcagtatcaggtaaccattctgcctaaaacaatgttgagccttgagggccagcagttaaacatcggtaccagcctgcgtaatttcccacggccatttgtcgatccgcagcgtatgaccgcagcggaggtgacgtttggctttaccagcaatgtcgcgccagatgcggtgacggcggcggtgctggtggcctcctggctgggcatccagagtgattaccgtggcattaatttccctgtggtgcgcggtaatctgccggaaaaaaacggcattctgtttggtcaccctggtgacaagattggcacgttaacctttcctgccagcagtggcccatctttgcaaatggtcgataacccgggtaatccggtttataagctcttgctggtcagtggtgaggatgaaagtcagctgcgccaggccgccaatcgtctgaccatccagcctcttaccactgacggcaacagcttgcaggtcaaaccgcaatccatagccagccgtacgccttacgatgcaccgcactggatcaacacggcgcatccggtacgactgagtgagctgctgcggaaagatcaaagcctaacggcgaccggtatctggcatgatgcgatgcgggtgaatttccgggcagcacccgacctgttcctgtgggatggcgattcggttccgctgtatctgcactaccgttttccgtcagaaaactggattgacgagaaaaactcgctgcttaacgttacgttaaacggcactttcctgcgtaatctgacggtcaataaagtggggttgctggagagtgcgtggcaccgcttaggcggtgatgcgcgtcaggagcactatcaaatcaaccttgatccctatctgatttatggcgacaaccagctggcgctctatttcaacatcaagccaaaagccgatgcgccctgcggtgtattgttgaacaacaacatcaaaagccgtattgaagacgactcatggattgatttaagccatacgcggcacttcagtatgttgccgaatctctcatactttgtcggtgcctcctttccgttttcccgacttgctgacttttcacagaccacgctgctcctgcctgcgaatcccagtgatgcggagatatcaacactattaaatctgtccgccagggccggtaatgccacgggcgtggcgctggcacaaaaccaggtactctttggcttgccaaatgggggcaataatctggcccgcgttcagcaaagcgacttactggcagtgagtaccacaggcaacagcgcgtttaaccaggcaatgctggcaaactcaccctatgacgccagcggcagtgcgataggggtgaaagaacccacgacgctcgaaaagttacgcagctggctgatgggtgactggaatcgtcaaccgctggatgccgatcgctatttctcttcgaatgagtcctggcgtggctttttaagctatcgctcaatgtggaatccagatcgcctggtggtgatggcagtggcgactagcgatgatcaactgctgcgcctgcatgatgatttgggctccgcccgcatcaacgccgcggtgcggggtgataccgcgattatgactgatgagaacggtatccggagcttccgggtaggtccgcagttccccagcggtgaaatgccgtggtacatgatggtggtgtggtatgccaaccagcactcggtattgatggcgctgacggcgctgttgctttccgccgtcgtagggagtgctgcgtgggttatgctgaaacgacatgcttcgcggcgactacagccaaaacacgatcgcgatgccggtaagaagtaagggccataataatgaataaaaaccaaatcagtgccggtatctgtcgtgcgttgttactgggtagcgcgctctcactgtctctgccgctgcaggcggcggagagcagcaatccagcgttacaggcgctctttgatcaggcggcttactggcatcaaaaagcccatgacgatctggcaaaagcgtcgctgcaaaaagtgttaatggttgagccgaacaatagccaggcgctttatctgctggcgctttattcacagcaaagcggtgacagcgcaggggcgatgcagtatcgcacgcgtcttagccaggtttcgcctgacgatccgcacctgtctgaactggataatgcccgtcagttgcagaccattcctcaggcgcagctctctttggctcgccagcaggcaagaagcgggaatatcgcggctgccttacagacctggcgtaatacgttcagcggcaatgaaccgccacccagcgttgccgccgaatattacctcaccatggccggtgaccgcacgctgctgccgcaggctattgaagcgttacgtgctttttcagcgcagcatccgcaggatacgggtgccaaactggcgttgggtaaggcgctgacttatcaggaccctacccggcgtgaaggcattgacttgctcagtacgctggcaagcggcaatcaggatgccgatcgttctcttcgtcaggcgctgttgtggctcggcccgcagacgtcggacgcgccgctctatcagacctggcagcagcggcacccccaggataatgcggtaatggactattaccgtaaaaacgtgggaggggcagaaaaaggcgcaggttttagcgcgctaaacagcggcgacgtgaacagcgcgcaaagcaattttggaaaggtgttacaggccaaccctcaggacgcggatgcgcttgccggaatgggatatgtggcacaacgagaaggccgttaccaggacgcagcggattatctggagcgtgcggcgcaactgggcggcgatcaaagcgccgatcgccagaagcaggcagccgatgcccgtttttatgcacagttagccagcgctcagcaagcattgaaaaatggcgacagtgcacaggcactggcgatcagcgaaccgcttacgcatgcagaaggcgagaagggcgtggcggcgggcttattccgcgccgacattttgcgccgcagtaatcaacccgaccaggcggagcaggcttaccgcgcgatactgaaaaacgatcccgataaccgcagcgcgcgcgaagggttgttctatgtactgcgccagcagaaccgcagcgctgaagccaatacgttactggcttcgctgcccgaaagcgtcaggcaaagtgtggcgccgcgaggcagcagcgttgacccgattcgccagcaggcgaaacgtcaggttgcggcaggtaatatcagtgccgctattgcaacactgcagcagggcattcaacgttatccgcaggacggctggttgcgtctcgacctggcgcgtctttaccgccagcaagggaataccatgctggctgcgggcgtcatgcagccggtcatgcgcagtggtgccagcatcacagaacgctatgcgggcgcgattaacgccagtgaaagcggtgcctggcagcaggcaagttcgctgctggcgcagatccctgccagcgcccaaacccgtgatatgcgggagctggcccagcgtgtgaatttcaatctgcagatggcgacggccgatcagtatctggcacaaggatcgaatgcggcggcggcaaacacgttaaaagcgctggcggtgaatccgccagataacccggttgatgccggaaacctggcgcagaagctggcgaaagcgggcgatatcaccacggcggtggccgtggtgcgcggtaatatgcagcgcggtgttcagggtaatgttggtgattatgctactcaggtagccgtactgaatcaggccggactggacaatgaggcgcagcgttttctcagcttgccagaactgcaggcacgcagcacaccaaaacagctggcagatatacgcgaaggttatctgattaacgatgttgatcggctacgacagcagaaacagtatgccgctgcctacgataagctggttggtgcactgcagcgcgatccgcaaaaccgtgatttgatgtttgccatggcccgtctctaccaggacggcaaaatgaacaaagacgcgggcgtggtttacgattacctgatgacgcaggatacgccctcccaggatgcgcgcgttggggccatcaatgtcgcactggcacaaaacaacgtgcagcgtgccaatgaactgacccgtggccttacacagagccagacaccgcaacgtcagttgctgctggctcaggtcgccgaggccaatggcgaacatacgcaagccatgcgttatttacgcgctgcacgcgggcagattattggtctgcaaggcgcacaggctggcgcaacgcctaccattggtggactggcgctggccgacaatccctttattaaccgcagcacttcccctgttggacacacgccgtccagttatggcaccgtgctgccgtggcaggttgccccggtctcggcagagggatcgcaggatgtcgccgttgcccgtgccaacacggttccttcgcagcaggcacagacgttgcacgacattgacaccatgatggagaccctgcaggagaaaaccggcacctgggcgcagggcgcggtacaggtccgcgggcgtgacggcgagtcagggctgagtcaattgacggaagctaaagcaccgttgaccttctccaccgtgccgtttggcaatgcgcggttcaactttacgatgacgccggtttcactcaccgccggaagcggtgcaggcgatgcctggcgtcgttttggtacgaatgcgctggagcagggcaaagtggtggctgccggtatcgccaaaattgatgatgttcccaatgccacgaccgattcgcaaagcgcatccggcgtcgagctgaatctggcactccagggcgatagctataaaatcgatctcggcagcacgccgctgggccaggatctcaatacgctggtgggtggtgtgcaatggtcgccgaaactcacggatttcctgacgctgattctgaccggtgagcgccgtgcgattaccgacagtctgctgtcttatgtcggcacggaagataaatccagcggtaaacgttggggtaacgtcaccaaaaacggtggcaacgcattactgagttatgacaatggcgatgccggtctgtttgtcggggctggcgcttacagctacgtggggaataacgtagccagtaacaacaacctgcaggctaatgcaggtgtttatgtccgtcccttttatgctgacgaccgtgaactcaaggtgggcatgagtttgtcgtggatgaacttctcgaaaaacctcagctactttagctatggtcagggcggctatttcagcccgcaggactatgcgtccatctccttcccgatcgacttctcgcgcacgtttgacgatcttaaagtcaatattggcggtgccgtgggctatcagagctacagccaggataagagtgcgtatttcccgggcgatgcatcccgccaggcgcagctggaagcgctggctgccaacggcaatgtgaaaagcgccttctatgacggcaacagcaaaaacggtgtaggttataacctgcatgcgggcgcggattacaaaattgataaagatgtcacgattggcgggcagctgggttatgacacctttggtgattataacgagagcaccgcacagctctatttccgttatctgttcggagagaagtaatgagtgaagcatttggcgggggaacccacccgcatcagcccggctggtttgatctggtcagcgtactggtcgaagggatgattgccaacgccggtcaggagcaggcagaggcttttctgtacagcatgggtgaatcgctggcggcgcgctatcctttacctgaatcgcgtactgtgcaggatcttgaacgcgagtttaatctgcaactggcccggtttaactggggatttgttcagctacagccgcaggaaaatgccgtgttaattaagcattatgcattacctgcaggcgacagcaatcagccggccgcacactggcagtcggcattgggcgccatactggcgggattgttttccggctggtttcaggggcagggcggcagcaaagcagtgccggttgtgctggaactgaacgatggcaataccatgcattttcgatatcaataaggtgctctgatgagagttaagccagtgtggtcaggtgttctggtttgttttatggtgatgtttttcaatgcccaggcaatggcaaatggctgggatacgtataagagccgttttcttcagtcagacggacgcattattgatacggcgaataataatgtcagtcatacagaaggccagggttatggcatgttgctggcggtagcctacaacgaccgtgcaaccttcgatcggctctggacatggacgcgtaccaccctgcgcaatccgcaaaacgatctgttttactggcgctatgtccccaccgctcaggaccccatcgcggataaaaataatgcttccgatggcgatgtgttgattgcatgggcattacaacgtgcggcgcaaaaatggaatgtggccgactaccagcaggcatcagatcgtattcaacgtgcgatagtcaaacttgatgtggcggactttggtggttacaccgtgctgatgcctggcgcgcagggattcaataaaaacagttatgttgttttaaatccctcttatttcttgtttgtcgcttggcaggagtttggtcagcgcagccatttacaggtctggaacaagctgattgacggtgggatgacgctgctgggtaagatgcattttggcaacagcgatcttccactggattgggttgcgctgaatgcggacggttcagtggcccccgcggtcggttattcgaaccgctttagttatgatgccatccgcgtaccgctgaatatctggtggtacgatccacaaagcctggcgctgggccctttccagcgtctctggcagggttacggtcgtatgaatacgccggcctggttcgatgtcctggccaatacggcagcaccttaccatctggaaggcggcttgctggcggtgcgcgatctggtgctcaacgaaacgggctacctgagtgacaaactggcgcctgagcagaactacttttctgccagcctgcagctactgacctggatggcttatcaggaaaagcattgataactgtctgaatcgcaacggcggcatcctttcgttattcgccactgaaaggatgcggctgtggcaaatttcgcttttgctgtctccgcctttctgaatcctctgcttccgccgccttaagccacaaaaaaacgctgcgataggatatacttgacgcgcttttcttgacggatatctacgctcttagcgagccgggagtaaatttttgcgcgtaagccgatcacttacgataaaacagatggcgacggtttctcttatcgcgacggtgaccatcagtatttttatcgttattcaactgttccattttgtgcagcagcgcaggattgaatacgcccagcaaatggagaatatcgcgcacaccgtgcgtcagcccctgtctgatgccgtattaaaagctgatatccctcaggccgaacgcatccttaactcacttaaaccggcaggcattttgtcgcgtgcggatgtggtgttgccgaatgcttttcaggcgctacacgcgaattttgaaaacgaaaaaccggtgcccaggctggtggcccgcctgtttgagctgccggtacaaatcacgctgccgctctattcggtggagcatacgggcttacccaagccgctggcttatctggtgctgcaggccaactcatcgcgtgtttatcagtttatcctgagtacgctctctacgatgattgtcacctatctgctgctggcgctgatcctctccgtctccattagctggtgcatcaaccggttggttgtacatccactgcggcgtatttcacgtgaaatacaggaattgccgccccagtcgattcttacgcataaactgacgctgccggcggatcaccgcgacgacgaaatcggtatgttgattcgcagttacaaccgcaatcaacatgtactggagtccattcatgacgagatgagtcggttaacaacgcattttgacgtcaccgacctgcctaaccgggcgctgtttgtggcgttgctggaacagttcatcggctatcgacggcaggcctttagtatcatggtcatccgtattgagaccttacaggaagcgaatggcgtactaagcgatgagcagcgcgatacgctgatgttgacgctggtcgagaaaattcgcagcacccttgatgaccacaccgtattagcgcagatcaccaccagtgattttgtcttgctgatgaaatcggccaacacgccgttccgcgccctgcgtctggcccgcaatctgatgattcgcctgaatcaacctgtaaacctgcatcagctacagctgcggcctaacgccagtatcggtctggcattaagcgaagagcgcgatacgacgggcgccgttgagatgctggacagagcgacctcggcaatgatgtccgcgcgccggctggggaaaaatcagatcctgttttttgacgctgcattgaccgaacgcgcgcaaaaacggttgacccaggaacacgatattttacaaggcctgcacgacgaccagtttgccctctacctgcaaccacagatcgatatgaggaccggtaacttagccggggcggaagcgctgttgcggatgcgtcaggctgacgggagttacggtttaccggaggagtttattgccagtgccgaagaaatcggggtgatttctgccatcggccgttgggtgtttgaagaagcctgtcgcattctggcgggctggcagcgccatggcatgacggtgccgctaagcatcaacatttctgccgtacagttacgtgatgccagcatcgtcagccatttgcaatcgctgttggcgcgccattctatcgcgccgggctcgctggtgctggagatgaccgaaacggcggagatcggcgatgctgaacaggccatttccctgctacgcatgctgcaaaaaaccggtgttgctgtcgcgcttgatgacttcggcatggggtattccaatctcaactaccttcatcagttcaagtcattacctgttaacaagctgaaaatggatcgcagctttgtcgccgccttacccgaggatgacaccatggttcgcatcgttgctgccatcgcggatattatcgacctggatgtgattgccgaaggcgtggaaacctgcgagcaacgcgactggctgcttgcgcgtggtatcacgattggtcagggctatctctattctgaggccgtcccgctggcgcagtttaacgaacaatggattggcaagccgccactgcacgaataaccctctgattccttgattttgcaagaattttagttacaaaaccccttgctgaagcgtttcagttcagaattacgcttgtatcatttcccctgactttgcagccctgtattaatcacgtaaacagagtgttattttctgtcaactgtctggtccggcctgccttgccagccagtcacaataaaaaatccgacaacattaccctattcgttagtggatacctgtttatgaaactatttaaaagcctttatttccaggttctggtcgccattgccattggtgtactcatgggccatttttatccagaattaggtacccaaatgaagccgttaggggatggcttcgttaaattgatcaagatgatcattgcacccgttattttctgtacggttgtgaccggtatcgccggaatggaaagcatgaaagccgtgggccgcacgggtgcggttgcgctgctctactttgaaatcgtcagtaccatcgcgctgatgattggtctgatcgtggttaacgtcgtccagcctggtgtgggcatgaacgtcgaccccgcgacgctggatgcgaaagccgtggccatttatgcccagcaggccgagcagcagggcattgttgccttcttactggatgtgattccgggcagcgtgattggtgccttcgccagcggtaatatcctgcaagtattgctgtttgccgtcctgttcggttttgcgctgcatcgcctgggcaacaccggcaccttaattttcaacgtgatcgaaagcttctccaaagttatttttggcatcatcaatatgatcatgcgccttgcacctattggggcatttggtgccatggcctttaccatcggtaaatatggcgtcggttcactggtacagcttgggcagctcattatctgcttctatatcacctgtattctgtttgtggtggtggtactggggctgattgcgcgcgtgttcggtggcttcagcatctttaaattcattgcctacattaaagaagagctgctgattgtgctgggaacctcctcatcagaatccgcactgccacgtatgctggataaaatggaacggctgggttgtaagaagtccgttgtcggattggtgattccaaccggttattcctttaacctggatggcacctcaatctatctgacgatggcggccgtctttatcgcccaggcaaccaatgcccacatggatatcttccatcaaatcacgctgttggtcgtattgctgctctcttcgaaaggcgcagccggggtaacgggcagtggctttattgtcctggcggcgacgctttcggcagtgggacatttaccggttgcaggtctggcactgattttaggcattgaccgctttatgtccgaagcacgtgcgctgaccaatctggtgggtaacggtgttgcaacggtggtcgtggcaaaatgggtcgatcagttggataaaaaacagctgggcgacacgctggcgggcaaaaataaggcaaaaaacccgtcagaatcggcgatttaacgcttgaatgtgatttaatcctctcaaatgcccgctgtcacttgccctgacagcgggcatttggataataaaccccacttgtttttttcaacgtttttcacttcgttgcgtgacatcccggtcttcctgtggtcaaacctgttgttaatgatcggcagcgcgaatcggcaatgatcggtccgcttataaacgcggctaaacgtgccagtgataacgatttttgaattgtttgagtaggggttcacatgcagggcaccagaattcggcttttggttggtggattagtgctggcagcgaccagttacggtgtgccagcagaaacgctgcaacctgatccagcctggcaacagggaagactggataacggatttaactggcaactgttggcaacaccgcaacggccaagcgatcgcattgaattgcgtatggtggtaaacaccggctcactggtagaaagtgcgcagcaaaccggttttagccatcttctgtcacgtctggcgatggtgcataacacggcgctggatactaaccagcagcgcgctttgtggcagcagagtatcgatccacagcgacctttaccgcccgttatttcttcgtatgattacacgcaatacaacttaagcctgcctaacaaccgtcctgagctattgaaagaagccttgaactggctggcggctacggcaggggatatggccattaccaatcaggtggtggacacagccttgtccgcttctgacccggtaagaacctggccggcggatactcaggatgtctggtggcgctatcgtctgaaagggtcggcattgttagcgcatgacccggctgaaaaaccgcgcgcgccggtggacaccgcgcagctgaaaagtttttaccagcagtggtatacgccagatgcgatgacactgtatgtcgtcggtaacgtagacagtcgcagcctttccgagcagatcaacaaagcgttctcaccgctggaaggtaagcgcagcacgccagcggcgatgcctacgctgtcgcctttaccgcacgatcccgtcaatctggtcagcggagcattaacgcaggacaggttgtcgcttgtctgggatacaccgtggcagcccatccgggattcgcagaacttacagcgttactggcgaggcgatctggcgcgtgaagccctgttctggcacgttcagcgggccatgagcaacaggaaagcacaaggtgtgcaggttggctttgactgtcgggtgctgtaccagcgcgcgcagtgttccatcaatatggacacgcgcaatgacagtcttgaacagaacatgaatctggtcgctcgtgagctggctgccgttcgcgataacggtttgcctcaggacgagtttgatgccctgatggcgcaaaagctgctggaactgaataagcttttcacgacctatgcccgcacagacactgacgtattgatcagccagcgcttacgttctcagcgcaattcagtggtggatattgccccagagcagtatcaaaagctgcgtcaggatttccttgctggcttaacgcgcgatcagctgaatcaggagctgcgtcagcaactcagccaggaattaatgatggtgttgattcagccggaaggcgaaaccgaaaccaatgtgaaaagcctcaagtcgggctgggataagctcatgacgccgcccgcgacagcatcttcaccgacgatcagcagtgatgccagccagccggagagcagcgccgcaggtgacgcagcgcctccggcttcctgatccctcaggtttttgccctgagccattcggtcactaacatcggccaactggcgaggggcaaatccgctacgccacggataccaaaaccgtgcccgcccttctggtagaaatgcacttcaactggcacattgtgttcccgtaatgcgctaaaaaataccatgctgttgttaacggggacggcatcatcatcggcggcatgaatcagcaaggtcggcggtacctgattgtgcacccgggtttcaagagagtaagcatcaatggctttctgatcgggccatgctcctaataagcgggtgcgtgcgccttcatgggccagaccgtcacgcatactgatgaccggataaaccagcaccatagcgtccgggcggggtgaaaagttttcagcactgtcctgaaccggatagagtttctcggcgaaacgcgtacccagactcgcggtaacgtgaccgccagccgaaaagcccatcatgacgatgtacttaccgttcagcccacgctgtgcacgttcacgcagtacgcgaacggcgcgctgtgcatctgccagcggtgcatctggcccttcatgatgcccgtcgtagggcaggcgataggtcatcacggccagcgtataacccattgaagtaaaaaaggtggcgagcgcgctgccttcacgatcgatcatgatgcgttgatagccgccgcctggcgcgaccagtaacgtaattccattggattctacagggtgccagatagccatttccgggcagcgcacgccggttgccacgcgatcgtagggttcgtactcttttgctgtatccactatctggggctgagcacgagaatcgctggcaccgggcgcatcaccatttggccagatattaataatttctgtattcatagctgtgtcctgatgcgagagatgttgtcgttgttttgttcgcggccgtgaaaacagcatcctgctgtcgctgtttaaaagatggcttcttttagcctaatcgtccaacttaaaaccgcgcaaacgccgagattcagactatacctggcatcagtgatattgcgctaacctgataattttaaaggaataaaaaataattaagattagcggctattaacggacgagggcgggatggcgcaagaataaaacgggatgactgacttaagctaaatgcagggggtttcatgttgccctgagggaaacggcagacatatttcccccgtttttctttaaagaaagtgatgtgttcctgcgcgactcgcgttgtgcaactggcaagcccggcgccgctgagccagaactgcggtgctataggcttgcatcgatcaccagcctgtcccgatcgccagattgccagaaggatgaccatccagtctcccagtcatcgcctccaggatcgcggaagtatgttccctggccgcttcatgaggcttttaaggtcttcccctcctgggcgatgcgcggcgattacgcgggcatattttcccgcgggataattgccccacgaaactgaataaccgtgctggccgtaagatgaccgcgcagcgcggcatctttaacagaagcacccacaagacgttgtgccagatagcccgcactgaacgaatcgccggctgcggtagtatcgattatcttatctttcgccagcgtgattgacggaacctccgttactggctggccttcaacggcaatcaggcaggattctgctccgcgcttgataacaatctcgctcacgcccgcctggcgcgcccttgcaatgacatcctccacaggctgattgccccataacagatgctcatcatccaacgtcaggaaagcaatatccgtattttcaagcatttgttggtaggcctggcgggtactggcgttatctttccacaagcgaggccggtaattattgtcaaatatcaccttgcccccgttcctgcggcagtttgcaagcaactgcatgagtgctgcacggctctgatcaggcagaatcgcaaggctgataccgctgagatacagatagtcgtaatgctcaagctgctgacaaatcgcttttgcctcagggccatcaagccagtatcgtgccgccgcatcgctgcgccagtaccagaacgagcgttcgccctcttcatcggtttggatcatgtacaggcctggcattttgttttcaagccgttgaatcagtccggtattgacgttttcctgctgccagctggcaatcatttgtgcgctaaagggatcgttccccagcgccgtaacgtaatccaccttgatagtgtgttgatcgacctgccgggcaaggtaaacagcggtattgagcgtgtcaccgccaaagccgcgtttgatgttgtcacctttctcggatagctcaatcatgcattcacccataatggcgatgtttatgtgcgtcatggtttcaggcctgtcgttaacgtttgcttcagtctcgcgtttgtcagcgttgtcgtcaacgttttaaaacgccgttttaatttaatttatggtgatgtaaagcgataattaacccgataaagcggcttgtttcggcgattgtcgcaataaaagaggcgtagactcgttgcttcaacgtggcccggttttcactatgttatcgaaacttaagcgataattaccgctgagccgccagatgaaggcgcttactatcaaccaggaaaagaccatggttatggagaatattagtcaatggctaccttcttcaactgacatcaatccccagcagaaaaaacgtctcttctggcagcagtgtcaacgccgctatacctttcagcctatctataaagtctcagggcgactgttggcggttgaactgctgacggcggttacacatccgtctgaaccgacgaaaaatctgtctcctgaagcctatttttctgcgctggaaatcgcgcaacgccttgatattgtgcaggagcagttagagctgctcgcccagtgggaatctttttttgcctgcaataacgtcatggcttcagtgaatattgacggcccttcattgtcattaatacaacatcatttgccgattcgtagtctgattacccgtttaccctgggtgcgctttgaactgaccgagcatcatgtcttgcctcaggaagagatggtggcgcaaatgcccgagctgggacccttgtggctggatgatttcggctcaggtatggcgaacttctctgcattaactgagcttaaatacgactacatcaagctgtcacgtgaactttttattctgttacgcgcgtcagatgaaggccaggtgttgtttcccatgctgttgtcgttgatcaatcgctattgcaacggcgtgatcgttgaaggcgtcgaaacgcaacatgagtgggagcaggttaagtcgtcacccgcgatggcagcgcagggatactttttttcacgtccggcgcctttttccgaactggagcatctacctgtacaacttgattgatcccttcccgcgcgctctcgactatctttaacggagaccgtgaaagagcagggaggaagcctaatgtcacgcgccggaaaaactgtaagctggattggcgggattttagtcgtgctgatcgtcgtggtggtagtggtcattgcaacattcgactggaatcgcctgaaaccaacaattaaccagaaagtgtctgcggaacttaaccggccctttgccattcgtggtgatttgggaatcgcatggcagcgtaaccgtgaagaacccggatggcgtgcctggataccctggcctcatctgcacgccgaagacattatgctgggtaatccccctgatattcccgatgtcactatggtgcatttgcaaggtgtcgacgccacacttgcgccgctggcattactgcataaagaggtttttatcccctggataaagctgcagcagccggacgcacgtctgatccaaaccgcggataagaaaaacaactggacctttaccctcgcgaacagcgacagcaaagacgacaagtcgccgccatcggcctggtcattccgtttggataatatcctgtttgatcaggggaaaatcctttatcgcgatgccgttaacaaggcggatgtgacgcttaacgtcaacccactgggtaagcctgtgccttattcgcaaatcgcgggcggtgacgacagacaaaaaggggcaggtgattttgtctttggctggcaggcaacgggcagctacaacaatgaaaaactcacgggtgagggcaagatcggcggcatgttatccctgcgtagccagacaacgcctttcccggtacaggcagacgtgcataacggcagtacgcgcgttcagctcactggcggtgtgcaggacccactgaatctgggtggactggatgtgcgcctgcgtttttcgggtgatacgttggcgaatctgtatggcctgaccggcgttttattacctgatacgccgccttatgaaaccgatggtcgccttatcgctaaatttacggggaaagagggcggggttttccgttaccaggggtttaatggtcatattggcgacagcgatatccacggttccctgacctacagccagggcaagccgcgaccaaaactggtgggtgaactccgctcggatcaattacgcatggcggatttaggcccgctaatcggggttgattctggtaagggcagcgagaaaaccgcactggccaaggcgaaacgcggtgaaaaaaccacgcagcctgtcgatcgtgtcctgcctcacgacaagtttgatactaaaaactggaacgtcatggatgcggatgtgaagtttagcggcaaacgtatcgaacacagcaattcgctgccattaagcgatctttatacccatttacagctggataacggtaatttgctgcttgatccgctacgtttcggcatggctggcggtaacctcaacagtacgattcggctggaaggcgatcgctcgcccatgcggggccgggctgatattcatgcccgcaaacttcgtctgcgccagctgtttcccaatgtgcaggcaatgcagaacagccagggacaactgaacggtgatgccagcttaaccggcaccggtaattccgttgctgacctgctggcaaccagtaatggccagttaaaactgctgatgaacgacgggctgatcagccgcaatctgatggaaatcgcgggattaaacgttggtaattatctggtcggcaagctgtttggtgacgatgaggtccgtattaactgcgcggcaaccgatcttaagctgcaaaatggcctggccaccccaggactgtttgtgtttgatacggaaaatgccgttatcaacgtgacaggaactgcaaactttgccaatgaacgcctggatctttctgttaatccagagagtaaaggtattcgcgtcgtgaccttacgctctcctttgtacgttcgcggcacgttcaaaaacccggatgctggcgtgaagactggtcccttactggcacgcggtgcggcggcggtagcgctgggtgccgtcgtcgggcccgcagcggcgctcctggcgctgatttcgcccagtgatacggacgataaccagtgcagccgggtactgcagcaaatgaagaagaagtgatcagttacgatagagcacttttataatgtggtaaccaaaagcggttttcaccggcccaaaaggttgtaacaacgggcaggtgaacgccgctttatcaaaggccgcgaccatttttccccgacggaactctcccaaatctcccccgttccggccagagggacagagagaatgtttgcgggcaagttgctggaagttttcgcctttttgcagtttttccagcagggcagtcgcctgcgcctcgtgtttcaccagaatatgtaaagccgcggcagttttcgccatgatgatgtctctgttgtgtataatcgtcccccattataaacctgtcttttcaaatcgcagatgcgttaacggcgcatattcattgagtcagtgctgacgggctaccgccctcactgcggttcgaaatcggtcttctatttcaacagagcgattccctatgcgtttaaactccagccaacaacgagccgtcgaatttgttaccggtccctgtctggttctggcgggtgcaggctcggggaaaacccgcgtgatcaccaataaaatcgcgcatctgattcgtgaatgtggctatcaggctcgccatattgctgccgtcactttcaccaataaagcctcgcgcgaaatgaaagagcgcgtggcgcaaacgctgggacgcaaagaggcacgcggcctgatgatctccacgtttcacacgctggggctggagattatcaagcgcgaatatgtggcgctggggatgaaatccaacttttccctgttcgacgatcaggatcaactggcgttgctcaaagatctgaccagcgaatggctgcaagaggataagacattactgcagcagctgatttccaccatttctaactggaaaaacgatctggtcgatccgccgaaagcggcagcattagcccgctcagagcgcgataacctctttgcccactgctatgcactttacgatcggcatcttaaatcctgtaacgtgctggattttgacgacttaattctgttaccgacgcttctgctacagcgtaatcaggacgtccgcgagcgctggcaacaacgtattcgttacctgttggtggatgagtaccaggataccaacaccagtcagtatgaactggtcaagctgctggtcggtgcccgggcgcgtttcaccgtcgtaggggatgacgatcagtctatttactcctggcgcggtgcgcgcccgcaaaatctggtcctgctcaatgaggatttcccggcgctggaagtggttaagcttgagcaaaactaccgttcttcacaacgtatccttaaagcggcgaatatcctgatcgccaataatccgcatgtgtttgagaaacgtctgttttctgaactgggtctgggcagtgaactcaaggtcctcagcgcgaacagcgaagagcacgaagcagaacgggtgacgggcgaactgatcgcccatcactttatcaataaaacccagtataaagattacgccatcctgtaccgcggtaaccatcaatcccgcgtgtttgaaaaattcttgatgcagaaccgcatcccttaccgcatttccggcgggacctcctttttctcgcgtcccgagatcaaggacctgctggcatacctgcgagtgctgacgaatcccgatgatgacagtgcttttttgcgcattgtgaatacaccacggcgcgaaattggtccggcaacgctgcaaaagctgggcgagtgggccaatgtacgtaacaaaagtctgtttaatgccagttttgatgtcggtctgggacaaacgctgaccgggcgtgggcttgaacatttacagcgttttacccattggctcaatgacattatccagctcagcgaacgtgagccggttaatgccgtgcgtgatttaatacgcggcatcgattacgaaagctggctgtttgaaacgtcgggcagccctaaagctgccgaaatgcgcatgaaaaacgtcaataccctgtttcagtggatgacggaaatgctggaaggtagcgatctggatgagcccatgacgctggcccaggttgtcacgcgcttcacgctgcgcgacatgatggaacgcggtgagagcgacgaagagctcgatcaggtgcagctcatgacgcttcacgcctctaaagggctggagtttccctacgttttcctggttggcatggaagaagggctgctaccgcaccagagcagcatcgatgaaaataacattgaggaagaacgccgtctggcgtatgtcggcatcacccgcgcgcagaaagagctgacgtttaccttatgccgggagcgccgtcagtatggcgaactggttcgtcccgagcccagccgctttttgctggaactgccgcaggacgatgtgatctgggaaaccgagcggaaagtggtgagtgcagaagagcgcatgaaaaccggccagagtcgcgtggccggattgcgtgcaatgctggaaaaggcgaaaaagagctaatcagtcgctgagcggatgaggtaagcggggtcaggaaagcgtcaaagaccagtggacataggactgataatggctttcctgttcaagcagctcggcccgcagcggatggacgtccagccagcctgccggtagcgtaacatgcagggcttcatcatctgcctgcatacgaacggcgggtaaggtgtcatcacgacggcgagtggagaagataatggacagtcgcagcagacgacacaaacgctcggccagacgcggtggcagggcattttgttgcgtcagtagagcaaggtcgatgctgccactttgattttgcagtaagcaggcaagcagttttttctgcgccggtgtaaaacccggaaggtcgagatggcgaaccagataggccgcgtgctgcggggcctgacgaaaatcgacactcagcccgatttcgtgaatcatacaggcactaagcagtagctcccgacagcgctggtctagcttccagctaacactcacctgacgaaaaaagctttccgccagctggcgtacccggtcggcctgacagacatcaatattgaaacggcgctgcacattttgcagcgtacggctgcgaatgtcgcgatcgacaggcagatgcagcataccgtacaccagaccttcgcgaagcgcgccaccggccagggtcatgctgtcaatgttgagttcctggaagatggcaataagaatggaaagcccactggggaacactaacgcgcgttccagcgtcaggccttcaatttcaagctcttcgagtttgccacactgaatagcgcgctgctttaactgttgcagcttgctcagggtgatgcgctcatccatgccctgggccaccatgatttcctggagggcctgaaccgttccagaagcaccaacgcaaacctcccaactctgtttacgcagttctgctgtaacaggttttagcatcgctttggctgcttcttctgcctggtcaaaattttctttagccaggtggcgatcgccaaagaaacgctccagccaggtgacacagcccatttgcaggctatacagcacattggcatgcgaaccatcgccagtggctaactctgtgctgccaccgccaatgtctaccaccaggcgttgatcagaacccccggtggtatgcgccacgccctgataaatcagacgcgcttcttcttcgccactaatcacattgatggcgcaacccagaatctgctgtgccttatcaaggaattcctgcgcattcgccgcgatacgcagcgtggcggttgctaccacccgaatctgatcggggggaatatcctgaagctgttcagagaaaagccgcagacattgccagccgcgagccatggcgtcggcggacagacaattcgatttatccaggccagcggccaggcgcaccttgcgtttgattttagcgatggtctgaatacttcccgacacttcgctgactaccagcatgtgaaagctgttagaacctaaatcaatggcagcatagagagtcgatgcgcttagcatggtcaacttaacccgaacgtttacggttgttatgacgtggtgcaccgcggcggccggtattgttgcctccacgacgctgaccgttgcctgaacgactacgcgtcagacgtttcggtggcggtaattcacttaacagcgcatcgctgttgtacttgctcaccgggatactgtgaccaatgtactcttcaatgccgggcagatttaacgcgtactcttcgcacgccaggctgatagagtgaccgcttgcgcccgcacggccagtacggccaatgcgatgaacatagtcttcgcggtcgtcaggcagatcgtagttaaacacgtgggtaacggcgggaatatgcaggccgcgtgctgccacatcagttgccaccaggatatcaatatcacctttcgtgaagtcatccaggatacgtaaacgtttcttctgcgccacgtcgccggtcagcaacccgacccgatggccgtctgcagccagatggccccagatgtcttcgcaacggtgcttggtgttagcgaaaatgattgccctgtcgggccactcttcttctaccagcgtctgcagcaagcgcattttctcttcgtttgacggatagaaaagctcttctttgatgcgatgaccggttttttgttcaggctcaacttcaacgtattcggcactgttcatgtgctcgaatgccagttcacgcacgcggtaagaaagcgtggcagagaaaagcatgctcaggcgttgggtcgcggcaggcatgcggcggaacaaccaacggatatcttttataaagccgagatcgaacatgcgatcggcttcgtccagcaccatgacctgaatggcaccaaggttgacgtgattctgcttggcatagtcaattaaacggccggtggtgcccaccagaatgtcgacaccttgttccagcacttttaactgtttgtcgtagccatcgccaccgtaagccagacctaatttaaggccggtcgatgccgccagaggttccgcatcggcgtgaatttgcactgcaagttcacgtgtcggtgccagaattaaggcgcgcggttggttaacctggcggccctctggagcagggtgagagagaagatgatgaaacgttgacgttaaaaacgccatcgttttgccggtaccggtttgcgcctgacctgcgacatcacgccctgaaagcgtaaatggcagtgctaacgcctggataggcgtgcagttataaaaccctttagtatcaagggcttccaccaccagagggtgcagggcgaagtcggaaaacttctgttcagttaagtgtgttttgctcatagtgtggtagaatatcagcttactatcgctttacgaaagcgtatccgatgaaataaagtcaaccaacattggtttatattacgccaattcgccaggcacaatcttgtggagtaaaacatgagcagcgataaaatcgttcatctgaccgatgacagtttcgacaccgacgtgctaaaagccgacggcgttacactggtagatttctgggctgaatggtgtggtccttgtaaaatgatcgcgcccatccttgatgaagttgcagaagagtatgatggcaaactgaccatcgctaagctgaatattgacgataacccaggtactgcgccgaaatacggcatccgcggtattcctacgctgctgctgtttaaaaacggtgaagtcgctgcaacgaaagtgggcgcattgtccaaaggtcaattaaaagagttcctgaacgccaacctggcgtaatcaggcagaacgtccggcagtggttaaatttttgcctgctgctggacgttcgctttcaagcgtgctaacttattttcactgcactatgaacataccttgtagttagcattcaaagttttctcttgttagaccctgtcatactgtacctaccagcggtttagcaatctaacgactagctctactctgactaagtcgaccgtctcctcgctcccagtcattattcaagacgatgatcgttgagaagagttgaaaaaagtcattaacagaacaggcatggattaactgccataccattcacgacaaacatttcgagtattaccccgagtttaagaacccatcaatatgaatcttaccgaattaaagaatacgccggtttctgagctgattaccctcggcgagaatatggggctggaaaatcaggctcgtatgcgcaagcaggacattattttctcaatcctgaagcagcacgcgaaaagcggcgaggacatcttcggtgatggtgtgctggagatattgcaggatggatttggattcctccgctctggagacagctcctacctcgccggtcctgatgatatctacgtttctcccagccaaattcgccgctttaacctccgcactggtgacaccatcgccggcaaaatccgtccacctaaagaaggtgaacgctactttgccctgctgaaagttaacgaagttaactacgacaaaccagagaactcgcgtaacaagattctgttcgaaaacctcacgccgctgcacgctaacagtcgtctgcgtatggagcggggtaatggctctactgaagacttaaccgctcgcgtactggatctggcgtcaccgattggtcgtggccagcgtggtttgattgtggcaccgccaaaagccggtaaaacgatgctgctgcagaacatcgcgcaaagcattgcctacaaccatcccgactgcgtgctgatggtgctgctgatcgatgaacgtccggaagaagtcaccgagatgcaacgcctggttaaaggtgaagttattgcttctaccttcgacgaaccggcttcgcgtcacgttcaggtggccgagatggtgatcgaaaaggccaagcgcctggttgaacataaaaaagacgtcatcattttactcgactccatcacgcgtctggcccgtgcctacaacaccgttgtcccggcttccggtaaagtcttaaccggtggtgtggacgccaacgccctgcatcgtcctaagcgtttcttcggtgcggcacgtaatgtggaagagggcggaagcctgaccatcattgccacggccctggtggatacgggttcgaagatggatgaagtgatttacgaagagtttaaaggtaccggtaacatggaactgcatctcgcgcgtaaaattgctgaaaaacgtgtcttcccggcgattgattacaaccgctccggtacacgtaaagaagagctgttaacctctcaggaagaactgcagaaaatgtggatcctgcgtaagatcattcatccaatgggtgaaatcgacgcgatggagttcctgattaacaagttggccatgaccaaaaccaacgatgaattcttcgacatgatgaagcgttcttgatcctttaaggcgtcatccaaccatgatggcgtttttttgctttaaatgatcataaaatagccctgacgccacgttctgacgtggcgtttttcatttccgggctataggattgaatcctggcaagcgtaataataatgacggtggaagtggtggacgtttaaccgttcgtgcacctcttcatgccgaattcggaatctggaacagtgatatgcgcgatctttagcgtattgtgagttccaggatgatagctgagagcgtttaacgtgaatttactcactatgagtactgagcttggtttagtttttatcttttccttggtgtttcttttccttgctcgcaaagtggccgaaaaaattggattggtagacaagccaaatcttcgaaagcgtcaccatggcgtcattccactcgttggcggaatctctgtttatgcaggaatctgtttcgccttcttcattacagattattacttgccgcacgctaagctttacctggcttgtgcgggggtactggtattcgttggtgcgcttgacgaccgattcgatatcagtgtgaaaattcgggcgacagtgcaaggtattgtggctttggtgatgatgttttgcgccaagctctatttgctgagtctgggatttattatcggtccggtcgagttaacagttggcccctttggttatgtcttgacactttttgcagtctgggcagctattaacgctttcaatatggtcgacggtattgacgggctcctgggcggcctttcaacggtgacgtttgcagcaatggggatcatcctttatctggatgggcagcacagcctcgcaatgtggtgctttgctatgatagctgccacgatgccctatattttactgaaccttggtttcctggggcggcgtttcaaagtgtttatgggcgatgccggcagcacgatgattggttttacgatcatctggattttgctggaaaccacccaggggttgagccatcccatcacaccggtcacagcattatggctgattgccattcctctgatggacatggtcgcgattatgtaccgccgattgcgtaaaggaatgagtcctttctccgctgatcgccagcatattcatcatttgataatgcgcgcgggttttactcctcgtcaggctttcgtattgattaccgctgctgctgctttgcttgcaggaatcggtgttttaggtgaataccttgcctttattcctgaatgggtgatgttgatactgttcctgatagccttcatggggtacggctattgtttgaaacatgcgtggcgtgtcgcgagaaaggtcaggcgatttaaacgccgcctaaataattttagtaatactaagaaaaatgaaccctgataagacttaacaaaggatgacgctctgatgcgcgctaacgttgtggagaacgaactggatattcgcggcctgggctgtcgcttatggcgtggaaaacgctggatagtcggctgtgcggtgctgtttgcattgatagcctggatagcgacgttactgatgaaacaggtctggagcaccaccgcgataacggggcggccaacggtgaatatgctgggttcctactattcccagcaacagtttctcaataatctggatatgcgcagtaacgcgctgacgttaaatagcccgttacctaccgtcatggacgacgtgtatcgggagttcctgatgcagctctcatcctgggatacccgccgggagttctggcagcaaaccgattattataaaagccgtaaaagcggcaacgcccataacgatgctgccctgctggacgatatgattgataacatccagtttacgcccgcggataccgcacgtaataccttcgacagcgtcaagttaaaagcagaaactgccagtgatgccaacaatctactgcgccagtatattgcctatgccagtgagcgcgctgcgcgccatcttaatgctgagttaaaaggcgcgtggcaagcgcgagagggtcaacttaaagcgcaggtcaaacgtcaggaagatgtcgctaatgccgtgtttcaacgtcggcaacatcgcctggaacaggcgctgaaaattgccagcgaacagggcattaacgaaaagcagacgcgcgaagtgagtgagaatcttgctgacagcgatctgtttttaatcggccaaccgttattgcagggacagttagaaaccctgcgcgccacggggccgagctttgacataagttacgatcaaaataaagcgatgctgacgacactggatgccggacccacactaaacaacaaattccagacttaccgttatttgcgtacgccggaagagccggtttcacgcgacagcccccgccgggtatttatgatggtgatgtggggcgcggtaggggcactggttggtgcgggcgtggcgctggcgcgtcgtcagcgcccgatgtcagatacacaagattgagagaaacagtgtgaaagttctgacagtttttggcacccgacctgaagccattaagatggcgccactcgtgcaagcgctggcgcaggaccctgcttttgaatcccggctgtgtgttaccgctcagcaccgtgaaatgctcgatcaggtactgagcttatttcagctgcagcctgactacgatctcaatgttatgcgacccgagcaggggttaacggaaataacctgccgtattttgcaagggatgcacaccgttctactcgacttcaagcccgacattgtgctggtccatggtgataccaccaccacgctcgcggccagtctggcggcgttctatcagcaaattcccgtgggtcacgttgaagccggtttacgcacgggcgatctggcatcgccatggccggaagaaggtaatcgtaagctgacaggtcatctggcccgtttgcattttacgcccacactgcgttcccgacagaacctgcttaatgaaaacctggccgacgacagcattgtggtaaccggcaatacggttattgatgccctgctgtgggtgcgtgatcgggtactggacgataacgagattaatgcgcaactgacggcacgttatccgtttcttgatgaaagcaaaaagctggttctggtcacaggtcatcgccgtgaaagttttggtgagggttttgaacgcatctgcagcgcgctggcccagattgcgcgtcagcatcctcatgcacaaatcgtctatccggtgcatctcaatcccaatgtgcatgaacctgttaaccgcattctgcgcggtattgacaatatcgtgctgattgaaccgcaggagtatttgccgtttgtctggttaatgaaccgggcctggctgatcctcaccgattctggcggtattcaggaagaggcgccctcgctgggtaaacccgttttggtgatgcgcgaaaccaccgagcgtccagaagctgtcgacgcgggaacggtaaagctggtgggcacggatacggcaaaaattgtttctgaagtcagtgcattacttaatgatgacgaggcctggcagaccatgagccgcgcccataatccctatggggatggcaatgcctgcgggcgaattttacaagctttaaaagataacagagccaacttatgagttttgaaaccatttccgttattggactgggttacattgggctgccaactgcagccgtttttgcctcaaagggaaagaaagtcgtgggcgtcgatattaatgctcacgccgttgataccatcaaccgtggtgctattcatattgtcgaacccgacttagatcaggtggttcaggctgcggtcgcgcgtggtgatttacgcgcaacgacgcaaccagaagcggcagatgcctttctgatcgccgtgcccacgccgtttatggcggaacgtcaacccgacttacgtttcgttcgcgctgccgccgcgtctgttgcgccggtactgaaaaaaggcgatctggttattctggaatcaacctctccggtgggcagtacagagcagatggccgactggctggcggcagcacgtcctgatttgcgttttccacagcacggcgatgatccggatattttcattgcctactgtcccgagcgcgttttgcccggccaggtcatggtggagttgatcagtaacgatcgcgtgattggcggcatgacgccggcctgttctgcccgcgcaagtgcgttgtatcgtatttttttacagggcgaatgcgtcgagacaagtgcccgtaccgctgaaatgtgcaagctgacagaaaacagcttccgcgatgtgaacatcgcctttgccaatgagctgtcactgatttgcgctgcgcagcagattaacgtctgggagcttattgccctggcgaaccgccatccacgcgtcaatatcctgcagccaggtcccggcgtcggcgggcactgcatcgccgttgatccctggtttattgtggcgcaaaaccctgacttagcgcgcctgatccgtaccgcccgcgaagtgaatgatgccaagccgcactgggtactggatcaggtaaaaaaggcgctggcagattgcctgatgcagaccggaaaacgtgccagcgatctgaccattgcctgcttcgggctggcgtttaaaccgaatattgatgacctgcgtgaaagcccggccatggaagtggtgcatctgattgccgactggcatcagggccgtacgtgggtgacagagccgcatattcagcagatccccgagagtttagcgacgcaggctaccttggtttcaacggcgcaggcgctgcaagaggctgatatcctggtgatgctggttgatcatcatgcgttccgccgtgttgaagctgcgcatattactcagcaatgggttgttgatacgaaaggtgtctggcgctaaaagaagccactggtcaacaaaggatccggttaacttatgtctgtccacctgaaggttaatccacttgcatgggagagccagttcttcggcatcgacaccgtaaggctggaaacagggggcgatctgccgcttgaacgcgcacttcagcatccctgtgcgttgtttcaaattaaagtgcctgccgaacaaaccgagatcattgatgccttaaatcagcaccagtttcatctggtggaaggtgaagtggatttgtcgttgacgatcaagcgcaccgaacggcagacaggtattcgcattgcacgggaaacacaaattgccgtactacgtgaagcggcctctgtggcttttcgtcaaagtcgttttcgcacgccgtggtttgcgccagaagacagtgcgcgtttctatgctcaatggatcgaaaatgcagtacgtggcaccttcgatcaccagtgcctggtggccagcgatgagagcggcgcgctgcaaggctttgtctcgttgcgtgaagtagaaggcgatgcgcgcattggcttgctggccgtggtgcccgaggcacaggggcaaagtattggtcagcgcctgatgctggctgcggctgactggggtcgcgcacgccagctagagcgcctgcgggttgcgacgcaaatcagtaatcttacggcgatgcgtctttatttacgctgtggcgcgcggctggaaagtacagcgtactggttttacaggagaggtcatgattccctttaatgagcccccggtcgtgggaagcgaaatcgactatatgcagtctgcaatgagcagcggcaagctgtgtggcgatggcggttatactcgccgttgtcagcagtggatggagcagcgcttcggtagtgcgaaagtattactcacgccttcctgtaccgcatcgctggaaatggcggcactgttgatcgacatccagcccggtgatgaagtcatcatgccgagttacacctttgtttcgaccgccaacgcctttgtattacgtggcgcgaaaattgtgtttgtggatgtgcgtcccgataccatgaacatggatgaaaccctgatcgaagcggccattacggataagacccgtgctatcgtgccggtccactatgcgggcgttgcctgcgaaatggacgtcattatggcactggcggcgcagtataagctgtttgttgttgaggatgctgcccagggggtgatgtcgcgttacaaagggcgggcattaggcacgattggccatatcggctgttttagcttccacgaaaccaagaattacaccgccggcggtgaaggtggtgcgacgctgattaatgatgccagcctggtggagcgtgcggaaattattcgcgaaaaaggcaccaatcgcagtcagttcttccgggggcaggtggataaatatacctggcgcgatatgggttccagctatctgatggctgacctacaggcggcttatctctgggcgcagctggagtcctctgaacgtattaaccagcagcgtttacgcctgtggcagcgttactacgatgccttaaagccgctggcggaaaaaggcgagctcacgctgccgtcgattccggccgaatgccagcataacgcgcatatgttctatatcaaactgcgcgatcagcaacatcgtcaggcgctgatcaactggcttaaagaagccgaaatcctggccgtatttcattatatccccttacacagctcacctgcgggcctgcgtttttcccgttttgccggtgacgaccgttttaccaccgccgagagtgagcgtttattacgtttgccgctgttttataacctgtcggataacaatcagagtaccgtgatcggttcgttgctgagctttttttcctgatgtcattagccaaagcatcggtatggaccgcctcatcaacgctggtaaaaattgtggctggcttgttggtggtcaagttactggccgtcagttttggcccggaaggggtgggccaggcgggtaactttcgccagttaatcaccgtactgggcgttctggccggtgctggtatctttaacggcgtcaccacgtatgttgcgcaatatcaacagcaacctcagcagctacgggcactcgtcggaaccgcctcgacaatggtgacgggcttctcctcgctgttggcgctggtgtttttgctggctgccgcgcccgtcagcaccgcgctgtttggtcacgatcgctatcaaaacgtgatacgtattgttgcctttctccagttcggtatcgcgtgggcaaacctgctgctggcattgataaaaggctaccgtgatgcacgcggtaatgcgttggccctgatttcaggcagcctgacgggcgtgctgggttacgtgctgtgttggtggctgggaggctatgcgggcgcattaaccggtctggcgctggtgccggcactactcgtttttcctgcgctggtgatactgaaacgccgtgtaccgcttccgttacgttggctgcggccaacatggcagccggaaatggcgcgtcatctggcaaaatataccctcatggcgttgatcaccgcagtcacactgccggttgcctgggtgatgatgcgaaatcaactggcggccagtaatggctgggctcaggtaggtttgtggcagggcgtaaccagtatctccgacgcttatctgcagtttatcaccgcaacgtttagcgtctggctcttaccaacgcttgccaggctagacaacaaacaggctattgcacgcgagatcgggcgggcgttacgctttgtgttaccggccgtcgcggtagccagcctgagcgtctggatcatgcgcgatattgctatcagcctgctgttttcggcggcgtttcacgacatgcgcgatctgtttgtctggcaactgtgcggcgatgtgttcaaagtgggtgcctacgttttcggctatttggtcatcgcgaaagcctcgttacgcttttacgtgctgaccgaaatcagccagtttattttgctgacgctgttctcacgctggcttattccgttacacggggcaagtggcgcagcgcaagcctatatgttcacttacgttacttatttcgcgctctgctgtggcgcatttattgtctactgtcgaaaaaaatgactttacttcatgtcctgggctccaacattccccatcacaatctcacggtattacgtttttttaatgacgtgatgagcaccgaactgcctgcggcagcgccgcgtcactttatggtggtgacgcagcagcctgaaagcctgaaaggttttgacgcactgcacattgaaacgtttagcagtaagaaagccctgtctgacgcggtgttactgcgagcgaaaaaccgcgagcaacgtttcttttgccatggacagtttaatccctggctgtggctggcattgctgagtggcaggttacgccgttctcagctttactggcatgtctggggcgcggacctgtatgaagattcgcgtagcctgcggtttcgtctgttctattttttgcgtcgtatcgcgcaggggcgcgttgcgcacctgtttgccacccagggcgacctgcaccattaccagcaacgccacaagtctgtaccgcactctttgctttatttccccacgaagttacccgctgcagcggtcacgccccatcctgacaagacttttaccgtgctgctgggcaattctggtgatgccagtaaccgccatattgaggggctgaaagcgattaaggcccagtttggtgaagatgttcgcattgaggtgccgctgggttatccccccggtaacgatgagtatatcgggcagattcagcgcgcggctgacaggctttttcctcaggggcaggtaaggttattacgtgacaaccttgcttttgatgactatctggcgctgttggggcgttgtcatttaggctattttatgttcgagcggcaacagggcgtgggaacgttgtgtttgttgattcaggctaatgtgccttttgtcctgacgcgtaaaaatccgttctggcgggatgttaccgcacagcagcttcctgtcttgttcagtgatgacgtgctgacgccggatcttgttgcagaggcgcgtcgacaattatcaggatgtgataaacagagcattgcttttctggccccaggctatctggcaggctggcgaacggcgttgcgcctttgcgaaggagagccctcatgagtcttatggcgtttagtggtctgttgatagtctatgtactgtcactggtgaccattgtgaccctgaatttacgcgagctaaagcaggcgcgatttaactttcacctgttttttactttattgtttctgctgaccttttacttcggtttcccgctaacctctgttctggtgtttcggtttgatacgcaggtggtttcggctgattttttactgcaggcgctgctttccgccacggcgttttatgctatctactttgtgagttacaaagtgcgcctcaggccgatagcggcaccgcccgccaggccctggctgcggatgaaccgggtagagacgcatctgacctgtggattactggcactggtcgcgatttctacggttacggtgttctttgcccataacggatttttgttgttccgcctcacggcctacaaccagattttttccagcgaagtgtctggcgtggcgctgaagcgattcttctatttcttcatcccggcgatgttgattccctatttcttacatcccacacgacgtaactggctgttgtttcttattgtcacggtaagctttggcttgctgacgtatgccctggtcggtggcacgcgcgccaatatcattatcgcctttgcgctgtttctgtttattggcattacgcgtggctggataacattgtggatgttggccgcggcgggcgtcatggcgattgccgggatgttctggctggcgttgcgtcgctacaacctggatgtcatgggtgatgaggctttttacaccttcctctacctgacgcgcgatacgttttcgccatgggaaaatctggctctgctgctggagaattaccataaaatagattttcagggcttagcgcctatgtggcgtgatttctacgtatttatcccatcatggctgtggcccgatcgtcccatggcggtcctgaacagcgccaactactttacctgggatgtgctgaataaccattccggtttggccatttcacccaccttaatcggttcgttactggttatgggcggcgtctgggcgattgtgccaggtgccgtggctgtcgggttaatcatcaaggcctttgataccttatatcagcgtggccgcgaggaatcgaatcgttacaccggtgcgattctgcagagtttttgttttggtgcggtgttcaacatgattgtgctggcgcgagaagggctggatgcgtttggatcgcgcgtggtgtttttctgtattatttttgccgcctgtttgggaatggcgaaattgcttttctggttactggatcatgtcggcctgattcgcagccgtagtgagcgggcgcttcatagcccatcctgattaacctctggtctttaagggaagaattaaaaagaaatgagcacggtttccgatacgccacgctatgtgattcgcggtattacgctttacgcttttaacagcatgactgcttttgtggatttcctgatgccgctgtcaggtattcggacaggaacgctggtggctatcaatgcggaaaaggtgctgaatgccgagcaggatgaggcgctgcgcgctcaaattgagcaggctgaattcaaataccccgacggcatcagcatcgtgcgctctgttcgcaagaaatatcctcacgcctcagtgcagcgcattgctggtgcagacctgtgggaagccttgatggagcgcgcgggccgcaatggaacgccagtgttcctgattgggggccggcagacggtactggatgaaacctgcgataaattacgtcgtcagtggaatgtgaatattgtcggtgctcaggatggctatttttcgcctgacgaacgggacgctctgtttgcccgcgttgcggcgagtggtgccagactggtgacggtggcgctgggttcgccacggcaggagcgtttaatggccgagtgtcggcatcactggcccgatgcgttatatatgggcgtaggcggcacttacgacgtgtttacggggcatgtaaagcgtgcgcccttaatctggcagaagcttggactggagtggctctatcgcttgattaagcaacccagccgcatacatagacagttaaagctggtgaaatatttgcgttatcactggcgtggtgatctctgagatcgctgattaatgccaggtttttagcacttgtgctggcgtaaatgcggtaattgtcgacgaaatgcacaaagcgtaatcaaacgcgctattttctttaaaaagcactagacaggatgggcgcttatctctagtatgcacatccgcaacggcgctacgcgcccgtagctcagctggatagagcgctgccctccggaggcagaggtctcaggttcgaatcctgtcgggcgcgccatttagtttgtgcgtaagagcttcggtggtttgagtaccgcgttagtaacaaagttttaaatgctgtgggtttgacttgcaacattcagtacagtggtggctatagctcagttggtagagccctggattgtgattccagttgtcgtgggttcgagtcccattagccaccccagattttgctgggatacgcgaaggtggcggaattggtagacgcgctagcttcaggtgttagtgtcttaacggacgtgagggttcaagtccctctcttcgcaccaggcaaaacaaaataaaaaatcggcgagtagcgcagcttggtagcgcaactggtttgggaccagtgggtcggaggttcgaatcctctctcgccgaccattttagaaacctgtcttttcagacaggttttttttcgtctgtgtaaaatgaggatgagcacctccgaaggccgtttgcgccgggcgaagcgagacaacgttgcgaaggcaacggcccgagtgcaacggcccaggggcgattgatatcttattaatcagtccctcagcgacaggcctctcaatggatcaactccggatcaagccataacacaaactgtcgcaaaaccgagacgcttaacgggttgttttataagtaattgacaggtctttactttgtatgtcgcttatttgcgacatccatgccgggttttgtcgttataacccgacggatatcacaaatctcaatcagcctgatcatttttttatttttaagtttatgatttttaagacaagataaaataaaatctgcaactggcatgaattatgcaataatcagagtgtagatgctcattccacctcttatgtctgcttaggctacataaacctgggaatgacgcagagccaatttgggtacctgttgtctgcctgcctgtatcgcgaaagtcttacagggttatcagacaccacgttgagtcgggtacctttcggttgtcaaaccgacctgatcttacacctgcttatggcaggtgttttttttgcctgaaataacggatgtaaaaaaaccgggctaacccggttttttatgtgatgcgctaaggtgctatcaatcaggcatcgggattgtttttcaacgtcagcaacaggccttcacggcgcatctttgccgcgtcttccgggcgacgcaggcgatcgtaaacatccgccagccaggcgtagtcaaatgcgtcagggcgctgagccagcgcctgctgaagtgattctgctgcctgctcccactcgccgtgacgcatcagcaactgccccagggtgctgtgcagtaaaggcgtggcaccatgttgtttgatttgctggcgtaaggctttttccagtgcttctggattgccgctcttgatacgaggcatcagcagtacaaggcggtcgtcgtaatgacgcttcagcccatccagcaaaatctcctgcgcggtgtcgtgatcgtcacactcaattaaatggtcaatcatcgccacctgcaatgctgtctcatgacgtgttttacggctcagattgccccaccagcgtttcaacccttcgctgccctgatcggccatcgcctggttcatcagtcccagccaggcttgctgctgtagcagggtgcgctgctcttcggttccgacctgtgatttttccatggcgggaagaatgtccagcagtgcgctccaggcgttggtgcgaacataagcctgctcagccagacgaagcacttccgggtgacgtggcgctacctcaagcaggcggtcgatactatggcgcgcggcatgatcttcatgacgagccaactgaatgcgggttcgggtaatctcaaccggaatcacgtcattgcctgccagttcagccgcgcgttcaagatgttggttggcccgcatctcatcgccacgctgctgtgcggcttccgccgctaacagatagttagccacggggacatcagcatgctcggcgtctttagacaggagtttttcaacctgcctgaaatcgccttctgccagcttaagcagggcattttgcgtatggcgctgggcacgacggcgcttacgaccggtgaaccagccgcgggtacgcgccccggtacggaaaagacggcgcagtatccattcaaccgccagaatcactaacaggctgataatcaggataatggccaggcctgtcacgctggtttcaacgttccagttgtcggtctgaatcagcacatagccctgatggcccgcgatcatcggccccagtacaatgccggcaatcagcaggacaaagaggataaataccttaagcatgattagcctccctgctggttagcggcggcagagggttgtgccatcaggttacgaacgcgggtttgcatcagcttatcaagcaacggctggctttccaggctgtccggcaggtccatattaatgttctgctggcttaattcatccaactgagccagaaacgctttcgtcgaggcatcattggtgtcataccatgcacgtacccatgcagagacggtttcgagcgattgcttgtaaatctcttcctgatggcgcggcacggcctgagctgcgatcagcaggcgagagcggatgttctcgcgcaggtaaacatcctgattcggtgccaacagcggctgcgccgtattatcgcggcgacggatggtaataaagtcatccataaaattatgccagcttttcaccaggttctgacgccattcacggatggaactggatagttcaccgctgtcgctgtccatgggcgcttcatcgctatcgttatccgccagacgcaggttatccacaccgtttgataactggttaagtttcagaatgatgccgtcataatccacctgagagagggaggaaagcgtactgatatcctgggtcaatgcacgacgaacgttcataacgctgggatcgttcatgtctgccaggctggcatcggcactttttagcagcgccgcagcggtagtcacatcctggtcgctccacaatttacgaccggccagcttcaccaggtaatccgcctgggccactaaccaactgcgtacgtcgttacctgatatggacgccatcttttcacgcaacgtttccagctctttcgccgaagcagcctgttgcgactgggcggtctccagcgttttctctgcggcattcaactgctgagtgagttgctgtttgtcgctgttcgcctgttgctgcagctttaccaactggtcgctcagatcctggttggtttgcgcctgccgttcggcctggtgtttatcgttcaggtataagcctgcgccaatcgccagtgcgatgacgatcgcgactgcacccagcaccatgccgccgttatgacgcttacgcggtgatttttcctgggtagaagaggggcgatcaaccgctggagtggtttcttcaaccacggcggaggtgtctttttgttccgtcatatctggcacatcccattgttaagttcaacataacgcgcgcagcagcgcatcgttatcggcaccatcggctacctgaatcgtctgccaaccaagattggcggccagggaagccaaacgttcgctgacgacaagcagtcgacagcggagcagccattcctcacgatcgacctcggggaacagcgaatacagctgatgcaacatctcaccgctggtcacaaccagcgtgtcaatattacgatcgcgccagcgacggccttcaatggcaccgtcatagtgtttttggcaacgttgatagcactccgcataggtgacctgtgcgccgcgtgctatcagtgtttctgccagcagctcgcgcccctggtttcctcgcaggataagcgcgtgcttacccgccatttgctgcagtgtcgccagttttatcaactcttcactggtttcatgcgcatgaggataggtcacctgcaaaccactgatcgtatgaaaagccaaagcggtactgcgaccaattgcataatagtctacgtcggcgggccatgcgttgatggcgtgctgtgcaaagtgaataacctgctgcgaaagcaggaacaccaggtcgccgcgtttcagtgtggcaagggctgccggtaactgctgcagatcgttacccggggcgaattcaatcagtggcaggctccacgcctgtttaccctgagcgtgcaggcgtgagaccagctcagccgctgcgggttccgggcgtgtcaccagaatggtcatacgggaggttgtccctggtaaacgtcgtgcagaatttcacgcgcgccgctgttgagcaactcgtctgccagcgaaatacccatctgttctgcctgatcgcgtggtccacggcgctcaccgctcaccacgacgctaccatcaggtgcgcccaccaggccgcgaagccagagttcgttaccttcaagcacggcaaagctgccgatgggaacctgacagccgccttcaagtcgggtattcatggcgcgttcggctttcacacagaccgccgtatcgtcatgattcaatgcctgtaacaatccaattaaggtgctgtcgtctagccgacattcaatcccgactgcgccctggcccacggccggcagagaaacgtccgcaggcagcggctggcgaatgcgatcggcaagccccaggcgattcagcccggcggcggcaagaataatggcgtcatattcgccggcatcaagcttgctcaatcgtgttcccacattaccgcgcagagagcgaatcaccaggtctggacgacgtgcgctaatctgacactgacgccgtaagctggacgtaccaataacggcaccctgtggcagcgcatctatcgacgcgtagtgattggagacaaacgcatcgcgcgggtcatcacgctggcaaatggtgaccaggcccagcccttccgggaacgccacgggtacatctttcatcgaatgcacggccagatcggcccggttttctaacatcgcctgctcaagctctttaacgaagagccctttaccgcccacttttgccagcggtgtatcaagaatgatgtcgccctttgtcaccatgggcaccaactccacgcgcaggccgggatgggcactgagcaaacgctgctgtacatattgtgcttgccacatggcaaggggactttgtcgtgtagcaattctgaaaattttgtttaacatgccgttaaccatttagatcgttcatcgaatatcctatcatcgttgagggaatgctgtcagtttcaacggattgaaaagaaccgcccgtagattaaacctgatatatcaggcagtaatctcaggctatgagcagagtgagcgaaaagtagacgaaaccgtgctaaaatgtcggtagcgtaactttctttacggtcaatccgacgagtgatagattgatcacgtttccagcaattatctgcacgacactcaattaataagtagcagatagcgggaacagggtttttaactccaggacaaccaggcgaaacgtcttgtacctctacattgagacactaaaacagagactggatgcaattaaccagctacgcgttgaccgcgctctggctgccatgggacccgcttttcagcgcgtctacagtctgcttccgatcttactacattatcaacatccgctgatgccgggttaccttgaaggtagcgttccccatggcatcaacgtcttcacgcctgatgaaaaccagctgcaactgctcgcggagttaacgggcgaacaggaactttccctggtcgaagcgccgaaaggcgagttgcccatcaccggtatctattcgatggggagcacctcctccgtcgggcaaaacagcgtgtccgatctggatatctgggtttgccatcaatcctggctggataacgaagaacgcctgaatctgcagcgtaaatgtgcgctgctgcaaaaatggtgtgcctcacaggccatcgaagtcagctttttcctgattgatgaaaaccgcttccgccacaatgaaagcggcagtcttggtggcgaagattgcggttctactcagcatattttgctgctggatgagttctatcgcacggcggtgagaatggccggtaaacgtattctgtggaatatggtgcctggcgaagaagagcatcattacgatgactatgtgatgtcgctctatgcgaaaggcgtactcaccccgaacgagtggctggatttgggcgggctcagcacgctgtcagccgaagagtatttcggtgccagcctgtggcagctgtataaaagtatcgattcgccctataaagcggtgctgaaaacgctgttgctggaagcctatagctgggaatacccggacaccaaactgctggcaatggatatcaaacagcgtttgcacgacggggagatcgtctgcttcggtcttgatccttactgtatgatgctggagcgcgtgacgcactacctcaccagcattgacgatcagccccgcctcgatttggtccgccgttgcttctacctgaaagtttgcgaaaaactgacgaccgaggagcaccagcagcgcagtggctggcgccgtgagattctgtcgcaactggttaaagcctggggatgggatgaggagaaactcgccattctggacaaccgcgcagaatggaaaatcgagcgcgtgcgtgaagcacacaatgaattgctggatgcgatgatgcaaagctatcgcaaccttattcgttttgcccgtcgcaacaatttaagcgtcagcgccagcccgcaggatatcggcgtgctgacccgtaaattgtacgccgcttttgaagcgctgcccggcaaggtgacgctggtcaatccgcaaatttcccccgatctttcggaacctaacctgacctttattcatgtgccacccggccgtgctaatcgcccgggttggtatctgtacaaccagtcgccggatatgagttcgatcatcagtcaccagccgctggaatataaccgctatcttaacaagctggtggcctgggcctggttcaatgggttactgaccagcaaaacgcgcctgcacatcaagggcaatgagctatgcgatttggcgcgtctgcaggaactggtggacgatgtttccagccatttcccgctgcgtctgcctgcgccaacgcctaaggcgctttacagcccgtgtgaaattcgccatctggccatcatcgttaaccttgagcacgatccgacctcggcgtttcgtaaccaggtggtgcacttcgatttccgcaagcttgatgtgttcagctttggccagcagcagcagtgtttgattggcagtatcgatctgctgtatcgcaactcatggaatgaagttcgtacactgcacttcagcggcgaacaggcgatgattgaagggctgaaaacgattcttggcaaaatgcatcaggatgcttcaccgcctgacaccgtggaggtgttctgttacagccagcatctccgtggattaatccgtacccgcgtgcagcagctggtgtcagaatgtattgaactgcgtctttccagtacgcgtcaggagcctgggcgcttcaaagctctgcgcatggccggccagacctggggactgttctttgaacgcatgggtgtgtcggttcagaagctggaaaatgccgttgagttttatggtgccatctccaacaacaagctccacggcctgtcgattaaggtcgagtcgaatcagacgccattgccgcctgtggtcaatggctacgccagcgaaggcatcatccagttcttttttgaggacaccaccgacgatcggggtttcaacatttatattctggatgaaagcaaccgtgttgaggtgtatcaccactgcgaaggcagtaaagaagagctggtgcgtgacgttagccgtttttactcctcgtcacacgatcgcttcacttacggctcaagttttatcaattttaacctgccgcagttctaccagatcgtgaacaccggcgaacgttatcaggtcattccattcagaaatcaggcactcaccgaactctgtgcctcgcagcctgataacgacaacaacgattatcagccgcgctatcaggtgcattgagttctacaggcccgctgtgacgctatctttagggcttgccacaacgctcacgtgatttgctggcatttcctgttgcttttccaccttcaactgcgatgataagcatccaggtcacaggatatgaagagcataaagaatgaagaaagtgataagcctgttagcgatgacaatggcactgacaagccttgcaggctgtggattgaaaggaccgctctacttcccaccgcaggacacgccaaaacaaactgcgccgacgccagcatcaacgcaaaaacagaaaaccgacgcgtctaaagcggatgtgggtggtctggtgacgggtgattcaagctcacaaatgaaataacacttatggcgcatccggcggagcaaaaaatgcagttctccaaaatgcacggtctcggcaatgactttatggttgtggacgccgtgacgcaaaacgtctttttctcgccggaattgatccgccggctgtccgatcgccatttggggattggcttcgatcagttactgattgttgaaccgccttacgatcccgatctcgactttcactatcgcatttttaacgctgatggcagcgaagtcgcgcagtgtggtaatggcgcacgctgctttgcccgttttgttcagttaaaagggctaaccaataaaagcgatattcgcgtgagcacccaggcggggcgcatggtgttaagcgttacgccggacgatctggtgcgcgtgaatatgggcgagcccaatttcgaaccccagcaggtgccttttcgcgccaataaagccgagaatctttatctgctacgcgtcgcggagcaaacggtgatgttcggtgccgtctctatgggcaatccacactgcgtgatccaggtggaaagcacgacaactgcccaggttgagcttttaggcccggttctggaaagccatgagcggttcccggagcgcgtcaacgttggctttatggaaatcattaatccggagcacatccggctgcgcgtctatgagcgcggtgcaggcgaaacgcaggcatgcggcagtggtgcctgcgcagcggtggcctgtggtatccagcagggtattttaagccagaaagtacgcgttgatttgccaggcggctcgttacatatcgcctggaaaggcgtcggacagccgctctatatgaccggcccggccacacatgtttacgatgggtttattcacttatgaaaaatatcgaagagcaggcggaaaatgctgtcctgctggacgatcaggccgtcagtgactatctgcgacagcatcctgacttctttatgcgcaatgcgcgtcaggtcgaacagatggcggtgccgcatccggttcgcggaagcgtatcgctggtggaatggcacatggcgcgccagcgcaaccacattcagcggctggaagaagagatcacgctgctgatggagcaggccaccgcgaaccagcagttattcgcgcgactgctctcgctgcaaagtcacctggccgccgccagctcattgcaggatatgcttaatcgcctgcaccgctgggcgcgcgatcttggccttgcgggcgctaatatccgcctgtttaatgaccggtggcggctgggcgcgccgtctgactttgtgcagcttggcctggcgcgtcaggctttcgaacctcttcgcattcagcgcttcggtaatgaacagcactatctgggcagtattaatggcccggaactgttgctgttgctgccgcaggcaaaagccattggttcagtggccatgtcgttgatgggtgacgacggtgagcttggcatcattatcttcagtagccgtgacagcctgcactatcagtcgggtatgggaactctactgctgcaacacctttcacagatgatgcctgcgttgctggaacgctgggtagagcgcgcatgagcagcgtgttgcaggaaaccgttgacggctttctgcgccacctgaaggttgaacgccagctcagccctcttaccctgagcagctacgcgcgtcagcttgccgcactggtgacgattgccgacgagatgaaaatcagcgcatggtcacagctcgatccggctatggtccgcagcatggccgcccgcagccggcgcgcaggtctggccgccagtagtctggcgctgcgtctgtccgcattgcgcagttttcttgactggcaggtgagccaggacatgttgcctgccaatccggcgaaagggatcgccacaccgcgcaatggccgccacctgccaaaaaatatcgacgttgatgatgtcagccagttgctggatattgaccttgatgatccgctggcaatacgcgatcgcaccatgctggaagtcatgtatggcgggggattacgtctttccgagctggtcaatatggattgtcgccatgtcgatcttgaggcgggcgaagtctgggtgacaggaaaaggcagcaaggagcgacgcgtgccgattggccgcaccgccgttagctggattcagcagtggttgccgctgcgtatcgcgtttaatcccgcagatgatgcgctgtttctctccagtcgcggctctcgtatctcggcgcgtaatgtgcaaaagcgttttgcagagtggggaattaagcagggcctgaccagccacattcatccccataagctgcgtcactcttttgccacccacttgctggagtcgagcggcgatctgcgtggcgtgcaggaattactgggccatgcgaatctctcgaccacacaaatttacacccatcttgattttcagcacctggcctcggtgtatgatgccgcccatccccgcgccaaacgaggaaagagtgaatgaagttttatcgccctctgcgtgacattaaagcaatcactttcgatttagatgacacgctttatgacaactatcctgtgattcgcaaaaccacagaagcatcccatgcggccctgcaggctttccatccggcactgcgtcacgttacgcctgacgacgtggccgaatcacgtaaacagctatgtttacgtgaacccgatatctaccatgatgtgtctgaatggcgtcgccgttcggtagaacatgttatgtgtcatgccggtttaacggcaaccgaagccgccaggggcgcggcgcaggtaatggatgtgtttcatcagtggcgcagccaggtggatatgccggctgaaacgcatcacacgctgaaagccctggcgaaaaaagtgccgctggtggccatcaccaacggcaatgcccagcctgaaaaactcggtctggcaaactacttccagttttcactgcgggcaggaccggatggacgcgccaagccgtggcaggatatgtatcagttggctgcgcaacgccttgatatcgccccagaatatattttgcacgtcggcgacgatctcactaccgatgtggctggcgcgattcgttttggcatgcaagcttgctggattaatctgcgtaagggcaacctgatgcacattgatgatgcccgcctgctgccacacgttgaaatttcacagttggcatcactgacctcgctgttataatggctgtaaatttatccagtcttatgcttcgcattttctgacttattggtgcttatggacgtttctgaactgctcgacggtttgaatgacaaacagcgcgatgccgttgcggccccgcgcagtaacctgctggtgctggcgggcgcgggcagcggaaaaacacgcgttctggtgcaccgtatcgcctggctattgtcggtagaaaactgttcgccgtactccattatggcggtgacctttaccaacaaggcggcggcagaaatgcgccaccgtatcgagcagctcattggcaccagccagggcggaatgtggatagggacgtttcatggcctggcacaccgtctgctgcgtgctcaccatcttgacgcgggtctgccgcaggatttccagatcctcgacagtgaagaccaactgcggttgctgaagcgcctgatcaaagcgatgaacctggatgagaagcagtggcctgcgcgccagggcatgtggtacatcaacggcaagaaagatgaaggtttgcggccaaagcatattgagagctatggcaatccggtagaacaaacctggctgcggatttatcaggcctatcaggaagcctgcgatcgcgccgggctggtcgactttgcagaactgctgctgcgggcgcatgagctgtggctaaacaaaccccacatcctgaatcactaccgcgagcgtttcactaacattctggtggatgaatttcaggataccaacaatattcagtatgcctggattcgcatgctggcgggcgacagcagcaaagtgatcatcgtcggtgatgacgatcagtccatttacggctggcgtggtgcgcaggtggaaaatatccagcgctttttgaaggattttcccggcgcggataccattcgtctggaacaaaactaccgctcgaccaacaacatcctgaagtctgcgaatgccctgatcgccaacaacagcggccgactggggaaagagctgtggaccgacggcagcgatggtgaacccatttctgtctactgtgcctttaatgagctggatgaatcacgctttgtcgtcaaccgcatcaaagcctggatggaaaacggcaatgcgctggcggattgcgccatcctgtatcgtagcaatgcccagtcgcgcgtgctggaagaggccctgctgcaggccagtatgccgtaccgtatttatggcggtatgcgctttttcgagcgtcaggaaatcaaagatgcgttggcctatctgcgactgatggctaaccgcaacgacgacgcggcctttgagcgagtcgtgaatacgccaacgcgtggtgtgggcgaccgcacgctggatgtggtacgtcagacagcacgcgaaaaacagatgaccttatggcaggcaacgcgtgagctgctccagtcgcgcgcccttgccggccgcgcggcctcagcgctgcagcgcttttgtgagctggtggattcactggcgagcgaaaccgcggagatgccgctgcatgtacagaccgacagagttatcaaggactctggcctgtggatcatgtacgagcaggaaaagggtgaaaagggccaggcccgtatcgaaaaccttgaggaactggtgacggccacgcgccagttcagctaccaggatgaagatgaagatctgatgccgctccaggcattcctgtcccatgcggcccttgaagccggggaagggcaggcggacaaatggcaggacgcggtccaactgatgacgctgcactctgcgaaagggctggagttcagccaggtgtttatcgtcggcatggaagagggcatgttcccgagccagatggcgctggatgaaggggggcgactggaagaagagcgtcgcctggcttacgtcggcgtcacgcgcgcgatgatgaagctcacgctgacctacgccgaaacccgccgtctctacggtaaagaagtctaccatcggccctcgcgttttattggcgagctgcccgaagcctgtatcgaagaagtgcgtttacgcgccagtgtaacgcgcccggtcagtcatcaacgcatgggcacgccgatgaccaaaagcgacacgggattctcgctggggcaacgggttcgtcacgccaagtttggtgaaggcactatcgttaatctggagggcagcggtgaacacagccgtctgcaggtggcgtttcaggggcaagggatcaagtggctggtggcagcctacgccaaactggaaaccgtctagtcgcgtgttgacgactttttcgtctcagcgtaacatgcgcgcactattatcatgagaggacaatgccttggacacgcccagtcgatgctggctcattaacctggttttcaggaataacatctaaggctatctcattacgctggtagccttagcggttatcagcgacctccctttttaatccgtcgcacgagtcagcactgatttatcctttatccgtgttcaggttcgcgggtctgaattcagaccggccgacagcgttgtcccataaagtctgcaatggggagtcttgctatgctgagcgcatttaaacttgataacagccgcctgacgcgtctggaactggaagatgaaagcgataaactgaccacgtcagtttgggttgacctggtcgagcctgaagaaggcgagcgcgatcgcgtgcaatccgaactgggccagagcctggcaacgcgccctgaactggaagacattgaagcctcggcgcgtttcttcgaagatgaagacggcctgcacattcactccttcttcttctttgaggatgccgaagatcacgctggcaactcaaccgttgcgtttaccatccgcgaagggcgtttatatacgctgcgcgaacgtgaactccccgcctttcgcctttaccgaatgcgcgcccgtaaccagacactgattgatggcaacgcttatgagctgctgcttgatctgttcgagacgaaaatcgaacagctggcagacgagattgaaaacatctacagcgctctggaaaagctcagccgcgtcatcatggaaggccagcagggtgaggaatacgaccaggcgttatcacgattagccgagctggaagatatcggctggaaggtgcgtttgtgtctgatggatacccagcgcgcacttaactttttggtccgtaaggcacgtttgccaggcaaccaactggagcaggcgcgtgaaattctgcgggatatcgagtcgctgttgccacacaatgagtcgctgttccagaaggtaaacttcctgatgcaggcagcgatgggctttatcaacattgagcagaaccgcatcatcaagatcttctcggtggtatccgtggttttcctgccgccaacgctggtggcatccagctacggcatgaactttgaatttatgcctgaactgaagtggagctttggctatcctggcgccatttgcctgatgatgcttgcaggtcttgcgccttatctctatttcaagcgtaaaaactggctttaatcatcagcacgggctgttaattcggcccatttagctggcctgtcgccttaattctgctaatctacccgctcaattttcataattgattgatttttttatggactctctttcgttgcgctggcagtggctgctgctgttagtgtcatctgtattactcggtgcgatcttccagtattttcacgtgcctgccgccctgctgctggggccgatgatcgttggcgtggtcatgggcctgtccggtgccacactgcgtattaataagcggttattcctgctgtcgcaggcggtactgggctgcatgattgcgcagagcctgtcaccttctatcctgacgccgctgttacaggactggcctgttgtgttagcggtactgctgctgacgctggcggccagtggcctgtcgggctttttgctggtgcgtttcagcccgcttcctggtcccacgggcgcgtgggggtcttcaccgggcggtgcctcagcgatggtggcgatggcgggcgaattcggtgccgacgtgcgtttggttgcttttatgcagtatctgcgtgtgctgtttgtcgcgggcgcggcggccatggtggcgcgtatcggcctgggcgacggcggtcatgcgggttcactgatatggtttcccgcgcttaatggcggttttctggtaacgatgtgcctggtcatctgcagcgcctggctggggccatggctgcgtattccgtccggggcattactgataccggcactgattggcgcgacgctgcattcaaccggcacggcagtgctgcagatgcctgaatggctgcttgcgctggcgtacgccttgattggctggagcgtggggttacgctttacccgaccgattttcaaactggcgttaagtacgttgccgcagatgctgttgtcaatttttggcctgatgttgctgtgcggtggactggcctggatgttaacccgcgttttgcatatcgatctgatgaccgcctatctcgccaccagtccgggtggactggacacggtggcgattattgctgccggaagccgggtagatatggcgtttgtgatggcgatgcagactctgcgcttgttcaccattcttctgaccggcccggcaatggcgcgctttatttcacgctttgcgcacacggctccgcgctgaaaatgccacggcatccagaataaagaccagcagcgccagccagataaacccaaaggtcaccattttatctggcgtaaccgtttcgccataaaacagcaccgccagcaggaacatcagcgttgggccaagatactgaaagaagcccaccgtggacaggcgcagtcgggtacaggctgccgcgaagaacatcagcggaatggtggtgacgatgcctgcggcgatcagcaacaggttcaggctcatggggttggcgctaaggtggctggtgctgctgtcggcaacgccaaacaggtagagtgcggccagcggaaacagccacagcgtttctatcagcatgccgctctgggcatcgacctgaattttctttctcattaagccgtagaacgcaaagctgaacgccaggcctaaagcaatcaccggcacagagccaaattgccacagttgcaaaagcacgccgaaggccgccagggccaccgccagccactgcagacgacgaaagcgttcacgcagaaaaatcatgccaaacacgacgttaatcaatgggttgataaaatagcccaggcttgcctccagcatgtgctggttgttcaccgcccagataaacagcagccagttcccccccaccgtgaccgccgtgagtgccagtagccacacttttttgggctggcgcagcacgctcctgacctggccccaactgcgactcagtgtgatcaataacagcatgaacagggctgaccagatcaccctgtgggtcatgatttcggtggcaggaacggccttgactactttgaagtaggcgggcgcaatgccccaaatgaaatacgcgccaagcgcaaaacctattccctgacgggtttgctgggtgtccataacatatcctgaaaattcgtcctgtaccggaggtcactaaggtgaagcggcgtgacagagggccgcaatattaccgcagtcttcgttatctctgtagccagatagggtgataaaacaggatcagtctttatccggctcaagggcgcgctggcgagcaagacaaatggcctgatgattgctgtctgcccactcaatcagttgctgcatgggtttgagaaatgaacggcctaaatccgtcaggctgtactcaacccgtggcggcacttccggatagagcgtccgcaggatataaccgtccatttccagccgtttcagactgcgcgacaggacctggcgggcaacatccccgatatgacggtgaagctcattgaaccgcagcgtctgctcggccagcgcctcaagaatcaataaactccatttatcacctatccggtcaagtacgtcacggatgggacaaggttgctcgtaagtaaaggttgcgggtaaagattttggcatcggtgagttcctgcgcagcgtcaatagtcacgttcacgtgactgggtcatcacaacgtgacttcttgttaaccatttttggcgaatgtaacatccacaacgtgaccagtctatttttgtgacctggtgtgatatcaaaacctgatggcgagtccggctcatctttggcggcctgtcaggactgactttcgggcgcgtaacggttagcgccataacaaatgcgcaaggagaataatgatgaccacctttctgaaaaacctgttgctggcggtaggtatcctgacagcgggcgcggtttacgccgcgcaacccggcgacggccgcgatctcaagacggaagaggctaatcgtgcattggtgctcaacttctatgatcaattttttaatcaccataatgtcgcagaagcggcccgggttgtggcggacgattaccgccagcacaatcccggattgcccaatggtaaggcaccgcttgttaactttttttccgattttttcaggaaaaacccgcagtcaaaagcacgcatcgtacgcagtgcaacggatggcgatctggtgtggctacatgtgcactcaaccaatggtaaaaacgatcgtggtcgggccgtgacggatattttccgggttaaaaaaggaaaaattgttgagcactgggatgtggttcaggaggtgcctgaaaaatcggctaatgcgaataccctgttctgatgcccagctgacgcagacgtggggcgccagcgcggcagccccacgttccttttccctgtcagcctgtcagataggttgccgtggcggtcgccaggtagtcaccctgctgattgtgtaattcaacccgtgcgacagagactttattcccggcgcgcagcaaacggctggtggcaataaaacgctcgccccgaccgggacgcagatagtcaacccgcatatcaatcgttcccatacgagccagccgctggcgcagcacctcctcgcgaatactttcatcacgcgtcaacgcatgactgacgcacaccatacctgctgccacatccagtacggcggcggtcacgccaccgtgcaggatctgctgagcggcattgccgaccagcatggttttgttcgtaaaactaatttcagcgcagtcggcgtcaaggcgatccagctccaggccgagagcctgattaaacggcatgtgataaataaaaatttcaccgaccaggcggcgagcttcctgctgagtcaatagcacggatgacatggtgtttagtcctgaatagctggcaaataaactgtagatgttaacaagttgtttattctatgcttcgctcgacaggctttccagtttaggaaatcagcgctgatgttcgctcacatttgtgtgtagaatgtcctgctttttaagacacccattcgcttttatgaatacgcagttttcaccggagaatcctatgcgtaagcatcgcgccttgctggcggcaatgttacttcctgctttggcgcaggcggacgaagccacgatcaaacacgttcacgacgcaccgcaggtgaggggcagcattattgccaatctgctggagcagcacgacaatccgtttgtgctttatccttacgaaaataactatctgctgtacacgtacaccagcgacatcaataaagaggcgatttcctcttataactgggcaaaaaacgcacgcaaagacgaagtgaaattccagctcagcctggcatttccgctatggcgcggcatcgtgggtgataactccgtgttagcggcgtcttacacgcagcgctcatggtggcaggtatcgaataaaaaagagtcgtcacctttccgggagacgaactacgagccacagattttcctgggctgggcgacagattactctctcgctggctggacgctgcgtgatgttgaagtgggcgttaatcatcagtccaatggtcgcagcgatccgacttcccgcagctggaaccgcgtttatacccgcctgatggcgcaaaacggtaatttcctggtggagatcaaaccctggttccgtatttctgaaagcgccagtacggatgataaccccgatattacgaaatacatgggctactaccgtgccaaagtgggttacgcgatgggtgacagcattttcagcgtggaaggcaactataactggaatagcggctatggcggcgctacgctgggctggagctacccgattactacgcacgtgcgtttctacacccagctgttcagcggctatggcgaatcccttattgactataaccaccgtcagacacgcttgggcgtaggtgtaacgcttaacgatttgttctaattaaccattaagtcaggaatacagtggcaacctcggcagttcttaatcaggaagcgttggctaagcaggtattgcaggatacttttggctaccagcagtttcgtcccggtcagcaggccattatcaatgaagcgctgagtgggcgggattgtctggtggtgatgccaaccggcggcggtaaatcactctgctatcagatcccggcgctggtgctcgaggggctgacgctggtggtgtcaccattaatctctctgatgaaagatcaggtagatcaactgctggcgaacggcgtggctgcagcctgtctgaattcgaccatgacgcgcgagcagcagcaggccgtgatggcggattgccgtaatgggcgcgttaagctgctttatattgcgccagaacgtctgatgatggacaacttccttgaaagcctggcgcactggcagccctgtatgcttgccgtggatgaggcgcactgtatttcgcagtgggggcacgatttccgtccggaatatggcgcgctgggtaagatgcgccagcgtttccccgatctgcctgtgatggccctgacggcgaccgctgacgaaacgacccgacttgatatcgttaacctgcttcatatgcaggacccactgattcaaatcagtagctttgaccgtccgaacattcgttacaccctggtggaaaagtttaagccgaccgatcagttgctgcgctacgtgcaggatcagcggggtaagtgcggcattatctactgtaacagccgggcaaaagtcgaagatacggcagcgcgtctgcaaagccgtggcctgagcgtcggggcatatcatgccggtattgatagcgcgcagcgcgccagcgtacaggaagcattccagcgcgacgatctgcaaatcgtggtggcgaccgtggcatttgggatgggcatcaacaagccgaatgtgcgttttgtggtgcacttcgatattccgcgcaatatagaatcttattatcaggaaacaggacgcgccggacgtgatggcctgcctgcggaagccatgatgctctacgatcctgctgatatggcctggctacgtaaatgccttgaagagaagcagcccggcccgttacaggatattgaacgtcataaactgaatgcgatgaatgcgtttgccgaagcgcagacctgtcgtcgtttggtgctgctgaactactttggtgaaggacgacagcaaccctgcggaaactgtgatatttgcctcgatccacctaaacgctatgacggcctggtggaggcccagaaggcgctttccagtatttatcgtgtcggccagcgttttggtatgggctacattgttgaagtattacgcggtgccaataatcaccgcatccgtgagcagggacacgacaagctgcccgtgtatgggctgggtaaagaaaacagccatgagcattgggtcagtgttttgcgtcagttaattcatctgggactggttacgcaaaacattgctatgcactccgcgctgcagctgacggaagccgcccgaccggtattacgcggtgaagtcccgctgatgctggcggtgccaagactgataaccgccagaccgaaaagcagcgggtcggcaaaagtctatggtggcaactatgaccgcaagctgtttgctaaactgcgcaagctgcgtaaagcgattgcggatgaagagaatattcctccctatgtagtattcaacgatgctacgttgctggagatggctgagcagatgccggtcagtgcgtctgaaatgttgagcgtgaatggggtaggtcatcgcaaactggaacgttttggtaagccctttttgctgatgattaaagaacatctcgatgaagagtaaagaggcgttatcatgttgatcttgttcagtaccattgccctggtccatcttgttgcgctgatgagccccggccccgatttcttttttgtctcgcaaaccgccgccagtcgttcgcgcaaagaagccatgctgggtgttttgggcattacgctggccgttatggtctgggctggggtggcattaatgggcctgcatctgattctgcaaaagatggcctggttacaccaaatcatcatggtcggtggcggactctatctgttatggatgggatggcagttaatcagctcagcgcgccagcgtcataagcagcccgtccagcaggaacctgtcgccgagctgtcaaagaaaggcagaagctttattaaaggcctgctgaccaacttgtctaacccgaaagcggtgatctactttggtagcgtcttctcattgtttatcggtaacgatatgggcgagctggaacgctgggggctgttcgtgctgataagtgtcgagacttttgcgtggttttctctggtcgctgctattttttccctgccgtggatgcgggataaatatcaacgtgctgccaagtgggtggatggcgtggcgggcgtgctgttcgctggttttggcattcacctgatcctgtcgcgctgataaccgattatcggtcacttcagcgccactgcggtaagccgccgacagggtcactgtcagcggcagcctcggcccggtcaggcgatacgtctggcgctggcgagcagtcccccaatcgcaatgaataagccgccgaaaatgcggttcatcagcttcatctgcttaggtcctttaatccatcctgcaatgcgcgtggctaacgtggcatagccaatcataaccacgatatccaccaggacggttgttacgcccagtaccagatactgcagcatgagtggctggtgaggcaggataaactggggaaacagcgccgccagaaacacaatgcttttcggattggtcaggttcaccatcaccgcccgtttgaacagacgacgacgcggcatggctttcgacatggcgttaaggtcaatagcgcccgcagtgcgccactgttggatgcccagccagaccagataacctgcaccagcccactttaaaatctcaaacgccagcagcgactgggaaaagagcgccccaagaccgatccccaccagggcgatatgcagtgcaagaccgacctgcaagccagaaatagacgcgaccgcgccacgataaccgtgactgatgccggtgctcatggtgttaatggcaccagagccgggcgaaaggctaagaattgtggtggtaagaagataggtcagccaccattcgatggtcatgggttgtactccctgtcgcgtctgaagtgtgacacaatacgccagaatgatgcgcagggctacgggcatcatgcggccgttcagactcttttttttcggcaaccaggagggcggatgaagcaacacagagcaagctggctgcaacgtgaacaggcgtttgccgcctttgctaccggcccattgcttgatttctggcacagccgtgaagagtgtgaatttaccggcgttgaaaatctgacgttacgttatgtccggttcatttcaccgaaacataagcgcgttattttgatcgtacccgggcgcattgagagctacgttaaataccccgagctggcttacgatctgttccactgcggatttgacgtgatcgtgctcgatcatcggggacagggacgatcggatcgcctgctggacgactctcatcgtggacatgtcgtggagttttcccactatgttgatgatctcgaaacgctttatctcaaagagattgtaagccgtcattatcagcagcgttatgcgttagcccattcgatgggtggggcgattctggccctgtttctggcgcgtcagcctggtgcgtttcacgctgcggcactggtcgcgccgatgtttggcattgctttgccgttaccctcttttctggcgcataaaatactcgactgggcggaaaaaaggcctgccgtgcgcgatggctatgcgttaggcacagggcgctggcgggcgcatccttttggcattaatcgcctgacacacagccatgagcgttatcggcgcagcctgcgtttttatgcggacgatccggccattcgtgttggcggacccacttatcactgggttcgggaaggcattcatgccggacgtaacatcttcagtcaggtggataaaatgactaccccgctgctgctgctgcaggccagcgaagacagcgtggtagataaccgctcacaagatcttttttgtaccgccatggcggcggcgggtcatccctgtgagggacgcaaaccccagatcattaaaggtgcgcgccacgagatcctgtttgaaaaagacagcatgcgtgctgaagcactcaatgcgatcgtcgatttctttttgtcgcatcattagtactccgtttacattaccggctacggccaaccgacacagatacccgaggttttcatgtaccacattgttgtgtccgacctggacggcacactgctttcccccgaacatcgcctcacgcctgatgcccgcgaaaccttgcaacagctggttgcacaaggcattcactttattttcgccacgggccgccatcatattgatgttgggcaaatgcgcgacaagctgggtattccggcgtatatgattacgtcaaacggcgcgcgcgtgcacaatcccgcaggagagctgatttttagccacaatctggatatggatattgcccaggatctgtttgggctgcagtaccatcatccggaagtgctgacgcacgtttatcgcgatgatgagtggtttgtcagccgttgcagcccggcagagaaagactattttcgcgaatccgatttccattatcaggtttatgaaccgggtatattgccgactgacggcatcagcaaagtctttttcacctgtgaagagcctgagcatctgattcctatggagctggcgattgaagcgcgctggggcgatcgcgttaacgtcagcttttcactgccgacctgtctggaggtgatggcgggcggtgtttctaaaggtcatgcgcttgaatccgtagcgaaacagttaggctttacgctgaaagactgtattgcctttggtgatggtatgaacgacgtagaaatgctgagtatggcaggcaagggctgcattatggctaacgcgcaccagcgtctgaaagataccctgccggagctggaagtgattggcagcaacgccgaggatgcggtgccggcaacgctaagaaagttgtatttatcgtagcgcgcctgcgcagaaggccggcgaaccggccttctgacggttacgccagtttttgtttgtgtttatgctcgctgaccatggtgagcagtaacaaaatcaccgccagcacacagcccacaatcatcaccatgaagccgccatcccagccaaaatagtccaccgtgtaacccacaatggcgctggctgcgaccgaaccgcccagataaccgaacaatccggtaaaaccggctgccgtcccggcggcttttttcggtgcgagttccagcgcatgtagccctatcagcatcaccggaccatagatcaaaaagccaatgattatcatgcaggccatatctacaccgggatttcctggcggattaagccagtaaaccaccgtcgcgatggtgaccagcgtcataaagaacacgcccgtcgctccacggtttccgcgaaagactttatctgacatccagccgcacaacagcgtgccgggaattcctgcatattcatagaagaagtaagcccacgatgacttatccagggtgaagtgtttcacctctttgaggtacgtcggcgaccagtccagaatgccgtaacgcagcagataaacaaacacgttcgccagggcgatataccacagtaatttgtttggcaggacatacttcatgaagatttgttttgcggtgaactcttcttcatggctcgcgttgtaatccgccggataatcgtctttataagcctcaacaggcggcaggccacaggactgtggcgtatctcgcatcagcgcaaaggccaggattgcaatggcaatcgcgccgaaggcgggcatataaagggccgctttccagtcgttaaaccacgccattcccagcaaaaacagcaggggaggaattcccccgccgacgttatgcgcacagttccacaccgacacaataccgccacgttctttttgcgaccaccagtgcaccatggtgcgtccgcagggcggccagcccattccctggaaccagccacagataaacagcaagacaaacatcaccataatgctggaggtcgcccagggaacaaaccccatgaacagcatcacgacagcggccagaatcaatccggcaggtaaaaaaacgcggggattagagcgatccgataccgaacccataatgaacttggaaaagccgtaagcgatagagatgcccgaaagcgcaaaccccagatcgccgcgcgagaagccctgttcaaccagataaggcatggccagggcaaaatttttcctgaccagatagtaagccgcatagccaaagaaaataccgatgaagatctgccaacgcaggcggcgatagaggggatcgacacgctcctctgccacctggggctggtgtggtgcaggtttaaaaatacttagcattatggtggccctccgggcgcattatggttttgattccccagcaggttgggtcgaaacataaaaaaaatggtgctcgcgatgcaccatttcgcgcagagaatagacagagacagtgctgtttactgtgatgaatgacaaatttgttacagttttattacagtaaagcgcgaaaatgccaggcagatgcgctttttcgcacatttttggcggcaacaggcgtggtgtgggaaggataatacaggcagagaaaaaggataacgcctgaatgcctggtaagtaaccagatgtcaaccagataaatcggctctgattcaggactttgtttacactgacgctctgtttatttcggggttgttaccgtgcttttattgatcgttactaccattctgtgggcattttcttttagcctgatcggtgagtaccttgccgggcaggtcgacagctggttttccgtattgatgcgcctggcgctggccgccattgtctttctgccgttcctgcgctggcgtggctaccggccttcaacgctcttgctctatatgctggtcgggatgctgcaactgggcattatgtatttactgagttttgaagcctatttgtatttgagcgtgtcagaattcctgctgtttaccgtgatgacgccgctctatgtcaccttgatctacgacctgataagtcgaaggcctctgcgcgtcggatacattttcagtgccttgctggccgttgcgggcgcggcgattattcgctacgacaaagtcagcgaaaacttctggtttggtctgctgttagtgcagttagccaatatctgcttcgcggccgggatggtgggctataagcgtttgcaggaaacccggccgatgccgcagcacacggcgttttcgtggttttatctgggcgcggtgctgatagctattattgcctgggcagcctggggcaatcccaacaaattacccacgacgacgctgcaatggggaatccttgtgtggttgggcgttgcggcgtcgggactgggttattttatgtggaactatggggcaacgcaggtcgatgccggcacgttgggcattatgaataacatgcacgttccggccggattgctggttaaccttgcgatatggcagcaaaaaccgcactggccaagctttatcgcaggtgccctcgtgattatggcgtcgctgtgggtacataagcgctgggtagtcggtaacagcgcgaaatagccgggctgaccttagcaggaaaaaaggtcagtgggggatgagaaggcgcgccgggcgcctcgtccggcgacggacgcctgatgcgctaaaggctgaacggcttatgcttactcgtgatgacatatttccgagccagcgacaggacacagcctctgcgcctcaggcaggaaagcaagcgggcacggatgtctgctttcccgaccgggtgaaataccatcgagctgcgttttaagcgggtttacctgtggcgggccgatgaatcatcgtcagccctttaaggaaattacgcagaatctggtcaccgcattcacggtaatttttatgatccggtttgcggaagatcgcgccaatctccgcctgagaaaccgtaaaattggccttttttagcacctcaggaatatccgtcgtttttaaatcaaacgcgatgcgcagctttttcatgaagatgttgttgttcatcttgcgctcaatggacggcgcgggcgcgtcttcacttttgccacggcgatgaaaaattaaaccgttaaggaaatatcccatcacaacatcggggcagggacggaatgccgcatcctcatctttcttcagccagctggtgatatcagcctgagcaacctcacattcagccagcgcaaaaatcgccaccattttggcatcgttcagatcgagcatatagcgcacgctgcgcagaatatcgttgttagtcatggtgagatcttctcatggtaaatcgacaggctgcgcattataggggattttgcctgctaccgtgcagctttgtcactcacgcgataaaaccttagcaggatgcgcggcgtccctgacgaacggcagatgctcgcaggcatgctgacgggcaaaacgcatgaaggcttccagtaccggctgacgctgttccccgtcgcgcacggcggcataaaggcggctccataagccgtcgcccagcgttttggtgatcaccagtccctgtttttcaaagctttctaccacccagtgcggcagtgccgcaattcccatgcgcgccgataccatctgaatcattaacagtgtgttatcgacgttcttaagtgcagggctgatgccagcgggttgcagaaagtgacgccagatatccagccgctggcgttgtaccggataaatcatcaggacttcatccgccagatcgtcaggggaaatatgttcaacctgtgccagaggatgatccggtgccagcaccagtcggacttcgaaatcgaacatcggggaatagaataagcctgaacgcggcaggatatccgaggttaatacaatatccagttccccctgctgcagggcaggctgcggatcaaaggtcacgccggatttaaaatccatcaccacctggggccagctctggcgaaacttatctaatgccggcgtaagccactggatacagctgtgacactcaatcgccacgcgcagggttgtctgatgcggctcatggcaggcctgaagtgcctgctgaatctgcggcagtatctgctctgccaactgcaataaaatttcgccctgcggcgtaaaacgcaatggctgacttttacggacaaacagacggaatcccagccgctgttccagatcgctgaactgatgtgataacgccgactgtgtctgatgaagctgagccgctgctgctgccagcgagcccgtgttctgcagagcctgaagcgtccggaggtgtttgaattcgatcatgagagtccttcacatcgaaactgaataatttgcgcttgaggaacatacagtacccgcagaatatagcggtgtaaacatctggacggctaaacatctttagcgacccgctaaagccgaagaatttctggagaatagtgaatgactatcctgaatcatactctcggttttccacgtattggcctgcgtcgtgagctaaaaaaagcacaagaaagttattgggctggcaacatcacgcaggaagaacttctggcggtgggtcgcgaactgcgcgcccgccactggcaacaacagaaagaggccggcgtcgatgtgctgccggtcggtgattttgcctggtacgatcacgttctgacgaccagcctgatgctgggcaatgtgcctgctcgccatcaaaacaacgatggctccgttgatctggatacgctgttccgcctgggccgtggtcgtgcaccgacgggtgagccggcggcagcggcggaaatgaccaaatggtttaacaccaactatcactacatcgtgccagaattcactcaagggcagtcgttttcgttaacctggactcaactgctggatgacgtggacgaggcgctggcgctgggtcatcacatcaagcccgtattgttaggcccggtaacctacctctggctggggaaagtaaaaggcgtgccgtttgatcgtctgtcactgctgaacgacattctgcccgtttatcagcagatcctggccgaactgaaaaagcgcaacatagagtgggtacagattgatgagcccgccctggcgctggaactgccgcaggcatggcgtgatgcgtttaaaccgacttacgctgcattacagggttatagcaaactgctgctcaccacctattttgacagcatcggtcagaacctggatgtcatcaggtcactgcccgtgcaaggcctgcatgtggatctggtgcagggcaaagatgacattcagcggttgaaccaacaactgcccgcagagtggctgctgtctgtcggtgtcatcaatggtcgtaacgtctggcgtgccgatctcagccactggtttgaacgcctgcagccgctggtgggctcacgcaagcacctgtggattggtacctcatgctcactgctgcacagccccatcgatctcagcgtagaaacccgtctggacgatgaagtgaaaagctggtttgcctttgcgttgcaaaaatgtcgtgagctgtcgctactgagcacggcgcttaatcacaacgatcccggctccctggtggagtggagcgcgccggttcaggcgcgcgctcactcaagccgcgttcacaatgcggctgttgcgcagcgtctggcaaacgttcaggccaaagatagcgcgcgcgccagtgcttaccccgagcgggccagagcacagcgccagcgtttgaatctgcccgcgtggccgaccactaccatcggctcctttccacaaacccccgaaatccgtggcctgcggctcgacttcaaaaaaggcgcaatagatagcgcgcattaccgtaccggtattgccggacacatcaagcaggcgattgttgaacaggagcgcctggggctggacgtgctggttcatggcgaggccgaacgcaacgatatggtggaatacttcggcgagaacctggatggcttcgtgtttacgcaaaatggttgggtacaaagctacggttcacgttgtgttaaaccgccggtgatcattggtgatgtcagccgtccggaagccattaccgtcgagtgggcgaggtatgctcagtcactcaccgataagccggtaaaaggcatgttgacgggtccggtaacgattctttgttggtcattcccgcgtgaggatgtgtcacgtgaaacgatcgccaaacagattgcgctggcgctgcgtgatgaagttgccgatctggaagccgccggtattggcatcattcagattgatgagcctgcactgcgtgaaggcttaccgctgcatcagtcagactgggccgactatctgcgctgggcggtagaggcgtttcggttaaacgccgccgtcgccaaagacgacacacagattcacacgcacatgtgttattgcgagtttaacgacatcatggcatccattgcggcactggatgcggacgtgattaccatcgaaacgtcgcgttctgatatggatttgctggatgcatttaacgcgttcgaatatccaaacgaaatcgggcccggtgtttacgatattcactcgcccaacgtacccgatgtcgagtggatagaaaatttgttacgtaaggcggcacaaagtattccagaagaacgtctgtgggtgaatccggactgcggcctgaaaacccgtggctggcgcgaaacccgacaggcactggctaacatggttaaagcggcaaaaaacctgcggggtgaaaccgcctgatttcctggtgttgtgtcaatacgttgtcagtatgttggggcgcttgcgcgcccctttttttgatcacgtcgcgggtgcaacgccgtattgcgtaaaccaggccaacatgcgcgcccagccatcggttgccgattctgcgtggtagctcggacgatagtcagcgttgaaagcatgtccggcatcgggataaacaataatctcagcgttggcattggccgcatgcagtgcctgacgcatctgctcgacgctttccagcggaatgccgtcatcctgaccaccgtataatcccagaaccggtgcgttcaaatcgacggcgatatcgatagggtgcttttgctgcttcatggttttttcgccaaccagacgaccataccaggccacggcggcgcgcagctgcgggttgtgcgcggcataaagccagctgatgcgtccgccccagcagaaaccggtaatccccatgcggcgaatatccccaccgttacgggcagcccagttcgctgcgtgatcgagatccgccagcacctgactgtcaggcactttgctgaccagctctttaaacagcgtcggaatgtcattgtagtcattcggatcgccttcacggaagtacagttctggcgcgaccgccagatagccttccagcgccagccgacgacagatatcgcggatgtgttcgtgaacgccaaaaatttcctgtaccaccagcaccaccggcaaaggaccgtctgctgactgtggtttcgcataaaaagccggcaggttttcgccctgactcggaatagaggtttcccccgaatggatggtggggctgtcggtaataatcgtggttgatgctgtgggctgaactgccggagcaaacgcgcctgcagctgatttttgtgtcatattatcgtcggtcttcatcattctctccgtgcaagcataggcgcaatcacgtaactatagcctggccacctgtgacaggttccagacagggagtaacagagtggttaaccaataaaattacacttctctttaacattcccgcgatagcttccacatcaccatatgtagcaatacacaaggcgatgaatggatgtgtgatattgatcaccctatttttcttagaaaatgtaactttcattttcttaagtgaatttagtcacatatttacctcgcccggtgacgtaaagtggcgtgaaaattttccttaacccggagtctgatatgacacagtctgacgttttccatcttggcctgaccaaagctgacctgcagggggcgacgctggccattgttcccggcgatcctgagcgcgtgaaaaagattgccgggctgatggaagatgcacagcacctggcttctcatcgtgaattcaccacctggctggctaagctggatggcaagccggttgtcgtgtgttccacagggattggcgggccttcgacatcaattgccgtcgaggagctggcgcagcttggcgtgcgtaccttcctgcgcgtgggcacaacgggggcgattcagccgcatatcaacgtgggggatgttctggtcacaacggcctcagtacgcctggacggggcaagcctgcatttcgcccccatggaattcccggcggtggcggatttcacctgtactacagcattggtggcggccgcagaagcctgtggtgccaaaacgcatatcggtattacggcctcctctgacaccttctatcccggtcaggaacgttacgataccttttccggtcgcgtcgttaatcgtttccagggatcgatgcaggagtggcagcagatgggcgtgctgaactacgagatggagtcggcgaccctgttaaccatgtgtgccagccaggggctgagagcgggaatggtggcgggcgtgatcgtcaaccgtacgcagaaagaaattccggatgccgtgacgatgaagcagacggaaagcgatgcggtgaaaatcgtggtagaagccgcgcgccgtttactgtaatcccctgttttaacaggcaggcgagtgatcaggcctgcctgtctcatcccagacagattgttgcgtcaccgcttccaacgccagtaaatatatctggacattcatacagtgcgaatttaccttttccctcattagtctgaccagcggggaaaatatggatcagcacatcattatcagcatctgcctggcgcttgtcggccttggtgtgggctggatactggcgcaaatgcgcgtcggccatcagttagccagcttttccacggaacgccgcttgctcaacgaggcacagcagcgtcagcaacagcaaatcgaacaacttcagcagcaggtgcagcagcgcgagcaggagttgaggcagcttcatggttcattaagtggggccagtgagcgcctgcaacagcttgattactggcgcaacgagagtgaacagctcacacgtgaactgcggaaccaactggaagtgaacagcgcccaggaagcggaactgcgtgaggtcacgattcgcctggaagaaacccgcttcgcagcggaagaaaaacagcgcctgctgacaaacagtgagcagcggctcagcgcgcagtttgaaaaccttgccaaccgaatttttgaaaacagtggacgtcgggtcgatgaacagaatcgacaaagcctgaacagcctgatagggccgctccgggaacagcttgatggttttcgtcgccaggtgaatgaaagctttggcgcggaagcccgtgagcggcacacgctgacccatgaaattcgtcagttacagcagttaaatgcccagatggctcaggaggcgcttaacctcactaaggcgctgaaaggcgacaacaaaattcagggcaactggggcgaagtggtactgagtcgggtactggaagcctcagggctgcgtgaaggctatgagtatgatattcaggtcagcatgcagaacgaacagcaaagtcgtatgcagcctgatgtgattgtccgcctgccgcagggaaaagatgtggttatcgacgccaaaatgacgctggtggcctacgagcgttattttaatgccgatgatgacgttgagcgtgaacaggccattcaggaacatgtcagcgccctgcgtgggcacattcgtctactgggccgcaaagattatcaacaattacccggtttacgctcactggattatgtgttgatgtttattccggttgaaccggccttcctgctggctattgatcgtcagccagaattaatcagtgaagcccttcagcagaacatcatgctggtcagcccgactacactgctggtggccctgcggacgattaacaatctctggcgctatgagcatcagagtcgtaatgcacagcgcattgcagagcgggcctcccggctgtatgacaaaatgcggctgtttgttgatgatatgagcgggattggccatagccttgataaggcgcagaacagctatcgcgaggcaatgaaaaagctggcagaagggcggggcaaccttatcgcacaggcggaaggctttcgcgatctgggcgtagaagtcaaacgcgccattaacccgcacctggtcgagcaagctatgcctgaaaatgagcacgacagcgcgccagatgacgagaaccatccagacgaacatcatgagcaggtccggcacctccgcgaataagcaggtcgccaacgtgcctgacctccatgactctgatacacttcggtaagtattgtttgtggagcaggtaaaaccgatggcagatgaatcacagcaggaaaccacccattttggctttcagacggtcgccaaaagcgagaaagccgacaaagtcgcggatgtgtttcactccgtagcggcaaaatatgacctgatgaacgatttgatgtcgtttggcgtccatcgagtctggaagcgttttaccattgacagcagcggcgtgcgccgtggccagcgtgtgctggacctggcgggcgggacaggcgatttaaccgcaaaattctcgcgcctggtgggcgaaaccggtcaggtcgttttggctgacattaacagctcaatgctgaagatgggccgggaaaagctgcgcaatctgggcgtggtaggtaacgtcagctatgtgcaggctaacgccgaggcactgccgttccctgataactattttgactgcatcactatctctttcggcctgcgtaacgtgactgaaaaagagaaggcgctggcgtcgatgttccgcgtgctgaagccgggtggacgtttgctggtgctggagttctccaaaccggttatcgaaccgctgagcaaagcttacgatgcctattccttccacgttctgccacgtatcgggcaactggtcgctcaggacgcggaaagctatcgttaccttgctgaatccattcgtatgcatcccgatcaggaaaccctgaaagcgatgatgaatgacgtaggatttgaaaacaccacctatttcaatatgacaggtggcatcgtggcgcttcatcgtgggttcaaattttaaccattatggcgatgaccttaacacccgtaatcaccgccggtattgagacggcgttaaaccgcatactgtatcgtgaccgtggcctgaaaagcgcacgccagcgccttgtcggtaaggtactgacgttacgtttaactgagttatcctggccgctggtgctggtatttagcgaacagcagctggacgtgctcagtgactggcaggacaagagtgactgcacggtcattacacagctcaaatccttgccaaaattacgcgatcgccagcagcttacgacgctgattcgcagcggtgagttacaggttgaaggtgacttgcaggtggttcagcacttttctgcgctaatggatctggccgagctggaccctgctgaataccttgccccctgggtcggtgacattgccgctcaggggatgagtcagggtgcacagcgtgcattgcgctttttcaaagcagaaacacaacggcgtcaggactaccttggtcaggcattaacagaagagtggcgggtggcgcctggtgcgctggaatttgcctggttctctgaggaggttagcgcgatggaacgttcgcttgaggcgcttgatgcgcgtctggcacagctggaggcgaaatgagttttggagagatccgccggttatattttattattaaggtgtttttgacgtacggccttgatgaactgattccacaaatgcgtctgacacttccactgcgactgtggcgccgctgtattttctggatccccaaccagcacaagcaagaactccttggcgtacgtttacgtatggccatggagcagttaggcccggtctggatcaagtttgggcagatgctgtcaacgcgtcgtgacctgtttccgccgctgattgccgatgaacttgcggtcctgcaggaccgcgttgccccctttgatggggtcaaggctaaagcgcagatcgaagcctcaatgggcgcaccgattgaatcctggtttgatgatttcgagattatcccactggcttcggcctctatcgctcaggttcatacggcaacgctaaaatccacaggtaaaaaagtcgtcatcaaggtcatccgtccggatatcctgccggtcattaaagcggacatgaagctcatttaccgcattgcccgctgggtgccccgtctgctgcccgatggccgccgtctgcgcccggttgaggtggttcgggattacgagaaaaccctgattgatgagttaaacctgttacgcgaagcggccaatgcgattcaactgcgacggaactttgaaaacagccgcatgctgtatgtgccggaggtttactcagactattgcagtgaaaccatgatggtgatggaacgcatttatggcattcctatctctgatgtggcaacgctggagcagcacggcgttaacatgaagctgttagcggagcgtggcgttcaggtgttctttacgcaggttttccgcgacagtttcttccatgccgacatgcaccccggcaatatctttgtcagctacgatcatcctgaagacccgcagtatattggtatcgactgcggcattgtcggatcgctcaataaagaagataagcgctatctggcagagaattttattgccttcttcaaccgtgattaccgcaaagtcgcggagctgcatgtcgactcgggctgggtgccagccgacaccaacgttgaagatttcgagtttgccatccgtaccgtgtgcgagcctatttttgagaaaccgctagcggaaatctcgtttggtcacgtgctgctgaacctgtttaacacagcgcgtcgctttaatatggaagtgcagccccagttggtgctgctgcaaaaaaccttactgtatgtcgaagggattggtcgccagctctatccgcaactggacttatggaaaacggcaaaaccgttccttgaggactggattaaggatcagatcggtattccggcgattatccgtgccgtgaaagaaaaagccccttactgggcagaaaaattgccagagctgccagagctgttttacgacagtttgcgtcagcataagcagctacgtctcagcgtggataaactcgcgaacgatataagtgtccaacgtacacgtcagcatcaggctcgttacctgtttggcgtaggtgcgacactgctgattagcggaacggcggtgctcctcagcaggcctgaatgggacctgttcccggcggcattaatggcggcgggctttgtcagctggttaattggctggcgtaagacaaactgattgtcacttgcgccagaaacacggtaatgtcgctgattcgggcccgaataaatacgggtttctgtagggcattacgccacagcgtttaacaaaaaaatcgaggctatctcatgggcggtattagtatttggcagctgttaattattgccgtgattgtggttcttctgttcggtaccaacaaattacgtaatctgggttcggatttaggttcttctatccgtggttttaagaaagccatgggcgatgaagacgataaaaaggatcaaccgaaagagcaggacgctgatttccatgccaaaacgctggcggataagcagccaacgtcggctcaaaaagacgaagtcaagaacgacaagcaggtgtaaaccgtgttcgatattggttttggtgaattggtattggtattcgtgatcgggctgatcgttcttggcccgcaacggcttccgcttgcggttaaaacggtcatgggctggatcagagcgattcgctcgctggccgccaacgttcaaagtgagctggcgcaagagctgaagctgcaggagttgcaggacagcctgaaaaaggtggaggaagccggtcggggcacgctgtcgcccgagcttaaagaatccatggaagagctgcgtaaaacggcggattcaatgaagcgctcagtaaagcagagcattgatattgaaagagacgaagacgaagccaataccattcattctccacaacatacatcgaccgctgatacgctgcacccggttactcccgcgaccagtgagcatcaggcgcaggcacctgtacaggcaccaccggcgacacctgaacctgttgcctctcaaccgactgacagccgtgctgagcccgcgccggttcagtcgtaccctgcacctgtacagtcaccagcggcgacacctgaacctgttgcttctcaaccgactgacagccgtgctgagcccgcgccggttcagtcgtatcctgcatctgggcacgccagtgctccggcacagtcaccagcgcgtgtcgatgcacaacctgcggttaagcccgaaagcgctgcgccgtcggcaagttcagtttctactccttctgcaagtgatgaacgataatggccgttgaagatacccaaccacttatcagccatctgattgagctgcgtaagcgtctgttgaactgtattggtgctgtgctggtcatctttctggccctgatctactttgctaacgacatctaccacgcggtggcatcgccgttgattaatcagatgcctgcgggtgccagcatgatcgcgactgatgtcgcgtcacccttttttaccccgattaagctgacgatgatcgtgtcggtgtttcttgccgtgccggttatcctctatcaggtctgggcctttgtcgcgccagccctttatcgtcatgaacgcaagttggtcatgccgttactgttctccagcaccctgctgttttacgttggcgtggcgtttgcctacttcatcgtctttccgctggcttttggcttcttcgctaaaacggctccgcagggcgtgaccatcgcaacagacatcaccaactatctcgatttcgtgatgacattgtttatggcatttggtgtggcgtttgaagtgccggttgcgattgtgctgctctgctggacgggcatcactaaccccgacgatttaaaaaagaaacgcccctatattttggttggtgcgtttgttgttgggatgttgctcacaccgccagatgttttttcccaaactttgctcgctattccgatgtactgcctgtttgaagtcggcgtattcttctcacgttactatgtggggaaaggccgtcaggcagaggatgaggaagataacgccgactcctgatgtcagatccagcatcccgcacaggcgggagagtcaagtcaaaaaccgccgccaggcggtttttgtttatggtgttaatgataaagagtggaaaaaatatgtttgatatcggtgtaaacctgaccagcacgcagttcgcctccgatcggaaaaaggtgatctcacgcgcgcgcgaagcgggcgtcaccggcatgttgattaccggcaccaacgcgcttgaaagtcagcaggcgcaaaaactggcagaggcccatcaggattattgctggtcaactgctggcgtgcatccacatcatgccagtgaatggtcagcggagattgcgagcacgttgcgccgcctggctgagaaaaaagaggtggtggcaatcggtgaatgcggactggatttcaatcgtaacctggccgctcaccagcagcaggagtatgcgtttgatgcgcagctggcgctggccgctgagctgaatatgcccgtgtttcttcactgtcgggaagcgcatgcgcgttttgccgccgtgcttgaaccctggttgcctaaactgcctgccgccgtcattcactgctttaccggcacgcgtgaagagttagcggcctgcctggaaatggggctgtcagtaggcattacgggttgggtatgcgatgagcgccgtggtatcgcgctgcgtgagatgttgccgctgattcccgccgatcgattattactggaaacggatgcgccctatctgctgccacgtgatatgcgcccccgtcctacatcaagacggaatgaaccctgctttttgccgcatatcctgcagcaggtcgcaatctggcgcggcgaagatgccgggacgttggcaaaacaggtggatcacaatgcgcgtaagctgtttaggctgatctaagctttgcggaactgccggttgtccacgctgcgtacgacctgtttgttcagcagattcaacaacaggattgagcgcgcttcgccatccggctctgaaaaaatcgcccgcaagccttcaaacgttccctcggtgatgatcacttcatcaccgttttgcggtgtttcgggatcgagcagcgtttgaggcacgtcggtttgtaacgcgtcaataaccacggcaggcacggtagccggcgtcgtaccaaagcggacaaaatggctgacgccacgcgtgctgcttatggttgtggtatgaatggcttccggatcaaactcaataaacagatagtttggaaacagcggttcactgacggtagttcgcttaccacgcacgattttctccagcgcgatcatcggactcaggcaatttacgtcttgccgctcaagatgctctttcgcacgcaatagctgcccacgtttgcaatagagtaaataccaggattccataactgctcccaatgaatggacgctaagaatagcaaacctccagccagagttatagcgcattggggggttggaaagcggcgttgcatggaaaataaactaagattgttctgaatggtgagtgccaccgcataaagtgaataactgtgaattattcgcaaccaacggggtaaaaattattgccgcaagccgcctgattgccgtcagtgacaggtaagggagaggatgcggtgcataaagctcaacacatcccccacaatcagccctataatgacccattcactctggccggaaagttgaagccgcatgaaatatcaggatttaagagactttattgcgctgcttgaacagcgtggtgaactgaagcgtatatcgcacgagatcgaccccgaactggaaatgacggaaattgcggaccgcaccttacgagcaggcggcccggcactgttgtttgaaaacccaaagggttacgacatgcccgtcctgtgtaacctgttcggtacgccaaagcgcgttgccatgggaatgggacaggaagaggtcagtgcactgcgtgaggtgggtgaactgctggccttcttaaaagagcctgagccgccgaaaggcttccgtgacctgttcagcaaaattccgcagtttaagcaggtgctgaatatgcccaccaaaaggttgcgcaatgcaccctgtcaggaagaggttttcagcggcgatgacgtcgatctgacgcggattcccgtcatgaaatgctggcccggcgatgcggctccgctgattacctgggggctcaccgtaacccgcgggccgcacaaagagcggcagaacctgggcatctatcgccagcaggttattggtaaaaaccgccttatcatgcgctggctttctcatcgcggcggcgcccttgattatctggagtggaccaacgcccacccaggcgagcgttttccggtctccgttgcgctgggcgccgatccggcaaccatccttggcgcggtgacgcccgtcccggacaccttgtcagaatatgcctttgcgggtctgctgcggggtaacaaaaccgaagtggttaaatgcatttccaacgatctggaagtgcctgccagcgcggaaatcgtgctggagggttatattgaacccggcgatatagccccagaaggtccttatggcgaccacactggttactataatgaagtcgacagcttcccggtttttaccgttacgcatattacgcagcggcatcagcctatttatcattcaacctacacaggacgtccgccagatgaacctgccgttctgggcgtggcgttaaatgaagtgctggtgcctattctggttaaacagtttccggaaatcgtcgacttctatttgccaccggaaggatgctcctaccgtctggcggtcgtcacgattaaaaaacagtatgccggtcatgccaagcgcgtgatgtttggcgtttggtcatttcttaggcagttcatgtacaccaaatttgttattgtgtgtgacgacgatgttaatgcccgggactggaacgacgttatctgggcaattactacgcgaatggacccggcgcgcgataccgtattggtggaaaacacgccaatcgattatcttgattttgcgtcaccggtttcaggactgggttccaagatgggcctggatgcgacaaataaatggccgggcgagacagaacgagagtggggcacgccgattgttaaagatccggcagtcactgcgcgtatcgacgctatctgggatgacctcggtattttgaacagccatcacagcgttgatggcgcgcaataaccataaagacgacccgacagagggaacgcatgacaacgttaagctgtaaagtaacttcagttgaagcgattaccgacacggtgtatcgcgttcgtctgattccggaggcggattttagctttcgtgcaggacagtatcttatggtagtgatggatgagcgtgataagcgcccgttttctgtagcctctacgccaatggaaaccgaaatcattgagctgcacatcggggcgtcggagctcaacctctatgcgatggccgtgatggaccgcatccagcaagacgggcaaatcgttgttgatattcctcacggcgatgcatggttacgtgaagagagtgacaaacccttgattttaattgcgggtggtacgggcttttcctatgcgcgctccattttgttgacggcgctctcacagaagcccgaccgtgatattgcgatctactggggcggccgtgaactgaaacacctgtacgatatggatgagctagacgcgctggctatcaagcatcctaatctcaaggtgattccggtggtggaacagcctgaagctggctggcaggggcgttcaggcaccgtattaacggcagtgatgcaggactttaccaccctgagtgagcatgagatctatatcgccgggcgctttgaaatggctaaaattgcccgcgatcgcttctgttcagagcgtggcgcagtcgaatcacagatgtatggcgatgcttttgcctttatctgatcgcacgcagaaagaaaaaacccgcccctgacaggcgggtcaatcccataataacgtcccaacgtatcaaacgcgttcaatcacggtggcgatgccctgacccaggccaatgcacattgatgccaggccaaactgcgcatcgcggcgttccataatgttcagcaacgtcgtactgatacgtgcgcctgagcagcccagcggatggcccaacgcgatagcaccgccatttaagttgaccttctcatccagtttgtctgacaggcccaaatccttaatgcagggcagaacctgtgcggcaaaggcttcattaagctcgaagatgtcaatgtcgttcacgctcagccccgcgcgcttcaaagccagcttgctggcgggtaccggaccgtaacccatgatcgagggatcgcagcccaccaccgccatacttttaatacgggcgcgtggtttcaggcccagttcccgtgcgcggctttcactcataatcagcatggcggctgccccatccgacagggctgaggatgtgcctgcagtgaccgtcccggtcacgggatcaaatgcaggtcgtagtgccgcaagcccttccaggctggtatcttcacggatcacttcgtcgaagtcgtagcgtttcagcacgccgtcggcgtcgtggccgtgtatcgcaacaatttcatttgcgaaatcgccgcgctgtgtcgcctgccaggcacgttgatgggagcgcaaagcgaatgcatcctgctgctcgcggctaatgtggtgcatgcgcgccagcatctctgcggttaatcccatcatccctgccgctttcgcaacagtgcgccctaagccgggatgaaaatcaacgccgtggctcatggggacatgtcccatgtgttcgacaccgccgatcagacaggcatgagcatcaccgaccataatggcgcgggcggcatcgtgtaacgcctgcattgacgagccacacaggcgattgactgtcgtagccgggacgacatgcgggatttctgccaacagcgcggcattgcgggcaatattgaaaccttgctccagcgtttgctgtacgcagccccagacaacgtcatccagcgttgctgcattgaccgccggctggcggcttagcagcgcccgcataacatgcgcagacaggtcttcagcacgcacgtggcggaaagcgccgcctttggaacgacccattggtgtacgcaccgcgtcaataatgactacattttccatttttattccctcaggcgcttctgaacgcggcttcatcaatcggtttgacggcgggataccagctttcatgttggcgcgctttttcggacaaaagggccggtagcgcatacagaccgcccagtgccgtatagcgtttcgcctggtccacgacgttactgttacccagcgtatcgagataacggaaagcccctccacggaatggtgggaatcccagaccatacaccagcgccatgtccgcctcggcaggggaggcaatgattttctcttcaaggcagcgaacaacttcattcagcatcggcagcatcatgcggttcataatctcttcgtcactaaaaatccgcttcggctgacaggcagcttcaagcaaggcatctacctcagcatcaggcacttttttgggcttcccttttttgtcttcttcccaacgccagaagcctttaccgtttttctgaccaaagcgttttgcttcaaacagaatatcgatagcatcgcgataatcctttttcattcgctgtgggaaaccatccgccataacgctctgggcgtgatgtgctgtatcaatccccaccacgtccagcagccaggaaggccccattggccagccaaactgcttttccatcacattatcgatctggcggaaatccgcgccgtctcgtagcaacatgccgaaggcagcaaaataagggaacaggacacggttaacgaagaagcccggacagtcattgaccacgatgggggttttgcccattttactggcccatgccacaactttccccagggtggcttcgctggtcttctcaccgcgaaccacttctaccagtggcatacgagggaccggattgaagaagtgcatcccacaaaagttttcaggacgttgcagcgcctgggccagctggctgatgggaatcgtagaggtattcgacgccaggatagcatcggcacgcatgtgtttctcagtctccgctaacacactggctttgatctgcgggttttccaccacggcttcaaccacaacatcggcctgatcaaacccggaataatccagcgtgggctggatggtcgcaatgacggcggccagcttattcccgtctatcttgcctcgttccagttgtttgttcagaagcttactggcttcattcatgcccagggtaagcgcctgcggattaatatccttcatcttgaccggcacgcctttccacgccgactgatagctgatgccgccacccataataccggcgcccagcacggctgcctgtttcggcgcgccgctttcactgctgcgttttttggccaggcccttgatgtactgatcgttgaggaaaatgcccacgagcgcgcgggccacgtcagactgtgccagaggaacaaacgctgccgtttcgagttttaacgcatcgtcacggcctaatgcggctgcggcttcaatcgtcttaacggcagtgatcggcgcgggataatgttttccggccgtttgcatgaccatgcctttagcgatcgtaaagctcattgcggcctcaacagggctcagctttaacggggctaatttaggggcgcgacgtgcccgccagctgccatcactggctgccgctttaagcatcgtcagcgcggcatcgcgcagtttatcagggctgacaaccgcatcgaccaggccaagcttcagtgcggctagaccgtcaatgtctttacctgccgcaatgatttccagcgcgctgtcagcgcctaacaggcgaggtaagcgaacactgccgccaaagcctggcataatgcccaacctggtttcgggtaagcctaagcgggcggttggtgtggcaacccgcaaatcggttgctaaaacgcattcacagccaccgcccagcgcgtagccatcgatcgcggcgatggtgggaaccggcaaatcttccaggcgattaaaaatgctgttggcgaaggtcagccactggctcagcttttccgttggcgcatcaaaaagcgccagaaattcggtaatgtcagcacccacgataaaggcgggtttggctgaacttagcagcacgccgcgcagatcggcatgttgctccagcacggcaatcgcttcgccgaggctggcgacggtttgtgtatccagcttattaacggagccgggggcatcaaacaccagctcgacgatgccatcatccaactggttaagagtgaggttagcgccttggtagagcatgtacgtctcctgaaaccgcgaaaggtgatctggtcataccagatgatcgtgagtttgggagtgatgttaatattttgcaaacaagtctttgtttatttgctaacaagatcacagctgcgctgaacccggcatccgcatttcggctgtgataaactgcggcttttctggatactggagaggcggcaatggattcattgaaaagcttgtatcacgcgcatatcactactttgcaacaacgtgctcagcaggtattagcacgtcataaactggatgcaatgctgatccattctggcgagttgctcaccgtgtttctggatgatcatacctatccgtttaaggttaacccgcaatttaagtcctgggtgcccgtgacacaggtaccaaactgttggttgtggattgatggcgtgaacaaaccgagattgtggttttattcgcccgtggactactggcacaacgttgaacctctcccgcacagtttctggaccgatgatattgagattgtcggcctggcaaacgcgaatgctgttggcgatctccttcctgcccagcgtgaaaacgtggcctatattggcccggtgcccgaacgcgcggcacagctgggtatcaacgcggggaatatcaatccaaaaggggtgatcgatttcctgcattatcaccgcagtattaaaaccgactacgaactcagctgtatgcgtcaggcgcaaaaaattgccgtggccgggcatcgtgcagcgaaagaggccttttcagctggcctgagtgagttcgatatcaatcaggcttacctgacggcaaccgggcatcgtgataccgatgtgccctatggcaatatcatcgctctgaatgaacatgccgccgtgctccactacaccaaactggatcatcaaccgccagctaaacgctacagtttcctgattgatgctggcgcggaatatcaaggctatgccgccgacctgacgcgcagttatgccgcacaaagcggaacgctgtatgccaaaatggttgaggcgatgaacgcggaagagctggctttgattgccacgctgaaagcgggcgtgcgctacaccgattatcatctgcaaatgcatcagcgtattgcgaaattgctgacgacgtttgatttggtccacggtataagtgaagaggcattggtcgccgacgatctgacgggcccttttatgccgcacggtttaggtcatccgctgggtttgcaggtgcatgacgtcgccggctttatgcatgatgaaagcggtacacatcttgctgcacctgcgcaatatccttacctacgctgtacccgggtgatccagccgggaatggtgttaaccattgaacccggcttctatattattgattcgctgctggacccgttgcgtgcaggtaaattcagttcgcattttaactggcaggcactggatgcgcttaagccttatggcggtatccgcattgaggacaacgtgattatccatgcgaaccgcgtcgaaaacatgacgcgcgatctgcaccttgcctgatggaggcttttgatattcctgctcaggctctgagcgtcagtgaagagacgatcaagaagagccggtttattacgctgctggctcacacctgtggcgtggaagcggcgcgtgcttttgtccagcaggtaaagcaggatcatcccactgcccgccatcattgctgggcctgggtagcgggtgcgcccaacgactcacagcagttgggcttttccgatgatggtgagccttccggtacggcaggtaaacccatgctggcgcagttaatgggtgccgatatcggagaaattaccgcagtggttgtgcgttactacggcggcatcatgttaggcacgggcggcctggtgaaagcgtatggtggcggcgttcagcaaggattaaaacagctggcgcgtcagcggaaagtgccggtaaagcagtttaccctgcaatgtgattacggccagttgagtgatattgagcgtttggtgcaacgctttgaaggcagcatcacagaaagtgagtatcttgagcgtatctttctgacactggcgctgccttatggacaaattaatggattcaagcaaaatctgtcagacttcagccggggtgcgttaacgcttcttccgcttacaccatgatgttcttctctttgattaaaggaacggcttaatgcactttcgcgccattacccgcattgtcggtctgttggtgatcctcttctcggtaacgatgattttacccggccttgttgcgctgatttatcgtgacggtgccggacgagccttcagccagacttttatgatggcgttggtgatcggttcgttactgtggtggccgaatcgtaagaagaaaacggagttgaaaccccgggaaggcttcctgattgttgtgctgttctggaccgtgctgggcagcgtcggtgccatgccgtttatcttcgccgagcagccgcatctttccgttacggacgccttttttgaatctttttccggcctgaccaccacaggcgcgaccacgctggtggggctggactccttgcccaaggccatcttgttttatcgccagatgttgcagtggcttggcggcatggggatcattgtgctggccgtggctatcctgccgattctgggcgtcggtggcatgcagttgtatcgtgctgaaatgcctggcccgttgaaagacaataaaatgcgcccgcgcattgcggaaacggccaagacgctctggctcatctatgtgttactgacagtcgcctgtgcgctggccctgtggtttgccgggatgcctgcctttgatgcaatcggccacagtttttccactatcgccattggcggtttttcaacgcacgatgccagtatcggctatttccagagtggaacgatcaacaccattgtggcggtgttcctgctgatctccggttgtaactacggcctacacttctcattactcagtaaccgcagcctgcgggcttactggcgcgatcctgagttccgtatgtttatcggggtgcaactgacgctggtgctgatttgcaccatcgtcttgtggctccacaatgtgtatgacagtggctggcaaacgctgaaccaggcctttttccaggtcgtatccatggcaaccactgcgggattcaccacagacagcattgcgcgctggccgctgtttctaccggtgttgctgttgtgttctgcatttattggtggctgtgcgggttctacgggcggcggtttaaaagtgattcgtattctgctgctgtgcaaacagggtaatcgcgaacttaagcgccttgtccatcccaatgcggtctacaccattaaactgggcaatcgcgcactgccggaacgtatccttgaagccgtatggggattcttttcggcatacgcgttggtgttcctgattagcatgttggcgattattgccaccggcgttgatgatttttctgcgtttgctgcggtcgccgcgacattaaacaatcttggcccaggtctgggcgtggtcgctgataacttcacctctatgaacgatgtagcaaagtggattttgatttctactatgctgtttggtcgccttgaggtattcacattgctggtgttattcacgccgaccttctggcgagaataaccaataaggatgcagatgatgaaagcgttaattctcttttcgacccgtgatggtcaaacgcaaaaaatagcttctgctatcgcagatgagatcaaggggcagcaatcttgcgatgtcatcaatatccaggatgcaaaggccattgactggcaacagtacgatcgggtgttgattggtgcttcaatccgctatggccatttccagccagtggtaagtgaatttgtgaagcataatctggctgcgttgcagcagcgcgtaagcggtttcttctccgttaacctgacggcgcgcaagccagagaagcgtacgcccgaaacgaatggttataccgtcaagttcttaacgcagtcgccctggcagcctgattgctgtgctgttttcgctggtgcgctctattatccccgctatcgctggtttgaccgtgtcatgattcagttaataatgcgcatgaccgggggggaaactgatgcgacgaaagaagtggaatataccgactggcagcaggtacagcgttttgccagggattttgcacagttaccaggcaaatcgtactgaaataacgcgatctggcgaaatttgagacgaacagtaatgtttttgcaattaacccttgtcaggccgcgcgaacgccctataatgcgcctccactgacacggcacaacggcttacggaatgcggtgttgagaggttcaggaaactgaaccgccggagaaaaacttctgaaaaagaagttgactctgaaggaggaaagcgtaatatacgccacctcgcgacagatggttaacccgctgttcgcactgctctttaacaatttatcagacaatctgtgtgggcactcgcaggattgatatcagcgtcctcggacgtaaaaaatatcaagtctcacgagtgaacacataatgaaattcattatgacgttttacagatgagcaccgctgaactggtttcagcaaatcaaacttaaattgaagagtttgatcatggctcagattgaacgctggcggcaggcctaacacatgcaagtcggacggtagcacagagagcttgctctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcattgtggttaataaccgcagtgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccactttgtgattcatgactggggtgaagtcgtaacaaggtaaccgtaggggaacctgcggttggatcacctccttacctgaagataccttcccgcgaagtgctcacacagattgtctgatagaaagtaacgagcagaaaaaacctctacaggcttgtagctcaggtggttagagcgcacccctgataagggtgaggtcggtggttcaagtccactcaggcctaccaaattcgtctcatgctgcgttatgtttccggctcgcatagttcactatgcttcgcgaaaacatgccttgcctgagcacgaattacatttctcatgaagtgtactcggttgagtggtagtagtggtctctgcagtaactgtatggggctatagctcagctgggagagcgcctgccttgcacgcaggaggtcagcggttcgatcccgcttagctccaccatactgatattactgtatttctgaaaaatacttcagagcgtaccggcgacggtgtgctgcgaagtattatgctctttaacaatccggaacaagctgaaaatttgaaacgacgcattgtcgtgttcctccgtaataaggaacacagcacaacgcgttcgagtctctcaaaagcttacagcttacaagctaactgttatgcagtagcgcgcgagcagtgaagaaagcaaggcgcgtcggcgcacagccagcggagcgtactgaagtacgtgagcatggcgagcaccgcgcaacgacgcattctttacgcgcagccgttacggtattacagataaacgcctgtgggttgtgaggttaagcgactaagcgtacacggtggatgccctggcagtcagaggcgatgaagggcgtgctaatctgcgataagcgccggtaaggtgatatgaaccgcaataaccggcgatacccgaatggggaaacccagtgtgactcgtcacactatcatgcagtgaatacatagctgcatgaggcgaaccgggggaactgaaacatctaagtaccccgaggaaaagaaatcaaccgagattcccccagtagcggcgagcgaacggggaggagcccagaaccatcatcagcttgtgcatcagtggaagcgtctggaaagtcgcagggtacagggtgatactcccgtacacaaaggtgcacaggctgtgagttcgatgagtaaggcgggacacgtggtatcctgtctgaatatggggggaccatcctccaaggctaaatactcctgactgaccgatagtgaaccagtaccgtgagggaaaggcgaaaagaaccccggcgaggggagtgaaacagaacctgaaaccgtgtacgtacaagcagtgggagccttctttatgggggtgactgcgtaccttttgtataatgggtcagcgacttatattctgtagcaaggttaaccgtataggggagccgcagggaaaccgagtcttaactgggcgttaagttgcagggtatagacccgaaacccggtgatctagccatgggcaggttgaaggttgggtaacactaactggaggaccgaaccgactaatgttgaaaaattagcggatgacctgtggctgggggtgaaaggccaatcaaaccgggagatagctggttctccccgaaagctatttaggtagcgcctcgtgaactcatctccgggggtagagcactgtttcggctagggggccatcccggcttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcacagacagccaggatgttggcttagaagcagccatcatttaaagaaagcgtaatagctcactggtcgagtcggcctgcgcggaagatgtaacggggctaaaccatgcaccgaagctgcggcagcgacactatgtgttgttgggtaggggagcgttctgtaagccgttgaaggtgtgctgtgaggcatgctggaggtatcagaagtgcgaatgctgacataagtaacgataaacaaggtgaaaaaccttgtcgccggaagaccaagggttcctgttcaacgttaatcggagcagggtgagtcgacccctaaggcgaggccgaaaggcgtagtcgatgggaaacaggttaatattcctgtacttggtgttactgcgaaggggggacggagaaggctatatcagccgggcgacggttgtcccggtttaagcgtgtaggtgtgtgttccaggcaaatccggttcactttacactgaggcgtgacgacgaggcactacggtgctgaagtgataaatgccctgcttccaggaaaagcctctaagcatcaggtaacacaaaatcgtaccccaaaccgacacaggtggtcaggtagagaataccaaggcgcttgagagaactcgggtgaaggaactaggcaaaatggtgccgtaacttcgggagaaggcacgctggcgcgtaggtgaagggacctgctccccgagccgaagccagtcgaagataccagctggctgcaactgtttattaaaaacacagcactgtgcaaacacgaaagtggacgtatacggtgtgacgcctgcccggtgccggaaggttaattgatggggttaagcgcaagctgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaaatcgctgtgaagatgcagtgtacccgcggcaagacggaaagaccccgtgaacctttactacagcttgacactgaacactgagccttgatgtgtaggataggtgggaggctttgaagcgtggacgccagtctgcgtggagccaaccttgaaataccaccctttaatgtttgatgttctaacgtaggcccgtgatccgggctgcggacagtgtctggtgggtagtttgactggggcggtctcctcctaaagagtaacggaggagcacgaaggttggctaatcctggtcggacatcaggaggttagtgcaatggcataagccagcttgactgcgagagtgacggctcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgctggagaattgaggggggttgctcctagtacgagaggaccggagtgaacgcaccgctggtgtccgggttgtcacgccagtggcactgcccggtagctaagtgcggaaaagataagtgctgaaagcatctaagcacgaaacttgccccgagatgagttctccctgaccctttaagggtcctgaagggacgttgaagacgacgacgttgataggccgggtgtgtaagcgcagcgatgcgttgagcttaccggtactaatgacccgtgaggcttaaccttacaacgccagaggcgttttggttgagagacgaattaaattttcagcattgtttaccggaaaagaatttgcggaaacgacagattttgcggcatgagaaggcgcagagcgatgacgtcagcgggagcatactgaagtatgtgaccgttgcggcagagcgaatgcaacgcgttcatggcgtaaaagagtcgtttcgtgcacaaagaatttgcctggcggctgtagcgcggtggtcccacctgaccccatgccgaactcagaagtgaaacgccgtagcgccgatggtagtgtggggtctccccatgcgagagtagggaactgccaggcatcaaacaagtgaagaagccctgaacgaaagttcagggcttttttacgtccgtaacctgcggaaagcgggtcttcaagatcgctcctcctgctttattgccttctgcacacagccattcttatcctcatatgtgacacaaccgcaaaatcatcctgtattagcctgcttgtacgctctattcccgctgctattgagattattcaagagcaacagcatcccagaaagccattcaccgcacgcaatttcccccgcattatcgttgtgatgcggtaaactacggccagattaaccagttaaggccgtctcatgtccagttcgaacacctcattaaaagccgacaacacgctggggcttgatgtcagcgcaaaaacacgcattgtcgccgaaacgactgaagcgatactttcagcctggcaaatgagccagcacaatcagcaaccttttttggtccttggggaaggcagcaacgtgctgttccttgaagacttcgcgggcattgtcgtgatcaaccgtatcaaaggggttgagatccgcgatgagaatgagagctggaaactgcatgttggggcgggtgagaactggcatcaactggtgaaaactacgctggagaaagggatttcaggcctggaaaaccttgcgctcattcctggaatggtgggatcagcacctatccagaatattggcgcttatggggtagagttaaaagatgtatgtgagtacgtcgacgtgctgaatttgcataccggcatcacgcaacgcctgagccgggaggcgtgccagtttggttaccgtgacagtattttcaaacaccagtaccagtcaggctatacgattattgccgtcggtttctcattaaaaaaacactggcagcccgtcctcacctatggtgatttaaaaacgctaaatcctgcgacggcaaatgcctgggatgtcttccatgcggtctgccatatgcgacagagtaaattaccggatccgaaaataaccggtaacgtgggcagtttttttaaaaacccggtgataacaggtccgcaggccgctgcgttgctgaatgagtacccgacgatgccaaattaccctcagtctacaggtgatattaaacttgcagcaggctggcttatcgatcaatgccagctcaaaggctaccggattggcggtgcggaagttcaccagcagcaggctttagtgctaatcaatgctggaaatgccacacctgatgacattgtcgctctggcaaaaagcgtgcgcgcacacgtaggtgaaaaatttaatgtctggctggagccagaagtccgtttcattaaggcacaaggtgaatgcaacgctgtagaggtaatctcatgaaggatcacagcgtaccattgaaattaatcgatatcctggcagatggcgaatttcactctggtgagcagctaggagaaacgcttggcatgagccgtgcggcgattaataagcatattcaaacgctgaaaagttggggccttgacgtgtataccgtgacgggtaaaggctacagtttccctgcaccgcttcagttactgaatgaacaagagattcttgctcagctgtcccagcctgatattgcagtcataccagtgattgattcaacgaatcagtatttactcgaacgcatgaattcactgccctcaggatcggtctgtgttgctgaatatcagcaagcagggcgaggacgacgtgggcggcactggttttcgccttttggtgccaacctctatatgtctatgtactggcgtctggaccagggaccggcagctgcaatggggctcagtctggtgattggtatcattatggcagagaccctgcggtcgctgggtgcccaagacgtacgggtgaaatggcccaacgatatttaccttaatgacagaaagttagcaggtattttagtcgaattaaccggtaaaaccggcgatgccgctcatattgtcattggtgccggaataaatctggcgatgagaaatgccgaagcagcccagattaatcagggctggattaatttgcaggaagctggcgtaaccattaatcgtaacgagcttgcggcaaaactgatcaatcgcctgcgtgaagcattacccgtatttgagcaggagggcttagtcccctttgtcgcgcgctgggctgaactggataacttcattaatcgcccggtgaaattactgattggcgaacgagaagtgcacggcatcgctcgcggtattgataaccagggtggtttgcggcttgaacaagacgggataattaaatcgtgggtcgggggagaaatatcgcttcgaccgctttgaggaataaataaagcctgctttttagcaggctttatataccgttgactattttctgagacgcagcttttctaccgcatggttcccgcttttagtcataatcaaactggccctttcacgtgtaggaagaatattttccttaaggttcaaccagttaatttctttccacaacgcgccggcaatgttcacagcctcgtcctcaggcaactgagcatagtggtgaaaataagagttgggatcggtaaaagcgccctgacgaaatttcagaaaacgattcacataccagcgctgtaatagatcttcttccgcatctacgtagattgaaaaatccacaaaatcagagacaaaaacatgatgcggatcatgaggataatccatgccactctgcagcacatttaatccttccagaatcagaatgtcaggttgcttaaccaccttgtcaccatccggaatcacatcataaattaaatgggaatagacgggagccgtgacctggctggcccctgacttaaggtcagaaacaaatttaaccagccgatgcatatcataggattgaggaaagccttttttcttcattaagccgcgttctttaagcacagcgttgggatgaagaaaaccatctgtcgtaatgagctcaaccttacggtgtccgggccagcggctcagaagcgcctgtaaaacacgggcggtagtacttttgccaaccgcgacgctgcctgcaatgctgatgatatagggaattttttgcccattcgttcccagaaactgttccagcacggcctggcggcggacatttgaactgatatagaaattaagtaaacgtgagagtggcagatagatttctgccacttcttcaattgaaagatcttcattgatccctttcaattgggcgatctcatcctctgacagcgtcatgggaaccgagtcgcgtaatgccgcccactgttcacgtgtgaactgtaaataaggcgtggtgagtgatgtcgttttatccataagtatacatttgactgcagattcaaacccatctgtacattttgccgatcactatccgggtagtgtagagaaatgaattgccggtcacagggttattaacgagaacaatgggctggagggtatcaccagtatagcttttaaaagaagtaaaaaataaacagtaaactgctttcgcaaggctcaccgcagattttgataaatcttcaatgtaggggcttgaaatctttaatcgttatgcttttttatcctcgttgaggcatcagccacttctcaagtaaaaaaagcagtaaccgtcattacgtctggatagccatatattgaggatatgccgcacattgacatcgggtcttgtagaaataattagcacccatgttgataccacagtgcagtagtcgtactcagcatgctgtctgaaagccgcaccaggcacataaaccatgtgctgccacgccttctctggcgttaagacatccccgctggaggtggtccccgcttcccctgtcacctgtgaagcccttacaggctatcagaacgctgcaccgggcacgtacactatggactgccacatcttctctggcgttaagcgcattgacgctgtatatggtctctgcttcccctgtcgcgttgtgcacgtcccaacaggctgtctgaaagctgcaccaggtacataaacgatgtgctgccacgtcttactctggcgttaagcgcattcccgctgggttgttctctcagcgtctcctgtcacgccagtttgtccacacaggctctctgtcagctgccatgatgcgtcaggcacatgcacaggggctttctctataaggttaagcacatcctcgcgacttgtgtctcggcatctcctgtcgcgctaagcatgttcacacaggcttattatctgtcactgtaggattacgggttgtctcccaccttcctctgtcacatcacacttccccgaaggagcggtctgcatctctccatctaaggcggatcatcatgacaagcagtgaccggtgaaggattttttaggggtgcagctcgtgctgaggcttgtgtgaccgtacgatttaaattgaagcgcggtttagtcggttgaaaactgagcagttaatacacttttttgctgagtaagccaaaaaacgtgatgcagccggacaagtaaaggggcaataccctgcagggcgcaaaaaggcaagggcgagagtgaagagaaattttgaccagtaattgggtgttatttctgcagatcggggataaattgcgatgctttgcacaaatagtaagcgatagaacaaaaacagtgatttttttgttgcatccttctgccgaccttcctagaatgcgcgtcacttgatgccggcttagctcagttggtagagcaactgacttgtaatcagtaggtcaccagttcgattccggtagccggcaccatcaagtaggtgggattcccgagcggccaaagggagcagactgtaaatctgccgtcacagacttcgaaggttcgaatccttctcccaccaccatctcaacccccgggttgagaaacagataaacaacctgtttgtctggcaggtgagtcacttcttctcaccctgaattcagattgggtgtaagctcagtcaaagccagtcagctccgctgacaggcaaagaataataggggacttcccctgttattcacaagctacagaaagaacaggtagccgagttccaggatgcgggcatcgtataatggctattacctcagccttccaagctgatgatgcgggttcgattcccgctgcccgctccagatgtgctgatatggctcagttggtagagcgcacccttggtaagggtgaggtccccagttcgactctgggtatcagcaccacttcctttatctccctcctgatttttctctgtaactccttgcagtcaggcaatgcctggttaatgtgactatatctttgatatatccgtgtcttagagggactagcgatggctaaagagcaatttcaacgtaacaaactgcacgtaaacgtgggaaccatcggtcacgttgaccacggtaaaaccaccctgactgcagctatcaccaccgttctggctaaaaccaacggtggtcaggcgcgtgcgttcgaccagatcgacagcaccccggaagaaaaagcacgtggtatcaccatcaacactgcacacgttgagtatgaaaccccgtctcgccactatgcgcacgttgactgcccaggccacgccgactatgtgaaaaacatgatcaccggtgctgcgcagatggacggcgcgatcctggttgttgctgcgactgacggcccaatgccgcagacccgtgagcacatcctgctgggtcgtcaggtaggcgttccttacatcatcgtgttcctgaacaagtgtgacatggttgatgacgaagagctgctggaactggttgagatggaagtccgtgacctgctgtcacagtacgacttcccgggcgacgatactccaatcgttcgcggttcagctctgaaagcgctggaaggcaacccagagtgggaagagaaaatcgttgagctggctggtcacctggataactacatcccggacccggtacgtgcaatcgatatgccattcctgctgccaatcgaagacgtattctcaatctctggtcgtggtaccgttgtgaccggtcgtgtagagcgcggcatcgttaaagtcggcgacgaagttgaaatcgtgggtatcaaagatactgcgaaatcaacctgtaccggcgttgaaatgttccgcaaactgctggaccagggtcaggcaggcgaaaactgtggtgttctgctgcgcggtatcaagcgtgaagacatccagcgtggtcaggtactggctaagccgggctcaatcaagccacacaccaagtttgagtcagaagtctacgttctgtctaaagacgaaggtggccgccatactccgttcttcaagggctaccgtccacagttctacttccgtaccacagacgtgaccggttcagtagagctgccagaaggcgttgagatggtcatgccgggcgacaacatcaaaatggttgttaccctgattcacccaatcgcaatggacgaaggtctgcgcttcgccatccgcgaaggcggccgtaccgttggcgcgggcgttgttgccaaagttatcgcttaattaccgataatatttgacgcaatgcacgtggaaagggcatcatttgatgccctttttgtacgctgttacatagaacctgactcatcagtgattgtgaaccataatcattgctgagacaggctctgttatgtggcgctggataccgagttacgccccaaaagctcattcggtttggatgcctcgcaatgcggggcagaatagtttctgaattattgtggcaggttggtttatgagtgcgaataccgaagctcaagggagcgggcgcggcctcgaagcgctgaagtgggtagtggtagtcttattactgcttgcggcgatcgtaggtaactacctctatcgcgatgtgacgctgcctttgcgcgcgttggctgtagtagtcctgattgcggcagcaggcggcattgcgcttttgacgacgaaaggcaaagcaaccgtggcctttgcacgtgaagcaagaaccgaaatgcgtaaagttatctggccaacccgccaggaaacactgcataccacgttaatcgttgccgcggttactgccgtgatgtcactgattttgtgggggctggatggtattctggtccgtctggtatcgtttatcactggcctgaggttctgagatgtctgaagctccaaagaaacgctggtacgtcgtgcaggcgttttccggttttgaaggccgcgtagcacagtcgctgcgtgagcacatcaaattgcacaacatggaagagctgtttggcgacgtcatggttcctacagaagaagttgttgagatccgtggtggtcaacgccgtaaaagcgagcgcaaattcttccccggctacgtattggtacagatggtgatgaatgacgccagctggcacctggtacgcagtgttccgcgcgttatgggctttattggcggtacatccgatcgcccggcgcctattagcgataaagaagttgatgcgattatgaaccgcctgcagcaggtgggtgataagccgcgtccaaaaacgctgttcgagccaggcgaaatggtacgtgtcaacgatggtccatttgccgactttaacggtgtggtagaagatgtggattatgagaagagtcgtttgaccgtttctgtgtccatcttcggacgtgcaacaccagtagaactcgacttcggtcaggtagagaaaggctaacctttcccgacttacaatttggctgttgcagcaggcgcgaaatttaactataatttcgcgccttttgtttttatgcgctggcaacagcgtataaatcgttaccacggggagccttctacaggcgctataacccaattgaggaattatcatggctaagaaagtacaagcctacgtcaagctgcaggttgcagctggtatggcgaacccaagtccaccggttggtccagctctgggtcagcagggtgttaacatcatggaattctgtaaagcgtttaacgcgaagaccgaatctctggaaaaaggtctgccaacacctgttgttatcaccgtatacagcgaccgttcttttacctttattaccaaaacgcctccggctgccgttctgctgaaaaaagcagcaggcatcaagtcaggttctggtaagccgaataaagataaagtcggtaaagtgactcgtgctcaggtacgtgaaatcgcagaaactaaagctgcggacatgacgggttccgacgttgaagcgatgactcgctcaatcgaaggtactgctcgttccatgggcctggttgtagaggactaagaaatggcaaagctgaccaagcgcatgagcgtaattcgcgacaaagtagacgcgaccaagcagtacgatattgctgaagcaatcgctttactgaaagaactggctaccgctaagttcgtagaaagcgttgacgttgccgttaacctcggcatcgatgcacgtaaatctgatcagaacgtgcgcggcgcgactgttctgccacacggtactggtcgttcagtacgtgtagctgtcttcacccaaggcgcaaacgctgaagctgctaaagcagctggcgctgagctggtaggtatggaagacctggccgatcagatcaagaaaggcgaaatgaattttgacgttgtgattgcatctccagatgcaatgcgcgttgttggccagttaggccagattctgggtccacgtggcctgatgccaaacccgaaagtgggtactgtaacgcctaacgttgctgaagcggttaagaacgctaaagcaggtcaggttcgttatcgtaacgacaaaaacggcatcatccacactaccatcggtaaagtggacttcgatgctgacaaattgaaagaaaacctggaatctctgctggttgcgctgaaaaaagccaaacctgctcaggcgaaaggcgtgtacatcaagaaagttagcatctctaccaccatgggcgcgggcgtttccgttgaccaggctggtctgactgccgtagcaaactaatttctacttgaaacgggcgaaaaattcacctagaatcttacgcccgttgttctgcattcgtgcagacgtagaagtgcgtgattcagattgcggtaagacggtggctgagtcggctacccggagcatggtcaactgtgcaacggaagcggataaagacagtcggcgcaatagcaatttgagtggcgacacgcgacccaaattttaggttggagccaggccttatcctggcctccgtccaagaccgcaggagcggcacatcctcggatgtaatgcttaataccctgcgtagacggtgacagaaccaaaagatatttttcttaactggattctgctcaccgtgtaatagcgcttattttcctccgggcgagtaagtgaagtgagttccggggaaatccttccccggtcaaatccaggagctaaagctaatggcattaaatcttcaagacaaacaagcgattgttgctgaagtcagcgaagtagccaaaggtgcgctttcagcggttgttgcggattctcgtggcgttaccgttgataaaatgaccgaactgcgtaaagcaggtcgtgaagctggcgtttacatgcgtgttgttcgtaacaccctgctgcgccgcgtcgttgaaggtactcagttcgagtgcctgaaagacacgtttgttggtccgaccctgattgcatattctatggaacacccgggcgctgctgctcgtctgttcaaagatttcgcgaaagcgaatgcaaaattcgaggtcaaagctgcagcctttgaaggtgagctgatcacggcggccaatattgaccgtctggcaactctgccgacctacgaagaagcactggcacgtctgatgtcgaccatgaaagaagccgctgccggcaaactggttcgcactctggctgctgttcgcgatgcaaaagaagcggcttaaggcctctcttttcttcgtacttgctaacgtataaactttttctgattcttaggaacaattgttatgtctattactaaagaccaaattctggaagccgttgccgctatgtccgtaatggaagtagttgagctggtttctgctatggaagaaaaattcggcgtttctgctgctgctgctgtagctgttgctgctggcccagctgaagctgttgaagagaaaactgaattcgacgtcgttctgaaagctgttggcgcgaacaaagttgcagttatcaaagccgtacgtaccgcaactggtctgggcctgaaagaagccaaagatctggttgaagcaactggcgtgatcaaagaaggcatcagcaaagatgacgcagctgcacttgaagctgctctgaaagaagctggcgctgaagttgaagttaagtaagacaaccctcgggttgcagtctgagtagtttcagactgatggctggtggctttttggtcaccagcctttttgcgctccagggcctcaatggggtttcacactgtttgtccattgttgctcttcaatatctttctctatcgacgacttaatatactgctttcccgtgcgggttccctgcccacgctgaagcaatgaaatgatttaagcgtgatagaaagaggtattgcacacactgcaaagcagtaggtgaatcaaacaaaatcgtgttgcatgaactgtcctgtcaggacggacagcgtgggtcgacttgtcagctagctgaggaaccctatggtttactcctataccgagaaaaaacgtattcgtaaggattttggtaaacgtccacaagttttggacataccttatctcctttccatccagcttgattcgtttcagaagtttatcgagcaagatccagaaggtcagtacggactggaagctgcattccgctctgtattccctatcgcgagctacagcggcaattctgagttgcagtatgtcagctatcgcttaggtgaacctgtctttgacgtgaaagagtgtcagatccgtggcgtgacctactcggcaccgctgcgcgtgaaactgcgtctggtgatctatgagcgcgaagcgccagaaggcactgtaaaagacattaaagaacaagaagtctacatgggtgaaattccgctcatgactgacaacggtacctttgttatcaacggtactgaacgtgttatcgtttctcagctgcatcgtagtcctggcgtgttctttgacagcgataagggtaaaacccactcatcgggtaaagtgctgtataacgcacgtatcatcccttaccgtggttcatggctcgacttcgagtttgacccgaaagacaacctcttcgtccgtattgaccgtcgtcgtaagctgccggccagtatcattctgcgcgcactgcattacaccactgctcaaatcctcgacgtcttcttcgagaaagtggtgtacgaaatccgtgacaacaagctgcagatggaactggtgccagagcgcctgcgcggtgaaaccgcgactttcgatattgaatcgaatggcacggtctacgttgagaaagggcgtcgcatcactgcgcgtcatattcgtcagctggaaaaagacgctatccaacacatcgaagtgcctgttgaatacatcgcgggcaaagtggttgctaaagactacatcgatgagaacaccggtgagctgatcgtcgcggcgaatatggaactgtcgctggatctgctggcgaagctgagccagtctggtcacaagcgcattgaaacgctgttcaccaacgatctggatcacggcccttacatctccgagacgctgcgcgttgacccaaccaatgaccgcctgagcgcgctggttgagatctaccgcatgatgcgtcctggtgagccgccaacgcgtgaagctgcagagaacctgtttgagaacctgttcttctctgaagatcgttacgatctttctgcagtcggccgcatgaagtttaaccgttcgttgctgcgtgatgaaatcgaaggttcaggtatcctgagcaaagaagacatcattgaagtgatgaaaaaactgatcgacatccgtaacggtaaaggcgaagtggacgatatcgaccacctcggtaaccgtcgtattcgttcagtcggtgaaatggctgagaaccagttccgtgtcggtctggtacgtgttgagcgtgcagtgaaagagcgtctttctctgggcgatctcgatacgctgatgccacaggacatgatcaacgccaagccaatttcggcggcggtgaaagagttctttggttccagccagctgtctcagtttatggatcagaacaacccgttgtcagagattacgcacaagcgtcgtatctctgctctcggcccgggtggtttaacccgtgagcgtgccggcttcgaagtgcgtgacgtacacccaacgcactacggtcgtgtctgcccaatcgaaacccctgaaggtccgaacatcggtctgatcaactccttgtctgtgtacgcgcagacgaacgagtacggtttcctggaaacgccttatcgtcgcgttattgacggtgtggtttccgatgaaattcattacctttctgcaatcgaagaaggtaactacgttatcgctcaggcgaacaccaatctgtcagaagaaggtgcgttcgttgatgacctggtcacctgccgtagcaaaggcgaatcaagtctgttcagccgcgatcaggttgactacatggacgtttccacccagcaggtggtttctgtcggtgcgtcactgatcccgttcctggaacacgatgacgccaaccgcgccctgatgggtgcgaacatgcaacgtcaggccgttcctactctgcgtgctgataagccgctggtaggtaccggtatggagcgtgctgtagccgttgactcaggtgttaccgcggttgcgaaacgtggcggtaccgttcagtacgttgatgcatctcgtatcgttatcaaagtaaacgaagacgaaatgtatccgggcgaagcgggtatcgacatctacaacctgaccaaatacacccgttctaaccagaacacctgtatcaaccagatgccatgtgtatctctgggtgagccagttgaacgtggtgatgtgctggctgacggcccatccaccgatctcggtgagctggcgctcggtcagaacatgcgcgtcgcgttcatgccgtggaatggttacaacttcgaagactccatcttagtctccgaacgcgtggttcaggaagatcgcttcactaccatccacattcaggaactggcatgtgtgtctcgtgacaccaagctggggccagaagagattaccgctgatatcccgaacgtgggcgaagctgcactctctaaactggatgagtccggtattgtttacatcggtgctgaagtgaccggcggtgacattctggtgggcaaagtgacgccgaaaggcgaaacccagctgacaccagaagaaaaactgttgcgtgcgatcttcggtgaaaaagcgtctgacgttaaagattcttctctgcgtgtacctaacggtgtttccggtacggttatcgacgttcaggtcttcacccgcgatggcgtggaaaaagacaaacgtgcgctggaaatcgaagagatgcagctgaagcaggctaagaaagacctgtctgaagagctgcagatcctggaagcgggcctgtttagccgtatccagtctgttctgatttcgggtggcgttgaagcagacaaactggacaagctgccgcgtgagcgttggctggaactgggtctgactgacgaagccaagcaaaaccagctggaacagctggccgagcagtacgacgaactgaagcacgagtttgagaaaaaactcgaaggcaagcgtcgtaaaatcacacaaggcgatgatctggcacctggcgtgctgaaaatcgttaaggtttatctggccgttaaacgtcagatccagcctggtgataaaatggcgggtcgtcacggtaacaaaggtgttatctctaagatcaacccaatcgaagacatgccttacgatgagaacggtacgccggtcgatatcgtactgaacccgctgggcgtaccatcgcgtatgaacatcggtcagatccttgagactcacctggggatggcagcgaaaggtatcggcgagaaaatcaacgcgatgctgaagaagcaggaagaagtcgccaaactgcgcgaattcatccagcgtgcttacgatctgggcactgatgtgcgtcagaaagttgacctgaatacctttactgatgacgaagtcctgcgcctggctgagaacctgaaaaaaggtatgccaattgccacgccggtgtttgatggtgcgaaagagagcgaaatcaaagagctgttagagcttggcggtctgccttcttccggtcagattaccctgtttgatggccgtacgggcgagcagttcgaacgtcaggtaaccgtgggttatatgtacatgctgaaactcaaccacctggttgatgacaagatgcacgcacgttctaccggttcctatagcctcgttactcagcagccgctgggtggtaaggcacagttcggtggtcagcgcttcggtgagatggaagtatgggcgctggaagcttacggtgctgcgtataccctccaggaaatgcttaccgttaagtctgatgacgttaatggccgtaccaagatgtataagaacatcgtggatggcaaccatcagatggaacctggcatgcctgaatcgttcaacgtactgttgaaagagattcgttcgctgggtatcaacatcgagctggaagacgagtaaccctcagtaacaggcctggcctggaagcgcagggttaacgcgctcgcatttgtactggttatggggcgttcaatttcggttggacgcccctgagtctcactccgacgggagcaaatccgtgaaagacttacttaagtttctgaaagcgcaaactaaaaccgaagagtttgatgcgatcaaaattgcgctggcatcgccagacatgatccgttcctggtctttcggtgaagtgaaaaagccggaaaccattaactatcgtaccttcaagccagagcgcgatggtctgttctgtgcccgtatctttgggccggtaaaagattacgaatgcctgtgcggtaagtacaagcgtctgaaacaccgtggtgtgatctgcgagaagtgcggcgttgaagtgacccagactaaagtgcgtcgtgagcgcatgggccacattgagctggcttcacctaccgcacacatctggttcctgaagtcactgccttcgcgtatcggcctgctgctggatatgccactgcgtgacatcgaacgcgtgctgtattttgaatcttatgtcgttatcgaaggtggcatgaccaaccttgagaagcgtcagattctgactgaagagcagtacctggatgcgctggaagaattcggtgacgaatttgacgcgaagatgggtgcagaagcgattcaggcactgctgaaaaatatggatctggagcaagagtgcgaacagctgcgcgaagagctgaacgaaacgaactccgagaccaaacgcaaaaagctgaccaagcgtattaagctgctggaagcgttcgttcagtctggtaacaagccagagtggatgatcctgaccgtgctgccagtcctgccaccggatctgcgtccgctggtaccgctggacggcggccgctttgcgacatcagatctgaacgatctgtatcgccgcgtgatcaaccgtaacaaccgtctgaaacgcctgctggatctggccgcgccagatatcatcgtgcgcaacgaaaaacgtatgctgcaggaagcggtagatgccctgctggataacggtcgtcgcggtcgtgcgatcacgggttctaacaagcgtcctctgaaatctttggctgacatgatcaaaggtaagcagggtcgtttccgtcagaacctgctcggtaagcgtgttgactactctggtcgttctgttatcaccgtaggtccttacctgcgtctgcatcagtgcggtctgccgaagaaaatggcactggagctgttcaaaccgttcatctacggcaagttggaactgcgtggcctggccaccaccatcaaagccgctaagaagatggttgagcgtgaagaagctgtcgtttgggatatcctggacgaagtgatccgcgaacacccggtactgctgaaccgtgcaccaaccctgcaccgtttgggtatccaggcatttgagcccgtcctgatcgaaggtaaagctatccagctgcacccgctggtttgtgcggcttataacgccgacttcgatggtgaccagatggctgttcacgtaccgctgacgctggaagcccagctggaagcgcgtgcgctgatgatgtcgaccaacaacatcctgtcacctgcgaacggcgagccaatcatcgttccttcacaggacgttgtactgggtctgtattacatgacccgcgactgtgttaacgccaaaggcgaaggcatggtgctgactggtccgaaagaagctgaacgcgtttaccgcgctggcctcgcttcgctgcacgctcgcgttaaagtgcgtatcactgagcacgagaaaaacgagcaggatgagtgggtttctaaaaccagcatcatcgacacaactattggtcgcgccatcctgtggatgatcgtgccaaaaggtctgcctttctccatcgtcaaccaggcgctgggcaagaaagcgatctccaagatgctgaacacctgttaccgcatcctgggactgaaaccaacggttatctttgctgaccagaccatgtacaccggctttgcctatgcggcacgttcaggtgcgtctgtgggtatcgacgacatggttatcccagagaagaaagtggaaatcatcaccgaagcggaagcagaagtggctgaaatccaggaacagttccagtctggtctggtgaccgcgggtgaacgctataacaaagtgatcgatatctgggctgcggccaacgaacgcgttgctaaagcgatgatggaaaacctctctaccgaactcgtgatcaaccgcgatggcgtggaagagcgtcaggtttccttcaacagtatctttatgatggctgactccggtgcgcgtggttctgctgcacagattcgtcagctggccggtatgcgtggtctgatggctaagccagatggctcaatcatcgagacgccaattaccgcgaacttccgcgaaggtctgaacgtactccagtacttcatctcgacgcacggtgcacgtaaaggtctggcggataccgcactgaaaacggctaactccggttatctgacgcgtcgtctggttgacgttgcgcaggatctggttgtcaccgaagacgactgtggcacgcacgaaggcatcatgatgacgccagtcatcgaaggtggcgacgtaaaagagccactgcgtgagcgtgttctgggtcgtgtgacggcagaagacgtcctgaagccgggtactgctgacattctggttccacgtaacacgctgcttgatgagcactggtgtgacgtgttggaactgaactcagtagacagcgtgaaggtacgttcggttgtaggttgtgaaaccgattttggtgtgtgtgcacattgctatggtcgcgacctggcacgtggtcacatcatcaacaaaggtgaagcaatcggtgttatcgcggcacagtctatcggtgagccgggtacacagctgacgatgcgtacgttccacatcggtggtgcggcatcacgtgcggctgctgaatccagcattcaggtgaagaacaaaggtacgatcaagctgaccaatgccaagtcggtaaccaactcggcaggcaagctggttatcacctcgcgtaacgttgaactgaaaatgatcgacgaatttggccgtacgaaagagagctataaagttccttacggtgctgccatggcgaaaggtgatggtgagcaggttgcagcgggcgaaaccgttgcaaactgggacccgcataccatgccggttatcactgaagtgggcggtttcattcgcttcacggatatgatcgacggtcagaccattacccgtcagactgacgaccttaccggtctgtcatcgctggtggtgctggattctgccgagcgtaccgcgggtggtaaagacctgcgtccagccctgaaaatcgttgatgctaacggcaacgatgtcctgatccctggtaccgatatgccagctcagtacttcctgccaggtaaagcgattgtacagttagaagatggcgtgaagattagctcgggtgataccctggcgcgtgttccgcaggaatctggcggtaccaaggatattaccggtggtctgccacgcgttgctgacctgttcgaagcgcgtcgtccgaaagagccagctattctggcggagatcagcggcatcatctccttcggtaaagagacgaaaggcaagcgtcgtctggtcattactccgctggatggtagcgatccgtacgaagagatgattccgaaatggcgtcagctgaacgtgttcgaaggtgaacgtgttgagcgcggtgacgtagtttccgatggcccagagtcaccacatgacatcctgcgcttgcgtggcgtgcatgcggttacccgttacatcactaacgaagtgcaggaagtttaccgtctgcaaggcgttaagattaacgataagcacatcgaagttatcgttcgtcagatgctgcgtaaagcgaccatcatgagcgcgggcagtaccgagttcctggaaggtgagcaggctgaattctctcgtatcaagatctctaaccgtgaacttgaagcgaacggaaaagttggcgcaaccttcatgcgtgatctgctgggtattaccaaagcgtcactggcaaccgaatcgttcatctctgctgcatcgttccaggaaaccacgcgtgtcctgaccgaagcggcagtggcaggcaagcgcgacgaactgcgcggtctgaaagagaacgttatcgtgggacgtctgatcccagccggtacgggttatgcttaccatcaggatcgtatgcgccgcaaagcggcaggcgaagtaccggtagcaccgcaggttactgcggatgaagcctctgcaagcctggctgaattgctgaacgctggtctgggcggtaaaaacgacgagtaatcgtcaaacgcccgataaaaaaccctgctcaggcagggttttttttatcttaaaatcttcagcggatatcgtttcggtctagtccaatgtcttttaattgacagtcgctgagccgggataaaatagcccgggtttcacgctgacattgccaacgtctgatgctgctccagataaggcgtaagaaacgaaacggtcttatcgtaaatggcctggccgcgcggttttcttcatattccatgatcctgccctcagttgtttatctgagaaacattttcacgcagagcgtattttcaatacagatgcacgataagcaaatatttaacatacagattgcgctgcaggcgaactgaatggtagaaataatctctatctgtactgctttacggggcggtcaattttcacagggcatacaatgacgcgatatcaacatttggccatgctgctggaaaagcgcattgagcaggggctgtatcggagcggcgaacgtttaccttcagtgcggagtctgagtgctgagcacggcgtcagtatcagcacggtgcagcaggcgtattatttgctggagcagaaacagttaatcgttccacagtcgcgttcaggctactttgttgcgccccataaggcgatgccgcccatcccggcactgacccgaccggtgcaacgacccgtagaaataacccagtgggatgcggtatttgaactgcttaacagccggctggaagacgatatattgcagttgggcagcggcatgccggatttaacacaatccaccctgaaacccctctggaaagcctttagccgacaggctcagaagcaggaaagtcacctgctgaattacgataatctgtatggtgtagcctgcctgcgggagcagatcgcccgactgatgattgacagcggttgccagcttacccttgaagacattgtgataacaaccggctgccatgaagcactgtccgtgtccgttcgtgctgtctgccagccgggcgatatcatcgccgtggaatcaccatcctttcatggcattatgcagacgctgcgtggttttggcattcgcgccattgagatccccacggattcggtgacgggcatcagtcttgaggcgctggagctggcgtttgatcagtggccaattaaagctgtcgtagtggtgccaaactgtaataacccgcttggctttattatgcccgagaagcgcaagcgcgccttgctgaccctggcgcaacgttttgacgcagcgattattgaagacgatgtgtatggtgaactggcctgggaatacccacgaccgtcatccattaaatctttggatgaagatgggcgcgtgttgctgtgcagttcattttccaaaacgctggcaccgggtttacgcgtcggttgggttgcgccgggacgctaccgcgatcgggtactgcatatgaaatatatcggcaccggctccaccgcgacccagccgcagcatgcggtagcagagtttattcgtcaggggcactaccagacccatttacggcggatgcgtcaggtttatcagcacaactacgaaacctttatttgctgggtcaggcactattttccttgtgggatctgcgttacgcggcctcagggcggttttctgatgtggattgaactgccagaagcctttgatgcggtgcagcttaataacacgctgcgccagtcgggtattcagattgctgtcggctcgctgttttccgcctcgggcaaatatcgtaactgcctgcgtctgaattacgcgctgcccgccagtgataccatcgaacgggcactggcgataaccggcaaggccgtggagcaggcaatcatagcctgcacccatgataaattgatggagtcagtcccttatctctctgaacctgcagttgagaagcagggccagaaagaggaggaggctggccctggtccggcaatccctgctggacgcctgtgactttaaagggcattaaaaaaccgcgccagcagcaagatgaattgccgtgcgcggctttccagtttttatctaccgattgcactgactgcgcgtatttttgcgcgataacgccagttaatgcgcggtttcaggctcggcaagctgcagcagaatacgcgtggcttcctgccagtcttctgcctgggtaatcgcgctcaccaccgcaatgctgccgacgccggtggctaagacctcaggcgcacgggcaatgctgatgccaccgatcgcggcagtagagatgcccgccagccgacccaaatggcgtttaagttcaaccagcccttgcggagaagaaggcatcactttcgtctgcgtggggaagatgtgccccagtgcaatgtaagaagggcgcagcgccagcgcccgatccagctccgcatcgtcatgggttgacagccccagtcgcaagccagcgtgcaaaatctgctgaagattcgcgacgtctaaatcctcctggcccagatgaacgccataagcctgatgtttaatcgccaactgccagtaatcattgataaacagacgtgcctgatagcgcttacctgcggcgatagcccgaataataaagggttcaaccacctcatcgggctgatccttgatccgaagctgaagggttcgcacaccggcgtctaacagacgttcaatccattcaaagctgtcgacaaccggatacagccctaagcgtggtgcggtggcgggaaaggcgtccatttattcctccttaagggcggttgcgggatgatagagctcaccgccgcgctcacgaaaattatctgacatctttgccatccccacttcaatcgcctgggcttctgcttcctgcttcgcggcatagtcgcgtacttcctgggtaattttcattgagcaaaatttggggccacacatggaacagaagtgcgcaaccttgcctgattcctgcggcagggtttcgtcgtggtaagcgcgtgccgtatgggggtccagtgcaagattaaactggtcttcccagcgaaactcaaaacgcgctttcgacatggcgttgtcgcggatctgcgcccccggatggccttttgccagatcggcggcgtgcgcggcgatcttgtaggtaatcaaaccctgtttcacatcgtctttattcggcagacccaggtgctctttcggcgtgacatagcagagcatggcgcaaccgaaccagccaatcattgccgcaccaatgccagaggtaaaatgatcgtaacccggagcaatatcggtggtcagtggacccagggtgtaaaacggtgcttcatggcagtgttccagctgttcagtcatgttgcgacggatcatttgcatgggaatatgaccggggccttcaatcatgacctgtacatcgtattcccaggcgatttttgtcagctcacccaaggtgtgcagttctgcaaactgcgcgtcgtcattggcatcctgaattgatcctggacgcagaccgtctcccagcgacagcgaaatatcataagcagcacaaatttcacagatgtcgcggaagtgctcatagagaaagctctctttgtgatgcgacaggcaccacttcgccataatggacccaccacgagagacgatgccggtcaggcgtttcgcggtcatggggacatagcgcaacagcacgccagcatggatagtaaaataatccacgccctgttcagcctgttccagcaaggtatcgcggaagatgtcccagttcaggtcttctgctacaccgttaactttctcaagcgcctgataaatcgggactgtaccgatcggcaccgggctgttacgcaaaatccattcgcgggtttcatggatgtagcgccctgtagagaggtccataacggtatccgcgccccaacgggttgaccacaccagcttttccacctcttcttcaatggaggaggtcacggcggagttgccaatattcgcatttaccttcaccagaaagttgcgcccaatgatcatgggttcggattcaggatgattgatattcgccgggatgatggcgcgtccggctgccacttcctgacgcacaaactcaggtgtaatattttccggcaaatgcgcgccaaagctgtgccccggatgctgttgtaacagcacttcaccacggatgcgttcccggcccatattttcccgcagcgcgataaattccatctccggcgtgataatgccctggcgtgcatagtgcaactgggtcacgcagcggccggctttagcgcgacgcggcgttggcaggtgttcaaaacggagatgatccagcccgtcatcggccagccgctgctgcgtgtaggctgagctgatttgcatcagattctcgctgtcattacgttcttcaatccagcgcgcgcgcagtttatccagcccgcgatgaacatcgatttgtgctgccggatcgccataggcgcccgccgtatcataaatcggtacgggctcattctcctcataaacaggcgcgtctttactgccgctgatcagggtagggctgagttgaatttcccgcatcgggacacgaatatcgtcgcgactgccggtgagccagatacgttttgagttgggaaaggcgctgccgccctgaagagaatcaataaattcctgtgcctgaacacgttgttcgcgacgggtcgttttagcagtagacatagcaatattccagtaagtgggaaggttgcttgtccggagttcggaaggagtaacggcactgctggcaccatccggtggcgtaccgtataaatttactcttgttcccttcgcaggttctaacctgatcaggttccgcggatcccgaattaacggtctcagcccagagggcactccgacaagatgtggttttaacgctttacgcgacgacgcctgcgctgccttacctgtaaataaccgataacgagagcaggacgtgtaggtaacgtttcaaccgtaaaacaccgactacattaggcattacgtttaaagcccactcagcataagggggctttttactaatcacaagtcttttacaatcgatgaggttttaggcagggcgggcaatttcgctgtcgttagccacgggcggggtaaggtggttatcccatgccatctgaattaacttgtcctcaagggtaaagcgtccttcaagggcttcacccacctctgacagggcattctgaaaggtgacatagttatcgtcatcaatcgcctgctgaagatgcccgtcatacaattgcatcagtttttcggtgttggcttccagcgagggataaatctgcgtggcggccagcaacgggctggtgccgtccatttcaccgatcaggcgttggtaaagactaaagtggcctgatgacaggtaatcgaccagattatggcaaaaattatcaagcgcctgttcatccagacgagtcagtgcctctttctttggcttaataccgaccaaatgataataagaaaccaatagctggcggcgagcggccagccatgaatctaccagttcattactgccacctacgcgtttggtcagaacgtctaactggttgagcatagttaactccgtatgagttatgcaccttcatatttcagattagcgatgcgtcaattgcgcttgttctccacgagccagtcggggataaataagcgtgctgtcgtcttgcaaccagaattatttgggtatagttgttcatctacacacttaacatcgggacttcagcgtgcgggttgacgctaaggatgacgaaataaatgcaatgcgaaatttcaagcgtagacgctggatggtggattgtcagcagtgaacagaaaatttggttaccgcaaggggatctccctcacggtaatgcgcaacagtttggcctgacaggccatcagggacgcgttatcggcgaatggcagagtgagaaagtctggctggtttgcgaagcacgttcagaggatatgctgtcgctgcggcagttgcttaacgaagatccggcgctatttcagctggcggggcgcggtgtacaactggccgagttttatcgctctcatcgctggtgtggctactgtggtcatgagatgcaccccagcaagcgtgagtttgcctgtctgtgcagtcactgtcgtgaacgttactatccacaaattgcgccctgcattatcgttgcgattcgccggggggacgagatcctgctggctaatcatgcgcgccatcgtaataacatttacactgtgctggccgggtttgttgaggtcggtgaaaccattgaacaggctgtcgcgcgtgaggtgatggaagaaagcaatgtgcgtgtcaggaatgttcgctatgtaacatcgcaaccctggccctttccgcaatccctgatgatggcctttatggcggaatatgatggcggtgagttacagcatgacggtaaagagttgctggatgccggatggttccgctttgatgcgctgccgttacttcctccgcccggtaccgttgcccgtcgattaattgaagataccgtggccctctgccgcgctgaggcgtgagagtgctacactactcgcttgataccgagagagtcctgacatgagtgaactgaagaacgaccgttatttgcgcgccctgttacgccagcctgtagatgtcacccccgtatggatgatgcgtcaagccgggcgttatttgccggaatataaagcgacgcgcgcccaggcgggtgattttatgtcgctatgcaagaatgccgaactggcctgcgaagtcaccctccaacccctgcgtcgcttcaagctggatgcggcaatcctcttcagtgatattctcaccattcctgatgccatggggttagggctgtacttcgaaacgggtgaaggcccgtgtttctctaatccagtaacgtgccgtgccgatgtcgatcgccttcccgtgcccgatcctgagcaggaactgggttacgtgatgaacgcggtgcgcaccatccgtaaaaacctcaatggcgaggtgcctttaattggcttctcaggtagcccgtggacactggctacctacatggttgaagggggaagtagcaaagccttcaccaaaattaaaaaaatgatgtacgccgagccggccacgctgcacgccatgctggataagctggctgacagcgtcattctctatctcaatgcccagattcgcgccggtgcgcagtcggtgatggtatttgatacctggggcggcgtgttaaccgggaacgactatcgtgagttctcgctttactacatgcataaaattgtcgacagcgtgctacatgaaaacgaaggccgtcgcgtgccgatcaccttgtttaccaaaaatggcgggcagtggctggaagcgattgccgagactggctgtgacgcacttggtctggactggacaatcgatatcagcgaagcccgtcgtcgcgtaggccacaaagtcgctttgcagggcaacatggacccatccatgctctacgcaccgcccgcgcgaattgagcaggaagtcgctacgatcctggacgggttcggcaagggcgaaggccacgtcttcaatcttgggcacggcatccatcaggatgtgccgccagagcacgcaggtgtatttgttgaggcggtgcaccggctctcacgcccgtatcatcaggagtcttaatggatatcgctgcactccgcgcggagcaattacagcgtgccgtagaggtcgtgcggcaggatgactttgacgtactgccgccacgctttatcggtggcgcagacgtcggttttgagcaggaaggtgcagtcacgcgtgctgcgctggtcattcttgaatacccgtccctgaagctggtggagcatcgcatcgcgcgcattgacaccaccatgccttacattcccggtttcctctctttccgtgagtatccggctctgttggcggcatggaacatgctggagcagaagcccgacctgttatttgtcgatggtcatggtatttcacatccgcgccggctcggtgtggcttcgcattttgggttgatggtcgatgtccccactatcggcgtcgcgaaaaaacgcctgtgcgggcgctgtgagccgttggatgaaacccccggcagtcgccagccgttagtggacaaaggtgagcaaattggctgggtatggcgcagcaaggcgcgctgtaatccgctgtttgtggccaccgggcaccgcgtcagtctggacagcgccctgcagtgggtcgaaaagtgtacacagggataccgtttaccggaacctacccgctgggcggatgctgtggcatcccaacgccccgcatttctgcgctggcaaagcgcgctttaacactgtttgtatggcgcttttgcgttacactgccgccagcgaaatgaataagagctctgtgtatgttacaaaaccctgtgcatctgcgtctgaccaagctggaaagctggcaacatctgacgtttatggcttgcctgtgcgagcgcatgtatcccaactacgtggctttttgccagcaaaccgagtttgccgatcctgccctttaccgccgcatcctggacctgatttgggaaacgctgacggtgaaagacgcaaagatcaattttgacagccaactggaaaagcttgaagcagcgattcccgatggtgatgcgtttgaggtatacggtgtgtatccggcaattgatgcctgcgttgcattgagtgaagtcctgcactcgcagttaagcggtgaaacgcttgagcatgcgattgaagtcagtaagacttcgatcaccaccgttgccattctggaaatgactcacgaaggtcgcgaaatgaccgatgaagagctgcgagaaaatccggctgtcatcgacgaatgggacctgcaatgggagatttttcgcctgctcgcggattgtgaagagcgagaccttgaattgataaaaggtctgcgatccgacctgcgtgaggcgggaattagtaacatcggtataaaaattcagcaataaggcgagaaaacgtgacttcaggccttaattagcgcgcctggaggcttcacatcagccccctgtctggtctacatttggggggctgaaaattgtggctatcggtgcgtgcaggctgaagagtgcccgaagccggcttttccctcgcactcgttgcttagcaagcgataaatacactttaaggataacttatgaacaagactcaactgattgatgtgatcgcagaaaaagctgacctgtctaaaacccaggctaaggcagcgctggaatctactctggctgcaatcaccgagtctctgaaagagggtgatgctgtacaactggttggttttggtacttttaaagtgaaccaccgcgctgagcgtaccggtcgtaacccacagactggcaaagaaatcaaaatcgctgcggcaaacgtacctgcattcgtgtctggtaaagctctgaaagacgccgttaagtaagacgtcgcattgcggtaacgttttaaacaggggcgatttcgccccttttgtttaagggccagccaccatgactacgctgttccagcgattatctgccctgttcctctcctcactgattatcgggtgcagctcaacccccgacatcccggctttctcggccagcggttaccttgccgatcgcggcagtgtacgtatctggcgcaaaaataccgatcatcattcggtacatattcgtacgctgtacaatccgttcaacagtgaaaaaagtgaaattactgattatcgctggcttggggatgacttaatcagcgtagagcgtcaggtcaaaggcgataagccagacgacgtcaccttacgctttgatcaaaatggcagccttaatttcatgcagcgccagctcgcgacgcgccgtgaggcagtcagtccagatgcagtggagctttacaaattcgatgcacaacgtatgcgcgaagtcagcgatgcgctgttaagtggtcgtgtgttcttgaaacaggggcactggtcaggcggaagggctgtggaaacctgtgagggccagcaggtgacgcctgcttttgacagttatgccctgcagacgctaacacattaccgcagcaataagacgggaccgttgatgatttcgtggctggaagcccctgaaggcgtgcagctactgcgtgtcagtcaaaaagatgagtgtgcagatgcgcctgaagaggcagacttctgagacagtaaaaaggggcactgggtgccccttcgttctttatttacggtcaattgcacgatagccgatatcgcgtcggcagaagctgccttgccaggaaatcggtttagccagttcgtaagcccgtttctgtgccgcagcgacatcgtcgcctaaggcggtgacgcacaaaacgcgcccgccgttggtcagcacccgatcgtcttcaaggcgagtcccagcgtggaaaactttgccgtcggcaacctcttccagcggcagaccctgaatgtgatcgccgttattgtagtgaccgggatagccgccagcggccagcaccacaccaagcgatggacgcgggtcccattgggaatccttctggtctagctttccgtcgcaggccgccagacagagatccaccagatccgactgcaggcgcagcatgataggctgcgtttctggatcgccgaagcggcagttgaattcgatcacttttggctgacccgcctgatcgatcatcagcccggcatataagaaaccagtataaacgttgccttctgccgccatgccgcgcacggttggccagataacctgatccattacgcgctggtggatcgcatcggttacaaccggggcaggggaatacgcgcccattcccccggtgttcgggccggtatcgccgtcacccacacgtttatgatcctggctggtggccatcggcaacacgttctcgccatcaaccatcacaataaagctggcttcttcgccgtccaggaactcttcaataacaatacggtgtcccgcgtcaccaaacgcattgcctgccagcatatcgtgcacggcgtcttctgcttcctgcagcgtcattgccacaatgacacctttaccggctgccagtccgtcggctttgatgacaatcggcgcgcccttttcacgaagataagccagcgcaggggcgacctctgtaaaattctggtactccgcactcgggatgttatgacgtgccaggaagtccttggtaaaggctttagatccttccagttgcgcggcggcctgggtcgggccaaagatttttaagcccgccgcacggaacgcatcaacgacacctgacaccagcggcgcttcagggccaacgatggtgagatcgatctgttcacgctgggcgaaggccagtaaggcaggaatatcggttggtgcaatgtcgacgttctgcaacgcgggttccagtgcggtgcctgcattgcccggtgcaacaaaaacggtttccgccagcggcgactgtgcagccttccaggccagtgcgtgttcacgtccgccgttaccaatgattaaaattttcataaaacgctccacagaattaatggcggaagtgacgcatatcggtaaagatcatggcaatgccatgctcatcggctgctgcaatgacttcatcgtcgcgaatagaaccgcccggctgaatcacacagctgacgcccacggcagcagcggcatcaatgccgtcgcggaacgggaagaaagcatcggaagccatcgcggaccctttcacttccagaccttcatcaccggctttaatgcctgcaattttggctgagtagacgcggctcatctgtccggcaccaatgccgatggtcatgttgtcccgtgcatagacaatcgcgttggacttaacgaatttggctactttccagcagaacagcgcatcacgcaactcctgctctgaaggctggcgctgacttaccacgcgtagctggctggcatcgaccataccgagatcgcgatcctgaaccagcaaacctccgttcacacgtttgaaatcaagggcggcgacccgaccttgccatttaccgcataccagaacgcggacgttctgtttagccgccgtaattttcagcgcagcttccgttgccgcaggggcgatgatgacttcaacaaactgccgactgatgatggcctttgcggtagcctcatccagctcgcggttaaaggcaataatgccgccgaaggcagaagtggggtcagtctgataagcgtgctcgtaagccgccagaatggactcgcccacagcgacaccacaagggttagcatgtttgacaataacgcaggcgggctcaacaaactctttcacgcactcaagcgcggcatcggtatccgcgatgttgttataagacagcgctttgccctgcacctgcctggcggtagcgactgatgcttcctgcacatcttcttctatatagaaggccgcgtcctgatggctgttctcgccatagcgcatatcctgctttttaatgaagttaagattgagagtccgcgggaagcggcctgcaggttggctggtttcgccatgataagccgggaccaggctgccaaaatagttggcgatcatgctgtcgtacgcggcggtatgttcaaaagctttaatcgccagatcgaaacgggtttcgagcgtgagcgagttctggttggcgtccagctcggcgataatggcctggtagtcgctgctcttaaccacaatcgctacgtctttgtggtttttggctgccgagcgcaccatcgttgggccgccaatatcaatattttcgacagcgtcttccagtgaacaatccggctttgcgacggtttgggcaaagggataaaggtttacgaccaccatatcgatagggctgatagcgtgctgcgccattacggcatcatcttgcccacgacgtcctaaaataccgccgtgtacttttgggtgcagtgttttaacgcgtccatccatcatttccgggaaaccggtgtagtcagacacttcggtgacgggcagtcccgcctctgccagcaggcgagcggtaccacctgtggagagcagctctacaccgcgctgggagagtgcctgagcaaattcgaggatgccggctttatcagaaacactgagcagggcgcggcgtaaaggacgaggttgtggcatggtggttttatcccttggctttgattcgcgtaaataagagcgttacatcaagcttgcgtgctcacttctctctatatagagaagcaaaagcgtaaaaacttcaggtaacgccccgaaaaggggcatccattgcgttgcggggcattgtagcgaaaacgtttgcgtgatgctcgtctaaatttaacgcttccaggaatgtggataactttgtgtgtaactgcgtataaagtggggttttgctgtgtaatgcagcgaacggtcatttttattgaatttagcccttgtcagcctgagagaactccctataatgcgcctccactgacacggcacaacggcttacggaatgcggtgtcgggaggttcgggaaactgagccgccggagaaaaacttctggaaaagaggttgactctgaaggaggaaagcgtaatatacgccacctcgcgacagacggttaacccgctgttcgcactgctctttaacaatttatcagacaatctgtgtgggcactcgcaggattgatatcagcgtctccggacgtaaaaaatatcaagtctcacgagtgaacacataatgaaattcattatgacgttttacagatgagcaccgctgaactggtttcagcaaatcaaacttaaattgaagagtttgatcatggctcagattgaacgctggcggcaggcctaacacatgcaagtcggacggtagcacagagagcttgctctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcattgtggttaataaccgcagtgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccactttgtgattcatgactggggtgaagtcgtaacaaggtaaccgtaggggaacctgcggttggatcacctccttacctgaagataccttcccgcgaagtgctcacacagattgtctgatagaaagttaaagaagcaagacggctgcgaagtcgagacacgtccgtgtccccttcgtctagcggttaggactccgccctttcacggcggcaacaggggttcgaatcccctaggggacgccacttgcttggtgacaggtgaaaggtgttgcccacatatcttaaagatgacttacgagtcgtgtttaagatattgctctttaacaatccggaacaagctgaaaatttgaaacgacgcattgtcgtgttcctccgtaataaggaacacaggacaacgcgttcgagtctctcaaaagctcatgacacgcagcgtaaaacgcctgtgggttgtgaggttaagcgactaagcgtacacggtggatgccctggcagtcagaggcgatgaagggcgtgctaatctgcgataagcgccggtaaggtgatatgaaccgcaataaccggcgatacccgaatggggaaacccagtgtgactcgtcacactatcatgcagtgaatacatagctgcatgaggcgaaccgggggaactgaaacatctaagtaccccgaggaaaagaaatcaaccgagattcccccagtagcggcgagcgaacggggaggagcccagaaccatcatcagcttgtgcatcagtggaagcgtctggaaagtcgcagggtacagggtgatactcccgtacacaaaggtgcacaggctgtgagttcgatgagtaaggcgggacacgtggtatcctgtctgaatatggggggaccatcctccaaggctaaatactcctgactgaccgatagtgaaccagtaccgtgagggaaaggcgaaaagaaccccggcgaggggagtgaaacagaacctgaaaccgtgtacgtacaagcagtgggagccttctttatgggggtgactgcgtaccttttgtataatgggtcagcgacttatattctgtagcaaggttaaccgtataggggagccgcagggaaaccgagtcttaactgggcgttaagttgcagggtatagacccgaaacccggtgatctagccatgggcaggttgaaggttgggtaacactaactggaggaccgaaccgactaatgttgaaaaattagcggatgacctgtggctgggggtgaaaggccaatcaaaccgggagatagctggttctccccgaaagctatttaggtagcgcctcgtgaactcatctccgggggtagagcactgtttcggctagggggccatcccggcttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcacagacagccaggatgttggcttagaagcagccatcatttaaagaaagcgtaatagctcactggtcgagtcggcctgcgcggaagatgtaacggggctaaaccatgcaccgaagctgcggcagcgacactatgtgttgttgggtaggggagcgttctgtaagccgttgaaggtgtgctgtgaggcatgctggaggtatcagaagtgcgaatgctgacataagtaacgataaacaaggtgaaaaaccttgtcgccggaagaccaagggttcctgttcaacgttaatcggagcagggtgagtcgacccctaaggcgaggccgaaaggcgtagtcgatgggaaacaggttaatattcctgtacttggtgttactgcgaaggggggacggagaaggctatatcagccgggcgacggttgtcccggtttaagcgtgtaggtgtgtgttccaggcaaatccggttcactttacactgaggcgtgacgacgaggcactacggtgctgaagtgataaatgccctgcttccaggaaaagcctctaagcatcaggtaacacaaaatcgtaccccaaaccgacacaggtggtcaggtagagaataccaaggcgcttgagagaactcgggtgaaggaactaggcaaaatggtgccgtaacttcgggagaaggcacgctggcgcgtaggtgaagggacctgctccccgagccgaagccagtcgaagataccagctggctgcaactgtttattaaaaacacagcactgtgcaaacacgaaagtggacgtatacggtgtgacgcctgcccggtgccggaaggttaattgatggggttaagcgcaagctgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaaatcgctgtgaagatgcagtgtacccgcggcaagacggaaagaccccgtgaacctttactacagcttgacactgaacactgagccttgatgtgtaggataggtgggaggctttgaagcgtggacgccagtctgcgtggagccaaccttgaaataccaccctttaatgtttgatgttctaacgtaggcccgtgatccgggctgcggacagtgtctggtgggtagtttgactggggcggtctcctcctaaagagtaacggaggagcacgaaggttggctaatcctggtcggacatcaggaggttagtgcaatggcataagccagcttgactgcgagagtgacggctcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgctggagaattgaggggggttgctcctagtacgagaggaccggagtgaacgcaccgctggtgtccgggttgtcacgccagtggcactgcccggtagctaagtgcggaaaagataagtgctgaaagcatctaagcacgaaacttgccccgagatgagttctccctgaccctttaagggtcctgaagggacgttgaagacgacgacgttgataggccgggtgtgtaagcgcagcgatgcgttgagcttaccggtactaatgacccgtgaggcttaaccttacaacgccagaggcgttttggttgagagacgattaaattttcagcattgtttaccggaaaagaatttgcggaaacgacagattttgcggcatgagaaggcgcagagcgatgacgtcagcgggagcatactgaagtatgtgaccgttgcggcagagcgaatgcaacgcgttcatggcgtaaaagagtcgtttcgtgcacaaagaatttgcctggcggctgtagcgcggtggtcccacctgaccccatgccgaactcagaagtgaaacgccgtagcgccgatggtagtgtggggtctccccatgcgagagtagggaactgccaggcatcaaacaagtgaagaagccctgaacgaaagttcagggcttttttacgtccgtaacctgcggaaagcggggcgtcaggccggttatgctgcgcggccgggactgcgcgagcgccgtccgcgtcattcaaaccgccgggccgggataaaacggcgcgtgagaaagccggatggaatgccgcacctggcgtcatgtacctgcggccctgaccgaagacggcgaaccgcctgatcatccggatacaacaaacgccgcgaatgcctgcccgcacccgccaaattccctctgtgttttagatccagcacagcgccgccctgcattaactcgcaacagcaataaaggtcgtgaatggttgtcgactaaacggcaggatgagtaaaggtcgccagcgctatccggctcaagccagacaggctccagctatatttgcgtttattggcagatggggcttttggaaagacgcacttcagaaccctttccagtgttgaaatctgtgcggcggtattacaggcagacttaatgataaaatacctaaaaaaggccagctgctttataaaacggatatccgttatataaaaacagctggcccttttgcttatttagcgctggcattatttgtataattcagccgttacatgggcgtaattattcgtgtctgcactgataactttaaaatggtcaccttgttgtttagcctgtcgggcgattttagaaaccgcgccatccagcgttaatgaggtggcagagacagtttgtgcgaaacaaccaaaagacatcagtgaaaaggctacagcagccgcagctgacgttactttattgattttcataacattaccccttaattccggttgatgaaggagtctgtatggctccgttaaaatcaagttagcaaaatgtatgcattctaaaattaacgccgtgtgctctaattaatatcaagctgatagcattattgtcagagtgtaaaagagaatatcagtgagttaaatgtgtagggatttaatactgaaataatagaattacacagatgaggtgtaatttccgcccgacttttttagttaatagggcgaataataagtaatagccctccgacgccaggcagataaaggcgttggctaaaaacctcaaaactctcctgccagttttatgcaactcacacaacgattctgtctggccttcaatcgtaccgggtcaaactgttatctgaattgggtacgagaatgccgttcatcatgatccttccaagggcataagtatgtctcaatgttcgccgccagtatgatccaggcaaaaggctcagcctggcccgtaaaatcacttaggctgaacaggcttgctcctctccttctctggcctcaatcctcaatccgccaattcccgatgagcttaatggccgcaggctgagccgttcgctactgttccattgcgacacgtgccaggcgttgagcatcaacaggctaccttgccgcagataagcgctatataatccattgcattacgctttggagacgcttcattgaaaaaaatactgactcgcctggtccttgctggcctgctgacgttgaccgcctcaaacagctacgccagtcgtgttgtgaccgatcaaattggccgtaccgtcacgattccagatcaggttaatcgcgtggtcgtgcttcagcatcaaacgctcaatctcctcgtgcagttaaatgcgacagataaaatcgtgggaattctcgctaactggaaacagcagctcggggacgattacgcaaccctggtgcctgaactgacgcataaagcgctgctaggtgatttgacccacgtggatttggaaaaactggtcgcgctgcatccacaggtggtatttgttaccaactatgcgccgaaagagatgattgaccaaatcactgcgctgggcattccggtgctggcaatctcgttgcgtcacgatgatgccgggcagcagggtgagattaaccccaatatgcaaaacgaagatcaggcgtacgatctgggtatcaaagaaggcattacgctgattggtgaggtggtgaacaggcagcaacaggccagagcattactttcagcggcatttgccggtcgaaagatagtgactgaccgtctcaaaaacagacctgaacagcagcgtgtccgcgcttatatggccaatcccgatctcactacctatggcgcagggaaatataccggcctgatgatggcccatgcaggtgccctaaacgttgcagcctcgaccattcagggcttcaggcaggtcagtatggaacaggtggtagtatggaacccacaggtgattttcgttcagcatcgttatccacaggtggtacaggagattcagcaaaatccgctttggcgaacccttgatgcagtgaaacatcatcaggtatggctaatgcctgagtatgccaaggcatggggttatccgatgccggaagcgataggtttaggtgaactgtggatggcgaagaagctctatcctgataaatttcgcgacattgatatgcagcagcaggctgaccgctggtatcaccgtttttaccggacctcgtaccatgaaaacgttacacgttctggcagcaggtagcctgcgtgatgtgtggaaggcgctaatcgcagcctttaacatccagtccggcttaatggcagacacgcagtatggccctgccggtttactgcgccagcatattgagcagggtgacgtgtgcgacctgtttgtttcggccaacctgcagcatcctgccaggttgctgttgcaaggccttgcacaagataccggtcattttacaaataatacgctctgcctgacggtgaaacgtgattgtgtccgggccggggacgactggctgtcgctgctgcggcgtaatgatttacggctggcgatctcaaccccacattgtgatccctccggtgattatgcctggcagctgttcgacaatattgaacagcgccatcccggttgcggcgattttctcaggcgcagagcaatcgcgatggtgggcggcccggacagcttgccggttccagatggcgaactggcggcaaagtggttaatcgatacaggacgtgctgacctttttatcggctacgccagctatgcgccccgcctgaaccctcattcacaatgccttgtcctgactatccctcccgattacaacgtgcaggcgaagtatggctgggccacgctgtcagctgccgccaggccgcttgccgccttcctgcgctccgacgaggcgcaacgtattttgcggcagcacggttttctgcccctcggttttaaaatgcctctttaatttctgttcgcctcaaaccctgtgctgaagggaaggcctccccgcgccttgaaactttttcacctgtcgatatgcaggctcgacatttagcgtttaactggttatctttggctgtctggatgtctaaacgtatatatggttatgagaggtgattaagccatgccaatcagggtccccgatgaattaccggcagtaaattttttacgtaacgaaaacgtcttcgtgatgacgtcgtcacgtgccagtgttcaggagatccgtccgcttaaagtgctggttcttaatctgatgccgaaaaaaattgagactgaaaatcagtttctgcggttgctctcaaactctccgttacagattgatattcaactgctgcgtatcgacagccgggaatcgcgcaatacacccagcgatcatctcaacaatttctactgtaactttaacgatatccagcacgataactacgacggcttaatcgttacaggtgcgccgctcgggctggtcgaatttaacgatgtggcgtactggccgcagataaaacaggttctggaatgggctaaaaaccatgtcacctcaaccctgtttgtctgttgggcggtgcaggcggcattaaacattttatacggcattcctaaacaaacccggcagactaaactggcaggcgtctttgaacatcagatactgcatccccactcattactgacccggggttttgatgataattttctggcgcctcattcccgttatgccgatttccctacccagttaatcacggattacactgacctcgaattatttgctgaatcggaacaaaccggtgcctaccttatggcgagcaaagacaaaaggctggcgtttgtgaccgggcacccggagtacgatgcactgacgctggcgggagagtttcaacgcgactatgaagccgggctgaatcctgaagtaccctataactatttcccacaggataatccccagcttacaccgcgcgccacctggcgtagccatggaaacctgctgttttcaaactggctgaattattacgtctaccagattacgccgtttgatctgcgccatatgaatcccacgctggaataattcttttttagccacaactgaaccgtgttagccgctggcagcacggttttttttcgtctgtaaaactttagtgaaaagtattacctgttaaaaaataaaataaatcatttattaatcatgatgataagctgtttttttattaaaaatggaaatagtttttgattttaaaattaaaatgaatatgctctgatcctgtagctcaataattaccctatatgcggatcacccgttttgatccgcctgaaaacaggagagagcaaacatgacagactccgttatcaacagtgaattactgttcagcaagccctttaatgatgctgaaaaacagctgcttaccgcagatgccatcgctttcttacaggcgctggtgacgcgttttgcgccacagcgtgaggcgctgttaaccgcacgtcaggtaaggcagaagcagtatgattccggccagctaccgggtttcgatatggaaactgtttccataagggatcgtgaatgggccatccgcggcatcccgaccgatttacaggatcgtcgagtggagatcaccggcccgcccgatcgcaaaatggtgattaacgccctgaatgccaacgtaaacgtgtttatggcagattttgaggactccctggcacccacctgggaaaaactggttgatgggcagcaaaccctacgcgaagccgttgccggcacgctgcgttataccagcgataacggcaaaatctatcagctacgagccgatcctgcggtattgatgtgtcgggttcgtggcctgcatctgtctgaaaaacatgttagctggcagggcaatgcgattcccggcggtctgtttgacttcgcactctacttttttcataacgtcaaagccttactggcaaaaggcagtggcccctatttttacctgccaaaaaccgagagctggcaggaggtggcgtggtggcgggacattttcagctttgccgaggatcgttttgatctggcgcgcggtaccatcaaagccaccgtgttgatcgaaacgctaccggctgttttccagatggatgagatcctgtggaatctgcgggatcatatcgtgggactgaactgcggccgctgggattatattttcagctatatcaaaacgctgcgcgaacatgcggatcgggttctgcccgatcgccagtctgtaaccatggctcagccatttctggatgcttactcacgattactgatccgaacctgtcatcgacgtggcgctttcgccatgggcggcatgtcagcgctcattcccagcaaagacagcgcgcgaaatgaatgggtactgcagcgcgttacagaagataaacagcgtgaagccaacaacggacatgacggcacctggatcgcgcatcccggcctggcagacacggcgatgtcagtgttcaaccatgtactgggtgaacgccccaatcagctcaacattctgcggcaggatgacagtccgataacggctgaacagcttctggcaccctgtgaaggctatcgaacggaagcgggcatgcgcgccaatattcgggtggcgttgcagtatctggaagcctggattagcggcaatggttgtgtccccattgatggcctgatggaagatgccgcaaccgcagaaattgcccgtacctctatctggcaatggatacgccaccataaatccctgcaggatggacagccagtgacggcggaactgtttcagcagctactgaatgatgagttgcaaacgttacagatgcatctgggtgataagtctttcagttcaggtcgttatgaggaagcggcacgcttgatggcgcagatcacaacccaggacgaactggtttcttttcttactctgccaggctaccgcctgcttccctgactcaaggagccgttgccatgacacgtactcaacacatccagcaactcgaaaaatactggcaggacacgcgctggcagggcattacccgcccctacagcgcagaagaagtcgttaatctacgcggttcggttctgccagcctgcactctggcagagcgcggggcggtgaaactctggtcgctgctcaacggtgatgccagaaaaggctatatcaacagtctgggggcactcacaggcggtcaggcgttgcaacaggcaaaagccggtatagaagcgatatacctctctggctggcaggtcgctgccgatgccaacgtggcagggcagatgtatcccgatcagtcgctctatccggttaactctgtgcctgaggtggtcacccgcattaaccagacgttccagcgtgccgaccagattcagtgggccaacggtatcgaaccgggggacagccgctttgtcgactattttctgcccatcgtggccgatgcagaagccggttttggtggcgtgctgaatgcgtttgagttgatgaagtcaatgatcagcgcaggcgcggcggccgtgcactttgaggaccaactggcggccgtgaagaaatgcggccatatgggcggaaaggtgttggtgccaacccaggaagccgtgcagaaactggtggcggcgcgcctggccgccgatgtgatgggcgtgcccactattctgctggcgcgcaccgatgcggatgccgccgatctgattacctctgactgtgatgaatacgatcggccgtttatccgcggcgaccgcacggcggaaggttttttccgtaccaacgccggtattgagcaggccataagccgggggctggcttatgccccttatgccgatgtcttgtggtgcgaaaccgccacgccagatttggcaatggcccagcgttttgccgatgctatccacgcccgctatccaggcaagctactggcttacaactgttcgccctcgtttaactggaaaaagaatctcgatgataaaaccatcgcagcttttcagcaggcgctcagtgacatgggttatcgcttccagttcattacgctggccggtattcacagcatgtggttcaacatgttcgatcttgcgcacgcttacgcccagggcgaaggcatgcgtcactatgtggaaaaagtacagcagccggagtttgctgcccgcgaacggggttacagcttctcctcgcatcagcaagaggttggtaccggctatttcgatcgggtgaccactacgattcagggcggtaagtcgtcggtgacggccctgacaggctccaccgaggaacaccagttttgagttgagtctgtgtctttcccgcccggtattaacgggcgggctttttcaggagggaatcatgccgccacgcgaatcactgattgcgcataccattctgcaggggttcgacgcgcagtatggccgttttctcgacattactgcgggcgcacaacagcgttttgaacaggccgaatggcaagcggtacagcaggcgatgaaggcgcgtattcatctttatgatcatcacgtagctctggtcgccgatcagctacgggcactgaacggggcggcacactgggacgatgcattttggctggcgatcaaaagccattatgaaaccttgttacctgactatccgcgctatgaaattgccgagagcttctttaattcggtttactgccggttgcatggacatcacgcgctgcagccggaacgtctgttcattttcagctcacagccggcctcggcacccacgcactctgcgcgcccgctggcgcgaacctatctgccacatcagggctggcaagtgctgctcgatcaggtactgcgcgacgtgccgttaacgttgccatggcaggatcgggagcgcgatgaagcgtggattttacggcatttgcatgagcaattttccgcatcacagttggataatggctggctggacgtttgcagtgaactgttttttcgtaataaaacggcctggattgttgcccggctgcatctgccagacggtattttcccctgtctgttgccgattcaacgtagcgataagggcgagctgtggattgatacttgcctgacggacgtgaacgatgccagcatcgtgtttggctttgcccgcgcctattttatggtttacgccccgctacctgcggcgctggtggcctggctcaagcccatattgccagggaaaacgctggcagaacgttacatggccatcggttgccagaagcatggcaagacggaaagctaccgtgaatatctgcaggcgctggcgcaatccgacgccgcgtttgagattgcaccgggcatacgtggcatggtgatgctggtcttcacattaccgggctttgaccgggtatttaaagtcatcaaagatcggttcgccccgcaaaaagaggtcaccgaaatgcaggtgagggcctgctatcaacaggtcaaagagcatgaccgtgtgggacgcatggccgatacacaggctttcgaacagtttgcgctgccgctcgcgcgcattgcgccggcgctgctgctggagttccaacagaccatttccgggaaactacgcatcgaaggcgatcgcctgatcatcagtcatctctggctggagcgccgtatgcagccgcttaatctctatctggcgcaggccagtgaaagccagcgccagcatgccattgaagagtacggcaatgcgatcaagcagctggctgccgccaacattttccccggcgatatgctgtttaaaaattttggtatcacccgacatgggcgcgtcgtgttttatgattatgatgaaatccggcctatgcacgaactcacttttcgcgatgtgccacaggcgcgttatgaagaagatgaactctgtgcagaaccctggtacagcgtggggccggatgacgtttttcctgaaaccttccgttatgcattatgcagcgagccagcgacaggtgcgctgctacaaaagcggcatccggaaatttttgaggcgggctggtggcgcgcgcaacagcagcgtatcgcccagggacatattgaggatgtgatggcctggcaacatgctcagcgtttcagcatccgttacggcagcgcgttgccgcccggtgtgcctgccgtgacaggcgttcaggcgtcagtatttgccagcggccatgagtcaaacaggtaaccatcaaagtcgaggtcatccacattggaaaactccagcaggcgctgtttaacattttccagatgttgccacattgcccgcttggcagcgcgagcatcttttttgatgagtgcagcaagaatttgccggtgatccactaaccatgctttgcgataaagcgtatcaccaaggtggctatgcaattgaatccacatgggattattttcacgccactgccatgactgacgaaacagttcgaccagcatgctgttatgcgtcgcttcggcgatggcaagatggaaatgcatgtcaccgctctctgagttttccagcgagcaggagaccagttcgcgctcttctaacagcagggcctggcgcatcttgatgatatcctggcgggtggcctgaagtgcagcaaactcggcgatattactttccagcagctgccgtgcctggagctgctcaaacgggcccgcatcattgcaaaagccggtgttcacattgttcatgtgcagcggcgtttgagactcaacgacgtaaatacccgcaccgcgtctgacttcaatcagcccctctatttccagcataattaaggcttcgcgcaccacggtccggctgacgtcaagcctctcagccatttcgcgctctggcggcaaacgctgaccacagcggtaaggggtttccagaacaagctgccgaatttttgcagccacctgctgatagggcctctgttgagaggcagatttcatgatgatgctcctgtcggacacgcgctaccggcaaaaactataccacctaaatcctgcggcaacagggttctacgcacgacaggataaacaggtcaaccagatgggtaggggatttattctttgcgtaacaagtatttaaataatcattaaaaagcggcgctaacaagtgccgcttttgaaacatctttgtgacgtgcaaggggaaacggtcacttaagcataaagtcgtattgtatgccggctttcacatcccagtaatagagtgtgtcacccagtgcgctgccaggccgtttctctctggcgcggtcagccgccacatacatgttgagtcctttgaacgatccctctgtgacgttgtacatcacgccgcccatcagccccagccctttgatcctggtatggcgctgcttgtcttcataacctcgggtgatcaccggccccagcatcacaccgaggttctggttaaagaaatattgcccgccaagctgaaccgacagcatgttttctttattgcgatcgatactcagtgaatcgggataaccgatgtcggtataaataatgcgaccatcaatgtcatgcgtcagtttaccgatagcgccaaacaggcgcgcattgtcaaacgagtaggttaaacgacctgaaaccagcgcggtgtcatgatggtagctgaggggtttactcattccctcaacctgaccgtaaaaccccatcaactcccatttcagcgagcgattatcatcaaaggtgtgggttttttcgaaaatgctttggatctgcgttgaaacatctggctggtaagaggcaccaaccgaatagcgtgaagaggcatcgtgccaggaaccggccagataagtgcgcgcccgacggggataatagttgcccgttgcggtgtcaatcaccccttcatcacgtataccggtagccgaatcaacatagtaaaaggcgcgcttacgccacattgaccacaacgtcaggttttctgttgcctcaaagcgggccagcacaccttcagaaagggtctgtatcgtgcgcgacgaattatcggcaatcaatgggatgcggtacggcaaactaccgtaaccatagtcagtcccaaatcggcccagggttaagtaaagattatcagcgggtttaagtttgagtgcgccgatagccacaccaaaactgtcgtgcccgtccagatagtagcgcgtgctccagctgtctttggcgcccagcttgtaaacatagtacgcacctgcgctaacgccgataaagtcagcgtagtagcgggtattcacgtcaataagtccgccttgtacccaggcgtaaatatcacgccccgtgccagcactgggcttatctgcccgtctaaaatcattttttaaacgaattcttaaactgtcttcattgtcattaatggcggcggcgtacggcagcgcggggcaaagcagcaacgcgatagccatgtagcgaaaaaagtgtgttttcataaaggaacccatagcgtatttattatttttttcatgacattcaggcgaaggcagagtgggctgctatccggttggataagccatgcgtaacgggcaacccactgtaaaacaggcctggttgaattaaggacgcgcgttattctcctgctgccacacctgatcatagtcatagccggtcagggccttcaccacgactttagtctcgggtgtacagtcggctttattcccgcccgccttcagacgatcaatttctttcaccagaacccgatgtgtttcgcgggtgagcttaaatttgaaggtcatatataagctgatgagtaataaaccgccggtgccaaagaccagcaggccggtaatcgcattcagagcactttcaggctggattagctggcctttaacgaaattactgtgttccagtacggtaccgaccgccataatggcgatggcgacggtacttttacgcatcagcgtcatgacaccggcaaaaacaccttcacgccgctgacgcgtgaccatttcatccacatcaggaataaagctgtaaatattccaggggataaaataaagtcccgcgcgaccaaagcccaacagaacaaagaccagtgtggtcagccaccatgaagaaaccgcgctatggccgatatacatcaaaatgagatagcccagtacaacaaaaacacacagataagaaatacgcatagcaagcgcgggccggatattcagcttgtccagcataaacataaaaagcagcgttgcgggaatggaaacggaggtggcaatcgaaaggtaggcggatgcgtttgccgcatccaggttcagaccataaaccacgaaataaacaaaaaccgcaatgaaaatatccagtgccgtgaatgatgaaatatagataatcaggtgctgtctgaatatttttatcttgaacgtcgtggccagctcgatgaacatatttttcaggtgagctaaaagcccaatacccggcccagaattgagccgctcaaacgcttcgggattcatatcttttgattcccaggtacagtaccaggtgatcagcaccacaataaaaaacagacctgaaaacaggatgccggtataggtaaaggtcagcgctgaatcctggcccaaatactggatcataatgcccggtactgaggcggtgagaaacacacccacctgcgaaaacgtcagacggactgccgccatccgggttcgctcaccaaaatcattggtcatctctgccgccagggtttcccagggcaccagcaccatagccaccagtaactcgacggcgagataggtgccaagatagtaccagtagcccatatcactgacccagaccagcgcatagataaacatcatcggggcgctgatcagcagaaagaagcggcgtcgaccaaaacgtttacccaatcgggtgctgccaaatttatcggtgatatagcccattattgggctgagaatggcgtcaatgatgcgggcaatagcaaaaatcgagctcgcctccagcatggaaagtccacaaaacgtcgtatagaaaaacagtagccatgtaccgattagcgccatggagccgccgccaaaaatatcggtaatgccatagcctattgcggtgcccgtccccaccttcctgcgtggcggtattgttgttgtcatcatggttttcccttgattaactcagtgtgacagtcataaaacatcttccggtggttatgcgttcgtgaagatgaagaaatattttctgtttggtttttaattagataaatagttatgtttaatcggagttttgtttaaatgatgatcctcctttgttgtttttattattttctgatctggctgttttaaataagtaaagcaagctgtgtattaatgtttggtttattttggttgaccagtattaagcgcggtagagataagaagtcagtttgtttttattgtttatcagtctgtttttataaaagtggtgcgagggaatagtaatcactctgctcttttaaaaaaaagaggttgatcacaaatcccctggatgtccatcagttagacttaaattcaatttttggttgaccaattaaataagtgaggtgttttttgcgacaggcggatgttatttagtgtgtttattatttggagtgattgttaagtaggatggttaataaaatatatataaagtgaatttaatgcgtaatgcaaagaatgcataacgataatgcctttcatttttccaatttattcaaggaatcgataatgctttattttacatcaggactggttaaatactctgcgaagcttgaagccgcaatagatgcggctattgattatgcaatagatatacagcgtgttgttgggtgcacggtgatggtggcaaaagcgggcgaattaatttatcagcgggcggcagggctggctgaccgagagcaaaagaaaagcatgacgccggacgccattttccgccttgcctcactgactaagcccatagtgagcctgacggcaatgcgcctgattgaacaaggcgacatgcgtcttgatgacgatattacccgctggcttcccgattttcgtccctgtctggaagacggtcagcctgcgaccatcctggtgcggcaccttctgagccacacctccggtttacgctaccgctattccgctccggcggattctctttaccacacgctgaatgtgtctgacgggatcgattaccaaccgggattgaccctcgaggagaatctgcagcgccttgcaggcacccggttacagttcaggcccggaaccggctggcgttattctttgggcattgatgtcctgggcgaaatcatggtgcgggcgacgggaaaaagcttaccggagctggtgagtcatcacgtaacaaccccactcgggatgaaagatacgctgtttagcgtcagggacagggagcgtttaaccacggtgtataccgacgacagtccggcgcccacggcgatgagtgataaccagcggatacctttcggtgaaggtgccgctattttctgccctgatcgtattcttaaacccgacgcctggccctgcggtgggggtggcatggcagggacggcaccagactttatgcaattgctggaaaccctccggcgtcagggatcgccactcatctcacaagacagttttgactatatgacgcaggaacaggtggcggcgaaatatgcgacccaggggccaggatggggatttggcgtgggatgggcattgctggtggaccctgatgcggccagatcgcctcagtcagcaggtacgctctcgtggagtggtgcttacggccacacctggttcgtcgatcgcaaaaacgaattgtgcgtggtcgccatgacaaacacgacaccggaaggggtcaatggtcagttcccgatcatgctgcgcgatgccgtgtataaagggttacaggcgcggtgacgggaaggcgctgacggctggcgcctctttttgaggcgctggccagcccgcaggtggctcgggtacaggctgttgctgatagagaccggggtttataacgtatgagggcggctgcgccagtgctatcgggcggtcagccgtgacttagcgaccactgtaggccagcgtcacctgacgcgcttcacggatgaccagcgcacccagttcggtaatgcgatcgtcagtcatgcgggcgatagggcctgaaatcgaaagtgcagcgaaaggttcgccatgttcgtcataaaggggagcagccacacaacgcaaaccgagggcatgttcttcatcatcgaaagaaaacccccgcgtgcgaatctgggccaggttcgttttcaggctttgtggcgacatcagtgtctttggcgtgtagtaatgtaagcctttctgatgcagcagcgcggtgacctgttcgtcgctgagatgggccagaaaagccttaccggctcccgatgcatgcatcggcagtttaccgccgatcggcgcggacatgcgcatcagttgcgtgcactgcacctgatcgataataacggcctgaaaatcgctaagatccagcaccgccaggttgactgtttcaccggaatgttccatcagcgtgcgtagcaccgggtggaccaacgccagcaggttccggctctgcaaaaaactgctgccgatgacaaatgcctgtgcgccaatggtccagtagcccaaatcgccttcctgccgcacgaaaccctgctgttgcatcgtggtcagcaagcggtgggtggtggaattaggcaggcccgcctgttgtgccagttcggtcagggctacgctgccatgtgaattggcgattaacgccaacagcgttaatccccgggtcagtgactgaacctgaccgcccacgggcgctgatggggcaggggtgccacggggttttttaccgcgctttgcggggacaggcgttgccatattgtctctccttttcacatagtggaaaccattttcgttttaatctcatcaattgcaaacgctgacgcgctggtcagacctgatagcggcttctgctgaaaatctcaactaaggttactttgagccataacgaccttatgcaagaatgactggctggtatttcaccagcggattgacgtggatgagacaacagtgagcaatctaaccgacgcgctgcatcagcaacttgcccaacgcattatgctattagacggtggcatgggcaccatgatccagagctataaactggacgagcacgattttcgtggcagccgttttgctgactggccctgcgatctcaaaggcaataacgatctgctggtgttaacgaagccagaggtgatccgcgagatccatgaagcgtatctggccgccggtgctgacattctggaaaccaatacctttaacgccacccccattgcgatggcggactaccaaatggaagccctgtcggcggaaatcaacttcgcggccgcgaagctggcacgcgccagtgcagatgcgtggacggcgaaaacgccagataaaccgcgctacgtggcaggtgtactcggcccaactaaccgcacctgttcgatctcacctgatgttaacgatcctgctttccgtaatgtcacctttaatcagttggtggacgcctaccgtgaatccactcgggcgctggtggaaggcggttgtcacatcattatgattgaaacagtgttcgatacgctcaacgccaaagcggccatctttgcagtcaaaacggaaatggaagccctgggcgtggcgctgccgttgatgatctccggaaccatcaccgatgcttcaggccgcacgctttccggacaaactaccgaagccttttataatgcgttgcgccacgctgagcctttatcctttggcctgaactgcgcgctgggcccggatgaattacgccagtatgtcgccgaactgtcgcgcatcgcggaaggctatgtcacggctcatcccaatgccggtttgcccaacgcctttggtgaatacgatctcgacgcagacgtaatggcacagcagattggcgaatgggccaacgctggctttctgaatattattggcggctgctgtggcacgacgccacagcacatcgccgcgatggcggcggcggtagaaggcgttgcgccgcgtaagcgtcccacgttgccggttgcctgccgactctcgggtcttgaaccactgaatatcagcgccgggtcgctgtttgtgaacgtgggcgaacgtaccaacgttaccggctccgccaggtttaaacgcctgataaaagaagataaatacaacgaggcgctggaagtcgcgttacagcaggttgagagcggtgcccagattattgatatcaacatggatgaaggaatgctggacgcagaagcggcgatggtgcgtttcctcaatctgattgccggtgaacccgatattgcccgcgtgcccattatgatcgactcctcaaaatgggcggtcatcgaaaaggggctgcagtgcatacagggaaaaggcatcgttaactctgtctcaatgaaagagggcgaagccgcatttatccatcatgcccggcttgtccgccgctacggggctgccatggtggtgatggcatttgatgaagtgggacaggccgatacccgtgatcggaagattgagatctgccgtcgcgcctaccagatcctgacgcaacaggtgggtttcccgccggaagacatcattttcgatcccaatatttttgccgttgcgaccggtattgaagagcataacaactacgcgatggattttatcggggcgtgcgaagacatcaagcgcgagctgcctcatgccatgatctcgggcggtgtgtctaacgtctcgttctctttccggggcaacgatccggtacgtgaggcgattcacgcggtatttctctactacgccattcgtaacggtatggacatggggatcgttaacgccggacagctagccatttatgacgacctgtccgacgaactgcgtgaggcggttgaggacgtggtgcttaaccgacgtgccgacggcaccgaacggttactggcgctggcggaaaaatatcgcagcagtaaaagtgacggtgcggatgaaaaacagcaagccgaatggcgcggctgggacgtggtgaaaaggctggaatactcgctggtaaaaggcatcacggaatttattgagctggacacggaagaagcccgtcagctggccgcacgtccgattgacgtgattgaagggccgctgatgtccggtatgaatgtggtcggcgatctgtttggtgaaggcaaaatgttcctgccgcaggtcgtcaaatctgcccgcgtgatgaagcaggccgtcgcctggctggaaccctatattcaggccagtaaagaagacgggcgcagtaacggcaagattgtgctggcgacggtaaaaggtgacgtccacgacatcggcaaaaacatcgttggcgtggtgttacagtgcaataactatgaaattatcgatctcggcgtgatggtgccaggcgagaaaatcctgaaaaccgcgcgtgaagtgaatgctgacatcattggtctttctggcttaattacgccctcgctggatgaaatggtcaacatggcgaaagagatggagcgtcagggcttcacgctgccgttgttaattggtggcgcaaccacctctaaagcccatacggcggtgaaaatcgaacagaactacagtgggcccaccgtgtatgtgcaaaacgcttcgcgcacggtcggtgttgtgtcatccctgctctccgacacgctcagggatgactttgtcgcccgtacgcgaaaagaatatgaaaccgtgcggattcagcatgcgcgtaaaaaaccccgcacaccgccggtgtcactcagcgtggcgcgcgataatgccacgaaaattgactgggagagttatacaccaccggtggcgaagcacaggggcgtgaggcgcgtggaagccgacattgatgtgctgcgcaattacattgactggacgccgttctttatgacctggtcgctggcaggtaaatacccgcgcatccttgaagatgaggtagtgggcgatgaagcgaaacggctgtttgccgatgccaacgccatgctggataagctgagtgcagaaaaggcgctgacgccacgcggcgtggtgggcatattcccggctaaccgcgtgggtgacgatatccatatcttcaccgatgagcagcgcgatactgtactgaatgtcagccatcatctgcggcagcaaacggaaaaaacagattttgccaattactgcctggccgatttcgtggcaccgaaaaccagcggtaaagcagattacctgggtgcctttgcggttacgggcggcctggaggaggatgtgctggctgaggcttacgataagcaacacgacgactataacaagattatggtcaaagccattgctgaccgcttagccgaagccttcgcagaatatctgcacgaacaggtgcgtaaaacgatttgggggtttgcccccgacgaaagcctgagcaatgaggcactgatccgcgagaattatcaggggattcgtccggctccgggttatcccgcctgcccggaacataccgagaaagcggctatttgggcgctgctggatgtggaaacccatacctgcatgaaactcacggagtcttttgccatgtggccaggcgcttcggtgtcaggctggtatttcagtcaccctgacagccgctacttcgccgtggcgcaaattcagcgcgatcaggttgaagactatgcggcacgcaaaggcatgtccgtcagcgaagtggaacgctggctggcgcccaacctgggttacgacgcagactaaaaaagcaaggcagccaaaaggctgcctttttgttagttaaaccgggcgtcacggtccgaggtcatatcgtacagctggtacttacgtcccagcatctgaccaccgtcacgggtgagcggcacccagttaatctgcgcacggccacgggttggcgtaacggtaaacagatccattggaacagagatgtagaagcctttggtaaagtcgccttcaccatactgctgcgatgacacgttggttttagtggcataaacgcccaccatcacgccactgtcgaagcgtttggacacatcaatggtgacgcctttatccttcgccagatactgcccgacgctggctttgaccaggacatcctgcataaaccagggacgccagtagcccgtgaggttaccggtaggtgcctcgtaacgggtgaatctcatcatgtcatcccagtcacgctgacgcacatagttggcgtccaccccaacggcccagttgctgtcaaccggacgatagagcacttccccacctacgccgccatacatggtttccagatagccgccataaacctgaccatagaagccattgcccagataatccatgtagttggcttgcagatcgttgacgtaaacattgttctcaacgtagtcgcgaatgtgcgtacgcacgcgcggcagcgttgaatccgcaggcgcgccgttgtagttaaacttgttgtagttattcgccacgttagcaaacaggctaccgccgaccagaaaatgatcggtaagccagtaatcgacgttgcccatcacgccgacctggtacagatagaaactttccgggccgcccaccgactggttcagtaccggcgacaggctgtaactcaggcgctctttacgaataaacatgccctgctcagttgggtccggatcaacaggatttttgcggacctgttgtaacggctgctcatgccctaacggataaccccccagttcattgcgcaggctggcaacagaggtttccgtggtgacttgcggcatattgtaacgcgactccgtcacgttaatggtttcaataccgtccggcagattattcatgatgatacgatttgcgcgatccacgccttcgcgtgtatcgcggtatttggtttgctcgcccgagacgtataacgtgctgcccttggtctgaatttttggccctgccaggccagcgttagacttcagttcagacagctggctaccggtgaccgtggtctccagcagtttaggctgcggattcggctggtaagcaggcttcggactgtcgatatgatcctgatgcatatcgttgaaattagttcggatggtaaagccgaacataaaggtgttgccgcgttcatagctggcattgatatctgcccagtccgtcaggcgatagatcgcgcccacgttgaccttgctgcgttgcggcaggcgtccggcaaaatcatccttgtaatcgttaccttcgtattccaccttcaggcgcagcggctgccacggcgtctggtattcgatcccgccgaacacggcggaagggccatggaacatctgcgagccgttgatcgatcccgcctgaccgacgccaggacgctgacagtagctgtcgctgtaggaacagaaggggtttttgacggtgccgctgttgcccagatagccccagcccatccccaacgtaaagtcaaaggggccccaggctttggtggcgaccagatattcactgtcaaacaaaccggtaccgcccagatcgcgggtaccaaatgacacctccggcagccagtaaccttcctgccacagtcgcagcttcaggtcgaaggccttatctttatagctttgattgccgctgaagctttccaccgcactgtaacgccgggtccgcacgtcggtataacgcacggtggtttccagccaggggaacagctgtaacgaagcagaatagtagcggtactggtcattatcacggaagttcaggctgaattcgccctctttcgccatacgcgcggtaggcacctgcatcaggcccacaccgccaaaatcagactgcgaaggcgttaccggggccgcatacatttccgcatgggcctggcaggcgcttgccacagaaacagccaacaggctgagaagataacgttttttcatcagtctggtatccggtgagtcagaacagaaacgaggcggctattcaggtcttcatacgcgccaggcaggctccatgacgaaaagcccgtcataatgatgctgccgggttcgggttcgacgtggcggtgattccagtaagccacgggcgcttcctgcgtcgtaccatccggcgcaatcacaatcgcgatgttgcgttctgcaccagacaggagcgggtgatcgctcaggtaatcccgcactgatttacccggttgccagctcacagcaccggcccccgcgatggggccaaacagcaggacgctggtgctgggctgggtcagatagagatcgtaacggccttccaggcggcggttatccattgggtgcaggcgaatccagtcggggtccagtgacgtgaactgccgcccggtcaccttgatgctgcttaactgacgtatcacagcatcaatggcggcggcttgttctccgctgctgtcagcacgccaggcacgtagctgcgccagtgtctgctgatactgttgttgtgctattgccgtcgcgccgtattcggcaatgacggcgcgacgccagtctgtttgtgccatcagtgcgggctgagtcaccaactgggccaggttctctacctgattgacctggacgctgttcgtatcatggggcgcatgcacggtgacctggcctgcggcctgcgcacccagactggtgagcaggctcactcctgccaacaatagtgttatttttttcatgattttgccggcttcagaatggtgatatcaacagggaaagtatcggcagccagcatctgtcgggattgcaccacctgaccactgctgttgtcgatccagaacgtgttttgccactcgcggttaaggctgtcgatatgcagctgctcatgccagacgcgacaggcaatgcggtttcccgcaatattcagcacctcatcgtcgccacgctcaaaggttgagctcagggtaccgctatgaacgttgccctgaacggtccactgaacaatccgcgtccagcgctggccattgctaatgtgcaggccttttgccagcgggtcttgctggagattgctgacgcttgtcaggttatcaggcaagcccagggttttaatcagtctgccgtgtgcggtgaccagcatggactgatcgcgcgtcacccacttttgctgaccgttttcgttataacccaacacgacaaaaatgcgtggaccgtcattgattcgggcatacaggctggcatagggcagattatcaatctgctgaggcgtaacggtgacgtcatctggcccttcaatggccatcatcacggtttgttcgagtcctttttgcgtttgtgtacaggcctgcagcagcaggcaaacgagcagcagaggaagttggcgcacagtgtgtccctgataaatgatgccaaagtaaaaataaccacacgaaagtgtggttatgtttaaagctcccgtacccttactctttcaggccgccgacgcagtggcgtcctgatggcgactcattaacttgcgcaaatgaatcgtgatatgcgcgttcgcagccttgctacagcccgaaggagcagggtacccatcaacgtgtggtgcccgttgtggttgtggttgttgtaccagtatttgccccgtcaccaccgccagaagcggcaacaccgagtcctactaacgcgccaagcacgccgatacccacagcggtagtcgtacctgcggacatagtgcccgcttgtgcgcccgctgcagcacctgcttcttccggcgcggcaaacgcactggaagagacggctacgatgagtaatgccagaccggcaatcatgcgttttttcataacaacacctacattgagtgaatgaaggattgctatccgacaattctgcacaacagaatgaaccgttgccgcaaagtcgaaggacagacccattacgggcgcgtccagtatagggcaacaaaataccagagttcagtaacgtaaaaacctgtcgaaatgcagggcaaaaaacgggctaaattaagtaaatttagcgttaacttattttaaagccgtgagtttgtcttaaaaggccgaatatttgtctgcgaacagggagaaagcaaagcggtttctacttatttagtattgtttggtacggaataagaataatcggaatttcctcacgcatgaataaattaaatagcattataaaacaacaggtaagaatgttctgtgtgctgatttaggtccatttttaataagattgtcatattcaaacacctgtcatcttcagatttgcctcagcctattttaagaattatccaatccgtttgcgggcttttcagattaaaagcgggttgcactcagcgccatgcaatgaaaaaggcgactaaatagccgcctttttgtgcttgtggaaatttaacgccagctcttgtagcgattaattaaggcattagtggagctgtcatgactggtaatattactgtcattttccagctgtggcagaatacggttcgccagctgtttacccagttcaacgccccactggtcaaaggtaaagatattcaggatggcaccctgggtgaagattttatgctcatacagggcaatcagggcacccaggctaaatggggtgatttcgcgtaacaaaatggagttagtcggccggttaccttcaaaaaccttaaacggcacgatgtgcgccaccgattccgcagatttgccggcatcggtaaattctttctgcaccacgtcacgcgatttaccaaaagccagcgcttcggtctgggcaaagaagttagagagcagtttagggtgatgatcggcaagcgcattgtgactcactgccggtgcgataaagtcgcacggcaccagtttggttccctgatgaatcaactggtagaacgcgtgctggccgttcgtgcccggttcgccccagataatcgggcctgtctggtaggtgacaggctgacctgcacggtcaacgtatttaccgttcgactccatatttccctgctggaaataggccgcaaagcgatgcatatattggtcatacggcaggatggcttctgtttcagccccgaagaagttgttgtaccagattccgatcaacgccagcagtaccggaatattctgttctgcgggcgtcgttgagaagtgcttgtccatggcgtgggcgccactcagcaactgctcaaaattatcgaagccaatggagaggataatcgacaggccgattgctgaccacagtgaatagcgaccgccaacccagtcccagaattcgaacatgttgtccgtatcaataccaaattcacctaccgctttggcgttggtggaaagcgctgcgaagtgcttggcaacgtgctgttgatcgccggcggttttcaggaaccagtcacgtgcgctgtgcgcgttagtcatggtttcctgcgtggtaaaggtcttagaggcgaccaggaacagcgtggtttcagggctgagatctttcagcgtttccgcgatgtgcgtgccgtcaacgttggacacaaaatgcatgttcaggtggtttttatacggacgcagcgcttcagtgaccataaacgggccgaggtcggagccaccgataccgatgttaacgacatccgtgatgggctttccggtatagcctttccagtcaccgccgataatgcgttctgaaaagcctttcattttttccagcacggcgttgacttcaggcatcacatctttgccatcaacaataatcggcgtattactgcggttgcgcagcgcgacgtgcaacacggcgcgatcctcagtgcggttaatcttctcaccggagaacatggatttaatcgcaccacttaaatcggtttcttttgccagtgcctgaagcttatcgagggtttcctgggtaatgcggtttttggaaaaatccaccagcatctggtcgtcaaaggtggctgagaatttagcaaaacgatcggcatcctgggcaaacaggtcggcaattttcgccgttttcatctgttcatagtgctcttgcagcgctttccaggctgcggtttgggtcggattgatatttttcatggcaacactcttgttgatattaagaaccgtcattccatcggggtcgcatcgtacccggttagcatttcagtatgaccacagttgcaactgaaaggaaaattttgtctgcgccataatggcacggtaatgaaaaccgtctgtttcacggtggataatgccgctaaatttcagtctgatcccatgggagaaaggctgaaaagtatggcgcattggcggcccgcatactttgtgccgcatcagaaagtggtggccttgctgaagccattaagcactgtagtcgctgcgataaggcgaaatttgttatccggtgcgctctgcatgaaaaattgtcccacgacggtgattgacagcaggggtagaaatcgataaatctatgcgcgctacttgcgcacctgtgcgcaagccagaagaggcgcgtcgcccaggcagtgtgttggaggaaccgtatccggagataacacatcagggggagcgacgccgaggtggtcaacacacggtgtgttgcctgtcggctacaggggctgaatcctctgggttgtcaccagaaacgtccacagtcggacgttttgcaaggtggagcgcttctgggtgactcgtctattcgatcttgtctgcccgtttctgctctttccttgtgcttaggctgaattactgtttctcatccgtcaacgggtgagggcaacgtaccctgacacgaggtcatacaatgtctctgaatctgaatgtagcgaaatttggcggtaccagcgttgccgatttcgatgccatgaaccgtagcgccgatgtggtattgcaggacagcaatacccggctggtggtgctctctgcctctgcgggcatcacgaatctgctggtctcccttgcagaaggtcaggagacatcgcagcgtgcggctcaacttgatgacatccgccgcattcaatatgccatcatcgatcgcctgcaacatcctgacgttattcgcgacgaaatcgaccgaatgatcgacaacatcggcatgctgtcagacgcggccgcgctggccacctctaacgccttaaccgacgagctggtcagccatggcgaactgatgtcgaccttactgttcgtcgagatcctgcgtgaacgccaggtgaatgctgaatggttcgatgttcgcaaagtgatgcgcacgaatgaccgttttggccgtgctgagccggatgtggccgttctggcggaacaggtcagcgcgcagttgcagccgcgtattgcggcgtcattggtggtgacccagggctttatcggcagcgaagaaaaagggcgcaccactacgctcggtcgcggcggcagtgattacacggcggccctgctgggtgaagcgttaaaagcgtcgcgcgtggatatctggactgacgtaccgggcatctataccactgacccgcgcgtggtgcctgcggctaaacgtattgatgaaattacctttgaggaagcggcagaaatggccacctttggggccaaagtgctgcatcctgcaactctgctgcctgccgttcgtagcgacatcccggtgtttgtcggctccagcaaagatccggcagcgggcggcacgcgcgtctgcaatgagacagccaatcccccgctgttccgtgcgctggccctgcgtcgcaagcaaaccctggtgacgctgcacagcctgaatatgttacacacgccaggcttcctgtctgaagtgttcaatattctggtgcgtcacaacgtgtcagtggatctcatcaccacgtctgaagttagcgttgcgttaacgctggataccaccggttcaacctcaacgggcgacaatctgctgagccaggcgctgctgacggaactgtcgtcactgtgtcgcgtcgaggtggaagaaaacctggcgctggtggcgattatcggcaacgagctgtcaaaagcctgcggggttgggaaagaggtcttcggcgtgctcgaacctttcaacctgcggatgatctgttacggtgccagcagctataacctctgcttcctggtgccgggcaatgatgctgaaagcgtggtgcgtacgttgcatcacaatctgtttgaataagcgcatcgccaggataagtttgaagccggacattgtccggctttttaatgaccagctgctgaacggcaacgcgttctttcacagtaatccctcacttgcttataaggatgtctgttcatgctcgccaccttaactcgcttgtttcctctgtgggccgtcctgttatctgcggctgcctactactcacctacgacctttcttggcatcggtccgtgggtggtgtatctgctgatgctgattatgtttggcatgggcgtgacgctgaatattgacgattttaaacgcgtactgacgcgcccggcgccggtaatcgccgggacctttttacactatctggtgatgccactggcggcctgggcactggctaagctgtttcatatgccgcccgatctctctgcaggcatgattctggttggcagcgttgccagcggcaccgcctctaacgtgatgatttatctggctaagggcgatgtggcgctttccgtcacgatctcttccgtgtcggcgctggtaggcgtgtttgccacgccgttactgacgcgcctttatgtggatacgcacattcaggttgatgtcgcggggatgttaatgagcatcgtgaagatcgtcgtgatccctatcgggttaggcttgatcatccatcacaccatgaacagcgtggtacgccggatcgagccttatcttccggccttttccatgatctgtattctgttgatcatcagcgccgtggtggcgggcagccagagctttattggatcagtgggggtgatggtgattgccgcggtcatcttgcacaatgccattggtctgctgggaggttactggggcgggaaactgtttggcttcgatgagtccacctgccgcacgctggcgctggaagtcggcatgcaaaactccggactggctgcaacgctgggcaaactctacttttctccactggcagcgctgccgggtgccttgttctccgtctggcataacctgtccggttcgctgcttgcgggttactggtcgggcaaaccggtcgagaaaaaaaagtaacgctgtgcgggcgaagctgacctcgcgggggccaagcggcccccgcatgttaatcgtcgtcccgctcatcatcaggctgctccagcaccgtgtaggccaccgcgctaaacagcgagttcagccgcttcatatcacccagcaaccccagatgcagcgaactggtttcaatgctctgcacgttctgctgatgcaggcggttaacatgggagtgggaattgcggcgtattttcaggcggaaacggtgcttggcgcggcgcagccgcttcgcgctggtgacgtcgtgggagagaaaaaccgacaggctcagccgcaggctatcaatcagctgttcatgtaatgcttccagctctttcagcccctctggcgaaaaggtgcgtcgcgcggcaagggatttgtcggccacatcgccgctcatgcgctcgatgatatcgcctgcctgttccaggttcagcgacatttcaatgatttccccccagcggcgggaatcctgctcggataaatcctctttgggcatgcgcgccagataaagcttgatggcggtatacagcacatccacgtcatcatccagccgccgtaccctgcgttccgcccgggcttctccacgcaccacttgcagaaacgtatccagcatctgctccagcacatcccccatgcgcaacacctcacgtgcagcattgaccagcgccagtgctggcgtatccagcgcgctgctgtcgagatgcctgggcttcagcgtcgtctcgctttcggcatcgtcagcgatcagtcggcaacacaggcgcgccatggcgtcggcaaacggcaccatcaccacacagcgaatcaggttgtagaagacatgaaagaagatcaccagctcttcgtcatttaccggtagcttatccagccacactgccagcggatcgacaaagggcagaataatcacgcagccaatcaacttgaacagcaggctgcccatcgccacgcgtttaccggctgcgttggaaccactgccattgatgacggccagtagaccgctgccaaggttagcgccaatcaccagacacagcgctaccttaaaggcgattacgccggttgcggtgagcgtggccgtaatcagcaccgccgccaggcttgagtagctgataatggcaaagacggccccgagcagggcgtccagcatcacgtcaccggttaagctggagaacagtacctgtacgccggatgcctgagtgataggtttggcggcttcgacaatcagttgcagtgccagcaggatgagtcccagaccaatgctggtgcggccgagctgtccggcccgggtttgcttgcggctgatgaaaaagaccacgccgaaaaagataaatagcggtgaaagccaggagagatcaaacgtcaggatgcgcgccataatggccgtgccgacatctgcccccaatatcaccaccagcgcaggcgtcaggctcaccaggttttgagcaacaaacgacgtcaccagcagcgtggtggcattgctgctttgcaccagcatggtgacgccaacgccggcaagaaacgccatgggtttcttttccacgctgcggctgagtacccggcgcaaatcggcaccatacacgcgcataatcccggagcgggtaatatgtgtgccccataccagaagcgcaacggcagagagtaagttaagcagggttaacacgtatagtcgctcctcaaccatcaggcttcaggcggtgcagattgccagcctgatggaaagcgcaatctgagaacgtggctaccggacgctgcgcaatttttttcagtgttttaagcaacctgcgcaatgtcgacatctttaaatgtagactactctactgatctgcatggacaaatccaacccggcgcacgtcgctcaccttcctgattgtgcacgcctgaaacaggactgaacgaatatctacggcggaaagactggctacagacaagacgaggccgcccgttttgacagtgctgaaggggaagacggccgccgtcagtccagggtgaggtgccgctgcggttcatgatgaccccgcgcggcgggaatgtggaaatctgtacgttctctgcctggttttcagcgcgttaacgtcaggacgctgaacccgccagcaaggcgcgatggaccgacttatcatgtgtgacgccgagcagcgaacacagggtgccgcagagttcggtttgttgcggggccagcccggcctttcgcgagaagccttcaccaaatacaaacaggggaacggtcgtttcttctggcaacatgccaccatgcgaacggtcatcgttcatgccgtggtcggcggtaaccatgacctgatagccttctgccagccagcctggcatccactgtgacagataaccatctgccatgcgcgccctgttgcggtacgcggcagaagacaggccatgctgatgaccggcatgatcgatattcatcggatgaatcagcaggaagtccgggttgtaacgtaaccgcaggctttcggcatcttcaaacaggtgggaatcgggatagccgtcgtcggagtaaaagtgcccaaactgaacaggcagcgtcggggcgtccgtgtgacgatcgcgggccggttcgaagggcgtgcggttatacagttcgcttatccagtggtaagcggcggcggcggtggtcagcccggcgtcacgcgcatagtgaaacacactgcgttcgtggctcatgcggttgacatcgttatgaataatcccgctttccaccggtgtgacgccggtcagaatgcactcatacagcggacgtgacaacgaaggcagcgcacaggtcaggctgtagtaatggcctttgccatgggcacattctgcatgcaggtagcccatagcgtgttgtgccacgtgatgactcaggccgtccagaatcaccagaatcgttttcatgctgttctccttactgtggcttaggttgtgcgcgtcggtactcttaacagggcactattgggttgtctgatgcagcgttattgtttcgctcatcgggaatatccaggtttatcaatagcttttttgattgtaagtacacacaaacttttctgcgaaaacggagtgggttaaatgccttttcccggccgcatcgcgtcttatgcgctggcacttcgcctgattagccgccagtcgatacaggcaataccgctacataaagttgtgaatgcgtagagctgagcgttgtcgggctaaaaccgggtctggatcattcggtcgccaaaaccgagtcaatgtagccctcacatgtgaaaaagggatgacaggctttaccaacaggtggaatcaaccaggcagttataaggggataaccggcgtcaggcgtagcaacagcagcagttgacgcgcgatgtgcgtgaaaacatccatcctcacccgcgctgttcttgctttatgattctgatctttcaggggttatggcgttcattgataagccttgctcatgtcacatcgggaggcggaatggcagcgggtgcggtaagcctgacggttatattgtgatttaggtcacactcacgcatgatagcgccaataaaaccccatttaatttttgaggcgtgacatgagtgacaaaaacccggtagcacagaagattgcgcgcctgatgcagtgggtactgaacgcgggactgctgatcctggcggtgattttgatggtgtttttgggcaaagagacagttcacttagccaatgtcctgtttagcaccggtgagcaggcgtcgtcctacttgctgattgacggcattgtgatttattttctctacttcgaatttattgcactcatcgtgaagtacttccagtcgggctaccatttccctttacgctactttgtgtacatcgggattaccgccatcatcaggctgatcatcgtcgaccataaaaatcccattgatacgttatgttattccgcggctatcctggtgctggttatcaccctgtggctggcaaacagtaaccggcttaaacgcgagtaacgaagccgtcagcattcaggacggtgttccttgtatcgctctgcgctaaactacctctctgaaaatttttgggggaaagtgccatgacgcaagacccgctccgtttattacgttcactcacctggctggcgctggacgatgccgcatttacgcaaccgcttcgtgactggctgatggaggaggactccatgacgcgacgtttcgaacagcattgccagaaggtcagggtggaacctgtacgggaaggctttatcgatgctgacgaattaggcgacgaaggcgcgttattacctgcagaccagcgtttctggctgcgtgaagtgattctctacggagatgagcagccgtggctggcgggacgcacgctggtgcctgaaagtaccctcaacggcccggaaaccatgttacaacaactcggtacgcgacctctgggacgttacctgttctcctcttcaacgcttacccgcgactttattgagcctggcagcgttgaaacgctctggggacgccggtcccggctgcggctgtcgggtaagccgctactgttaacggaactgtttttaccggcatcgccggtctatcgtgatcaaggttaagggtttgacctgtgcaaaacacacaaaaaatgacgaaatggcaggcttacagccgcctgatgcgaatcgataaaccgatcggtgctttactgctgttatggccaacgctgtgggcactctggctggcaaagatgaccgtcccaccgctgccgacactggcggtgtttgtcgccggtgtctttgtgatgcgcgctgcgggctgtgtgatcaatgattatgctgaccgtaaggtagacgggcacgttgagcgcaccaggcaccggccgctggcaagcggtgccgtgacggcgaaagaagccaaaatgctgtttgtggtgttggggctgattgcgtttgccctggtactgagcatgaacctgatgaccattatgctctcggtcgtgggcctggcgctggcctgggtctatccgtttatgaagcgatatacacatctgcctcaggtggtgttaggcgcggcctttggctgggcgatccccatggcatggtcggcagttagtgagtccttacctctggtctgttggctggtattcctggcaaacatttgctggacggtggcctacgatacgcaatatgccatggttgatcgcgaggatgacctgaagataggcgttaagtccacggcgatactgtttggtcgctatgacaaattgattattggtctgctgcagctgtctacgttggtgttgatggcgctggtggggacgatgctggatctgaacggcgcgttttactggacgctattactggctggtgggttatttgtttatcagcaaaagctgattgcgcagcgcgatcgtcaggcctgtttccgcgccttcctgaataacaactatgtgggactggttctgtttctgggcgtgctgatgaatacgccgccgttcttacaactgctgtaacaggcgcggcgagccacgcctgccagtctgcagacggaaggatgcgttaatgcaggtttgaggatgatgttaaaacgcgaataaaaaaggcgacctgcaaggtcgcctttttcgtcttcactgatccgctaatcgtgcgctacggcgctttcgatggtcatgcgtacatcgctggtgaccaggtcagccaggatgtgccaggtcgccagcgtctgcgccacgtcggcatcaccgctgtcgctgatataaccttcatcacgcagcgtgagcaccagtgaggagaataccgctttatcaaagaactccggcgcattgatcccgtgcaacacgctcaggcgctgcgccagggtacggctctctttttccagcgtgccccggttaatggtgggcttggcgctaagaatcgagaaggtgatggcgtaacgctgcagcgtctcacgcacaccggcggccagcagttgaagcgtacggtaacgcgcggtgttaaacgacagcagacctgcctcaacggtaatcagcccctgacgcgtcagttcctgacataagttagtcagtaactgcggcagttgatcatggctccagcgcaggaacagctcgctcttcagcatgggatagatcaggctgacctgacgcagcagttcggcttcgctcaggttgcgatgctgctgcacaatcgccgcaatcagcgacggcatgaccagcatatgatgaatgttattacggtagtaggtcatcagtaccgcctgctcgcgcggcagaataatgatgtcaccaatactgtctttttcactctcgaatttgttcatgctgagcgcatgatccagcagggcttcggcagacatgtcgggcaaggtggcatccggcgagtagggcacgttgcgcagtaactgggtatagcactccagttgctcaaccaactgctcgcgggtcaaagagcgctgacgcgaagcaagcagagcggtaacgcacaggttcatggcattcgccgcgccggcttcgttaatacgcaccatgatggtggccgcgatatcgtttgccgccggggtcaaccagccgggacgctgtgcttcaatgggatcgatagcatcgcgccattcaggaacgtgcttattcaaataatttatcagcggtagcggctcgccaaagttcacgtaaccctgacctagattgcgcagcttacgtaagccgcgcaccatctgcatgaagccttctttctctttcgtggcaccgcgaagctctttcgcataggtgcccacttccatgacatgttcgtaaccgatgtatataggcactaacgtgatagggcgcgtgccgccgcgtagcatggcctgcagcgtcatggacagcgtgccggttttcggatctaacagccggccggtacgtgaacggcccccttccacgaagtactccacggaatagccacgggtaaagagttcacccaggtattcacggaagacggtggcatagagcttgttgcctttaaaggtccggcgaataaagaaagcacccagacggcggaaaatcggcccggcaggccagaagttcaggttaataccggcggcgatgtgcggcggaaccagcccctggtgatacagcacgtaagacagcaacaggtaatccatatggctgcggtggcagggcacataaacaatttcatgaccgtcctgagccagctgacgaacgcgctcaccgccgttgacgttgatgccctgataaagtcgactccagagccaacccatcacgcgatccgtgacgcgaatcgcttcgtaggagaagttggcggcaatctcctccatcatttcaacggcgttttgctgtgccttttcatgcgaaaccttcttgctgcgggcttcgtcttctaccgctttttctatcgctttcgattgcagcaggcgattgaacaaatcctgacgcgcaggcaggcgcggaccgaccgccgccagacgctgacgggcaaagtggatacgagcgacccgggccagtttttgcgcaattgatttatccgtaccgtgttcagtcgccatacgacgcagggaaacggttggcgagaagcgcacaaaactgtcgcgaccatgccagagcacagcaaagaatttttgtaccccatttaacaaacgtaaatgaggcggattatcttctccctgcacttcccggccgggtgcgcggccgaacatgacggaaaccggtaacatctggatatcaagctcagggttactgcggtgcagatcgagatactcgtggaagatttttaccgactcgacgctgggcacgaaatagggaaacacgcgtgggccatcgtggataaaaacatgacgcggcagcaaggccccgtcaatctccagcggcgaaagcggatcgggcagctcgtgcctgatgcactgcgcgcgcaaagtcaggagatcggcctttgaatcataaggcaggacatacataataggccgggttgggtccagcccatgttcggatacgggatcggccggaatggccttactctttaccagaaacgacaggggtaaattcagtaatttataaaaaagtatacgccaacctgacatagacaacatgaagcctcttgttagcaaagcggcgcaagcttatcagaaagcgcagcaaaaatctgtgacagcgacaattgtgcgctgcccaatattgacgtcaatcctttgaaaagagttcctttattatgacaaataatgtcaccggccttaaccgaattgtgaaagctgcgggctattcatggcaaggtcttcgtgctgcctggcagcatgaagctgctttccgtcaggaagcggttaccgcactggtagcgattatcctggcctgctggctggatgtcgatagcgtttcgcgcatcctgatgattggctctgtcgtactggtgattattgttgaagtcctgaacagtgccatagaagcggtggtagaccgcaccggtcaggagcggcatcctcttgctgggcgtgcaaaagacatgggctccgccgccgttttcatcgcaatattactggccctttttgtctggggaacgctgctttggtcgcatttgcgataagcgttccatctcgcgtcaaataactgattttggcctgagttttggtttccatttcaccaatacctgtatatactcacagcgactgtataaacaaccagggggcgggatgaaagcattaaccagcaggcagcaacaggtctacgacttgattcgcgaccacattaatcaaacaggcatgccgccaacgcgtgcagaaatcgccgcgcagcttggttttcgttcgccaaatgcagccgaagaacacctgaaagcactggcgcgtaaaggcgtgattgaaatcgtctctggtgcgtcccgcggtatccgtttgttaatggaagaagagccatcagacggcctgccgttgattggtcgcgtcgccgccggtgagccattactggcccaggaacacattgaaacgcattacaaagtagatcctgacatgttcaagcctgcagcggatttcctgttgcgcgtgagcggaatgtcgatgaaagatatcggcattatggatggtgatttgctggcggttcacaaaacgcaggaagtgcgtaatggtcaggttgtggttgcgcgtattgatgatgaagtcacggtaaaacgctggaagaaacagggttctgtggtgcatcttttacctgaaaacaacgatttcgagcctatcattgttgacacgcgtgctcagtcgctcaccgttgaaggtctggctgtcggcattgtccgtaacggtgagtggttgtaaaacccgttaaggttattggcatgcgtcaatcttaacgttctccagtctgcccttactttgccgctgtgggtttatctctggccccggcggtttatcgcacggattcaagaatgcgctttctgacagctaccgataaaaacctgtggcggttagcgctgcccatgatcctgtcaaatattacggttcctctgctcggtctggtcgacacggccgtgatcggccatcttgacagcccggtttatctgggtggtgtggctgtcggtacgaccatcaccagcttcatcttcatgttgctgctctttctgcgtatgagtaccacgggcttaacggctcaggcattgggtgcgggtgataagaccgctctggcgcgagcgctgactcagccactgctcatcgcgctggtcgcgggcctcttatttatcttccttcgctatcccgttacgacgttagccacccgctttattggtggggaccccgcggtattggaacaggcagccctgtttatccatattcgctggctcagtgcgcccgcaacgctggctaatttagtcatcctgggctggctgctgggcgttcagtatgccagggcaccggtcatcttgttggtggtaggtaacgtcattaatatcctgttggatctctggctcgtgctgggtttgcactggggcgtggcgggtgccgctagcgccactgcgctggcagaatacgcaacgttactggtcggtgcggtgatggtgtggcgcgtactaacgctgcggggtatcaccttggagatgctcactcacagctggcgcggcgacatccaccgccttcttcgccttaatcgcgatattttactgcgcaccttgctgttgcagctctgctttgcctctcttaccgtgctcggcgcccgcattggccctgacgtcgtcgcggtcaatgccatcctgttaatgttcattacgttcaccgcctacgcgctggatgggtttgcctacgccgtagaagcctttgccggtgaagcgcacggggcaaaaaacggcacccggctgcagcaggtatggctatctgcctgtcgtcaggcgctggtggtggcgctgtttttctcactcgtctatgccctgtttggctatcagatagtggcattcctcacctctatccatgcgctgcaacaggccgctgaccgctttttgatctggcagattgtcatgccgctaatcggcgtctggtgctatctgttggatggcatgtttattggtgcgacaaagggaagagaaatgcgtaacagcatggcggtggctgccttgggctatttcctgacgctcgctacggtgcccctgctcggcaaccatggtttgtggctggcgatagcggtcttccttgccctgcgtggcttatccttgtggctggtctggcgtaaacactggcgcaatggcacctggttcactgcctgatcgctgaaccggaattatgacgcaggatacatattattttcattttttccggcaaacctgaaattacctactacaattaactttgaatggtgctgttaagtagcgctttatatcgtgattttgtttaactgcaaaataaaacgaaaccgaaggatgacgtggaggtctgcaatgaataaagacgaagcgagtggtaactggaaacagttcaaaggaaagatgaaagagaaatggggcaagctgaccgacgatgatatgcaagtcattgaaggtaaacgcgatcagctggtcggaaaaattcaggaacgttacggctacgcgaaagaagaagcggagaaagaagtaacggcctgggaaggttccaacaaagattaccgctggtaatcacgctttcagggacgctcctacccgggtcggtacgctcatgccggccaccgcacaaggatgtgcacattaaccctgtaaccctgtaaccctgtagccttgtaatcccaaccctgttaaccccgtttaccgcgctttttcccttcagtctgatggtcgtgatcacaatgttcatgatgttcacaggcctcaacttcagcacagttctcacataagccatgggcttcaatcacgctatggcgtagcacaaagtgtgcctcctgagccaaagacgcgatgatctgctctgcgccttgagcctgcttctctgtcaccccagcacagcgatcgcaaaccagcataaccgacgtatgcgcaggcgcttcgaagtgatgacacatgacatagctgttattcgattcaacccgatgaataaaaccctgttcgagcaggaaatccagcgcacgataaacggtaggcggcttagcctgcggctcgctaacccgcaactgatcaagcaggtcataagcactgatagagcctggctgtccggccatcaaccgtagcacttctgctcgctgggtcgtcaggcgaacaccgcgctgtaaacacagcttctcagcctgggtcataatttgctctggcgtcatggttgacatggcgtttctccgctagacaggtgatgttatcttatcacaataattgttatgacgttgaaccttgccgccagccagacagcgcccgcttacacgcttctgtttcttcccttccattcgcttatcctttgtcgacagctggcttcgtaccagtctgtttcagaatgtttatagatattttttacttttactttacatctcactgagttaagaactaatgtttaaatgttcttaataaagtgctggcccagactggatttgcctgaagcattttcggcgggaacctcacatatcggatcgaaaaacaatcaatccacggaattgcgccactatttactctgaattcacagcaataaagcgttagcaatcctccacaatggagctaacaaactattcagtcgttaatgtattaacggcaatatttcaggtgatgataagcaaatggcaaaattaaccgttccacgttccgttctggtttttcctgcagtattcaatgccctggttttttcatcttccgcgctggccgccggaacctggtatgatgcccgcaacgacgccatgggcggaacgggcgtggcgtcctcaaactacggttcggctgtgttggctaacccggcgttaatgaccaaagccaggcccgacgataacgtcagcattattattcccagtgccggtgtgcaaatcacggacaaagacaagatggtcgataagatcgataccatcacggatacggtaaatcgctatcaggatctgttcggcaacgccacaggatttgagctgttacgccgtatcccgcaaatccaggctgcctccggcgacttagccaatacgctcagggatttacgcggtaataaagccaatgccacagcgggtgcggcgatcgccgtaaccattcccaatgaaacactgccttttgcctttatcaccaaggcttacggtaccgcgcacgttcgcgcgaatgtgaaagaaggtgacatcgttattctgcagggcgttgctgatggcacttttgcaggtattcctggcggtgcctttggcctggcgaacgttcaaaacctgctgggctccagcgcgaatggcctggcggcgttgaatacggattacggtatttccgttgcccatgagttcacgattgccggacaacctgtctcaatcggtattacgccaaaactgcaaaaaacctggctgtataattactccgccagcgtctataactacgacaaaaacgatttgcgcgacggtcgttaccgcagcaccgaaagcggttttaacatcgatgccggtgtggcgacggtctttgccgaaaactggacgctgggcgtgaccggacaaaacctggtttcccgcgatctgcaaacgaaagaagtgaacggctatcgcgatacttacgaaattcgcccattagtgacggcgggcttagcatgggataaaggccccgttaccctgaccggtgatgttgatctgaccgaaacccaccgctttaaatcgcaggaaaacagccagtacgctggcgtaggtgcggaataccgcgtgctggagtggttgcagttacgtgccggttaccgcgcggacatgcgttctactgatgaaaacgtggccacagccggtttcggtgtgtcaccgttcaacaactctgtgcatctggatctggctggctcagtgggccaaaacaatacctggggtgcaatggcacagcttggatttaatttctaatcccttgccattaacgggcgggcgataccttgtcgtccgcccttatgctatccttgcgcagaatatcatcactgttaactaccggatcgactgcgcttcatgaccgatactttttcatcccaacgcttttctgttgcccccatgctcgactggaccgatcgtcactgtcgctactttcatcgtcaactcactgcggacacgctgctgtataccgaaatggtaacgacgggcgcaatcattcacggcaaaggcgattatctggcatacagcgaacaggaacatccggtcgcgttgcaactgggcggaagcgatcccgccgccctggcacagtgtgcggcgctggcggaacagcgcggctacgatgaagtgaacctcaatgtgggttgcccgtcagatcgggtacagaatggtcgctttggggcctgcctgatggcggaagcaggcctggtggcagagggtatcaacgcgatgcgcgatgtggtggatatcccggtaacggttaaaacccgtatcggcattgacgatcaggacagctatgctttccttaccgactttatcggcaccgtggcagagcgcggtggctgtgacacctttattatccatgcccgcaaagcctggctttctggcctcagcccgaaagagaaccgtgagatcccgccgctggattatccgcgggtttaccagttaaagcgcgatttcccgcagttgacgattgcgatcaacggtggcgtgaaaacgctggaagaggcaaaaatgcaccttcagcatctggacggcgtgatgatgggccgtgaagcctatcaaaaccccggaatcctggcgcaggtggatcatgagttatttggccgcgatcgccctgcggtcgatccggtcgcggtggtgcgggctatgtatccttatattgaagcggaactcaccaaagggacttaccttggccatgttacgcgccatatgttgggcctgttccaggggattcctggcgcacgtcagtggcgacgtcacctcagtgaaaacgcccacaagcccggtgccgatgtccgtgtactggaggcggcgctagccctggtcgccgacaaaattcctcaggaagcataatcctgcaaaaccagccatccggctggtttttttaacaccattagttggttaatttcatcaattgtgggtttcgttttttttgctatttctattaaaatcaaaaggttaacctttggcgcgtttcttgtaatagtcagtgtattgataacgaggagctccaaaatggatattctttttgtgttgggttttttcctgatgctgttactgaccggcgtgtccctgttaggcgtgattgctgccctgatcgtcgccacggtggtgatgtttgtaggtggcatgttggcgctgatcgtgaaggttctgccttggttaatcctggcggtggcagcggtatggctttatcgccgcttttttacagacgaagagacgcgccgacgcaacaggcttaaacgccgcttcagtcggctggaaaaagacggctggtactaaatgtgtccgggatcacagggtgtgacattgccggtaagataatggccggtggccatactttttacttatgttttctgtcaggataagtcgcgttgtttcataacatattcatcgcttctgaccctacatcagtgcgaatgaaaaataaaaaaaagggcttcctgcgggaagccctttttatttcagggaattaacaggctggagccatgcgtggcccggctctccagagcctgatgcgctttactggcctctttaagggcaaatttttgctgctcaggcacatcgaccttaatcgcgccactggccagcaatgaaaacagctcggcactggccgtttccagttcctgacgattggtgatgtatccgaacagggaaggtcgggtaacgaatagcgatcctttcttgttcaaaatactgagatcgatattggtcaccggccccgaagcattaccaaaactcaccatcagcccctgacgacgcagacagtccagcgaggcttcccaggtggctttacctaccgagtcatagaccacgccaaccttttcgcccccggtcagttccatgacgcgctgagcaatatcgtcttgctgataattaatcgtggcccaggcgccagcattttttgccagcgtcgctttttcgggggagccgacggtaccaatcaggtgcgcgcctagcgctttcgcccactgacaggcaatcagcccgacaccaccggcagccgcatgaaacaggaagatttcatctggtttcaccttgtaggtctgacgtagcagatactgagtagtcagccctttcaggaaactggcggccgcctgctcaaagctaatggcatccggtaacagcatcaggcgctcttccgccacattatgctgttcactgtaagcacccagtgccgcctggcaatacacaacgcgatcgccgggcttaaaccgtgtcacagccgagccgacacgcgtcaccacgccagccgcctcggtgcccaggcctgacgggaaatgactggctggataaagcccgctgcgaatgtaggtatcaatatagttgatgccaatcgctcgattttctacctggatttcatgctcagtgggatcggcaagctcaaaatcgacccagcttaaaacctcgggaccgccgtgtgcgttgaactgaatacgctttgccattcttactcctgtgattgtttcatcatgagggtgaggcgcgccccttaactgaggtatacttgcgcgtccccacagaagatcggtaatgcattcactatggcaggaaataaacccaccaacaaatcgaacgaaacgcaggatcgccagttggaaggcgtgaaaatgcccccgcattcgctggaagcggaacagtcggtgctgggtgggttaatgctggataacgagcgctgggacaacgtgtccgaacgcgtcgtggctaatgattttttcaatcgctcgcaccgtctgatcttttccgagatgcagcgtctgctggaaaacagcaagccgatagacctgatcaccctgtctgaatcgctcgaaacgcgcggcgaactggacatggcaggcggcttcgcttacctggcagaactggcaaaaaatacgcccagtgctgcgaacattggtgcctatgcggatatcgtacgcgaacgcgcagtagtacgtgaaatgatcgccgtggcaaatcaaattgccgatgccggttacgatccccagggacgcagcagtgaagatctgctggattttgccgagtcgaacgtattcaagattgctgaggcgcgggcgaataaagatgatggtccaaagaatattgagcagattcttgaagccaccgtttcacgcatcgaatcgctgtatcagacgccgcatgatggtgttaccggggtggataccggttaccaggacctgaataagaaaacggcgggtctgcagcgatcagacctgattattgtggccgcccgtccgtcgatgggtaaaaccacctttgccatgaacctgtgcgaaaacgccgccatgctacaggacaaaccggtgctgattttcagcctggagatgcccagcgaacagatcatgatgcgtatgctggcctcgttgtcgcgggtcgatcagacgcgcattcgtaccggccagctcgacgatgaagactgggcgcgcatttcgggaacgatggggatcttgctggaaaagaagaatatgtatatcgatgattcttctggcctgacgccgaccgaagtgcgttctcgcgcgcggcgtatctaccgtgaaaacggtggactgagcatgatcatgatcgactacctgcagttgatgcgcgtacctgccttgtcggataaccgtaccctggagatcgcggagatttcccgttcgttaaaagcgctggcaaaagagctgaatgtgcctgtggtggccctgtcccagttgaaccgctctctggaacaacgtgccgataaacgcccggtgaactcggatctgcgtgaatccgggtcgatcgagcaggatgctgacttgatcatgtttatttatcgcgatgaggtttatcacgaaaacagcgatcttaaagggattgccgagatcattctgggcaagcagcgtaacggccccatcggaaccgtgcgcctcacctttaacggtcagtggtcacgtttcgataactacgccggaccgcaatacgacgacgagtaatcctgttatgcgccgacatgcacgatctgtgcatgtcgcttaccaccgtacgaaatagtgttggacaatcccgcagataatcgggttatctgtagcaaagcgacactcctacgcgatggaaacagcatgactcatgtagacgattacgatctaaaaatcctcactctgttacaatccaacggccgccttaccaatcaggaactcagtgatttagtgggtctttctgcgtcgcaatgctcacgtcgtcgtatcaatcttgaacaggcaaacctgattcttggctatcacgcccgcctgtcgccggacgcggtaggtcttggcatggtcgggttgatcgaagtgcgtcttatcaaccacaccgctgagtatgtcgagagttttcatcagatggtggcgcaggaagaggccattgttgatgcttataaaaccaccggggatgccgactacctgctaaaagtggcggtggccgatttagcctcactcagtgcgttaatcagccagctgttagccgggcaccaaagcgtttcccatgttaaaacgtcggttgtgctgggcaggcttaaagagaatggtctgatgatgagtgctgagcccgctgtgcgccaaaaaagcgcatgatgtgcaaatgtggtgcgatgaatcgtcaatctatgcgttttttgtgcgccacataaatcgactatgcacgattcgccctgtcagagccgatgacacaggcggatgaagacaaccgcgttttccgcacactaaggctggcgtagttattgcatcagtgcgtcattccttcgcactgagaaagtattatggataaccttgtacaacccgttgatattccccattctcgtcttgaagacgcgctggctattctgctcggcaccttaatggtctcgtttggcgtgatcatgctgaagcaggcgggtgccctgaccggcagtacggcaggcatcgcatttttaatcagctacctgtcgcccgtctcttttggcagtgccttctttctgattaacatcccgttttactggctggccgtaaagcgtatgggctgggaatttaccctgaaaaccttcagtgccgtgggcctggtgtcactttttacccacctgcacccgttatttatgcatttttccacgctgaatcctttttatgcggcattgttcggtaacgtcatcatgggcattgggtttatagtgttgtttcgtcacaaagccagcctgggtggaatcaatattctggcgctctggttacaggaccgtttcggcattcgcgccggtaaactgcaaatggcagtggatacctgtgtggtgctggcgtcgctgtttgtcgtcagcctgccgatgttgcttgcgtctgtcgccggcgcagtggtgcttaatttgattatcgcaatgaaccatcgtcccgggcgttacagggtttagtggccctttttatttcaagaccaaccatggagatctgcaccgtgttccaaaacgttgatgcctatgctggcgaccctattttgtcgctgatggaagcctttaaacaggacccgcgcgagcataaagtgaacctgagtattgggctttattacaatgagcaaggcatcattcctcagctacaggccgttgccgatgctgaagaacagttgcgtgccgagccgcagcaggcttctctctatcttccgatggaagggttaagcagctaccgcaacgcgattgcgcccttgttgtttggggccgggcatccggtactgaaagcgggccatgttgcatccatccagacattaggcggttcgggtgcgctcaaagtgggtgcggatttcctcaagcgctattttccacagtcaaacgtttgggtcagcgatccgacctgggaaaaccatgtcgccatttttagcggcgcaggtttcgaggtaaatacctatccctggtatgacccggaaagcaacggcgtgcggtttgacgctttcctcagcaagctgaaaacattgcccagccagagcatcgtgctgctgcatccgtgctgtcataacccgaccggtgctgacctgacgaatgcgcagtgggacgaaaccgtcgcggtgctgaaagcacaggaactgattccgtttctcgacatcgcctatcagggctttggtgcaggtatggaagaagatgcttacgcgatgcgtgcggttgccgcggcgggcttgcctgcgctggtcagcaattcattctcaaaaattttctcgctctatggcgagcgcgtcggtggactttccatcgtgtgcgacagcgctgaagagtccagccgtgttctgggccagttaaaagcgaccgtgcgtcgtaactattccagcccgccgaatttcggcgcgcaggtggtggcacgcgtgttaaacgatcctgccctaaaggcgaactggctggcagaagtggaagcgatgcgcctgcgtattatcgacatgcgtcaggcgctggtacaggtgatgagtacggcgttgccgggtaaaagcgttgactatctgttaaagcagcgcgggatgttcagctacaccggcctgagcgcgcagcaggtggatcgcctgcgagaagagtttggcgtttatctggttggcagcggtcgtatgtgcgtggcgggcctcaacagtaaaaatgtccatcaggtagcagaagcctttgctgcggtaatgtaattctcagccgtcgcaggttctggccgccagcattgtctggcggcttttttatttttacggttcgggtttacctttgcgccacattctgcacacttaaatggtctgacagattcaggaaaaaaatgtatgtggcatcaacaaaccttgaccttaagcgcgaaatcacgcggttttcatctggtcactgacgaaatcgtgcaacagctgacaggtttacgtgatatcaggatcggactggtgcatttgctgttgcaacacacttcagcctcactgacgctgaatgaaaactgcgatccgacggtacgacgtgatatggaacagcactttatgcgtcatgtcccggaagacgcaccttatcaacatgattatgaaggccgtgacgatatgcccgcgcacattaagtcgtccagtcttggcgtatcgttgacgttgcctgtgcagcgtggccagctggtattgggaacctggcagggtatttggttgggtgagcatcgcattcacggtggtgcccgacgtatcgttgccaccctacaaggggaatgatgatgaataactcagagttactgacctattgcatgagcaaacctggcgctgagcaaagcgttcacagcgactggaaggccacacagattaagagcaacggcgtgctgtttgccatggttcatgaagtgaaaggtcgaccggcggtgtcgttaaaatccacgcctgcgctggctgaactgatgcgggatgagcacagcgatgtgttccccagtgaacacctgaataaatcccactggaacacgctgtttctggatggcacgctaaaagattcgcaaatctactatctggtggatgcctcttttcagcaggctgacgccggacgataaggtccctcccccgaggcgggagagggcgaacggcagcgttatgccgcagattcgttacgcagcgtattgatatcaataacaaagcggtattttacatcgcttttcagcatacgttcgtaggcatcgttaatctgatccatagcaatcagctcgatatctgaggtaatgccatgctcgccacagaaatccagcatttcctgggtttcagcgatgccgccgatcagcgaaccggcaacactgcgacgtttaaagatcaggttaaacacctgcggtgccgggtgatcatgctcaggcgcgcccaccagggtcatattgccgtcacgcttcagcagggtgataaaagggttaagatcgtgctgggctgcgacggtgttcaggatgaagtcaaagctgttggtatgctgggccatctggtcggcatctttagagattacgacttcgtccgcacccaggcgtttaccatcttcgatttttgacggtgaggtggtaaacaacaccacatgcgcgcccatcgcatgtgcaattttcacgcccatgtgacccagaccgcccaggccgacgataccgacttttttacccggaccgacgttccagtgacgcagcggtgaataggtagtgataccggcacacagcagcggtgcaacgcctgccagctcaaggttttcgggaatacgcagcacaaagctttcatccactaccatcgaggtcgagtaaccgccataggtaatggcacctgttacgcgatcttcaccgttgtaggtgccgacaaaaccgttttcacagtattgttccagcccttcctggcagcttggacagctacggcaggaatccaccatacagccgacgccgaccagatcgcccactttgtatttttgcgtatccgggccaacagcggtaacgcgaccgacaatttcgtgcccaggtaccacagggaaaatcgtgtttttccactcattgcgcgcctgatgtaagtcagagtgacaaacgccacagaacagcacttcaagctgtacgtcatgagcacgaagctcacgcggtttgaaatcaaacggtgccagtttggattttgcatcctgagcagcatacgcatgggtaatgttcatggagtctccagttaaggtgtgtcgtgatttttgaatcaacgccgcagcataaagcgcgcagcaagaaggtgacgccaggggcgtaccaaagaggaacggattaaggatagtcaggggatcgaaaagcgtatatgcctatacgtgtctgaatcttgcctgattctgcatttatccggttaaacagagcagttctgaaaaaaagcccgccagaggcgggcgtgacaatttattttttcaacaagggtttgaggaaacgcgcggtatgggatttctcgcactccgccaccgtttccggcgtacccgacaccaggatttcaccgccgccgctgccgccttctggccccaggtcgacaatccagtccgccgttttaatcacgtccagattgtgctcaatcaccacaatggtgttgccttgatcgcgcagctgatgcagcacttccagcaactgctggatatcagcaaagtgtaacccggtggtcggctcatccagaatatacagggtttgaccggtaccgcgttttgacagctcacgcgccagtttcacacgctgggcttcaccgccggagagtgtcgttgccgactgacccaggcggatataggacaaacccacgtccatcagcgtttgcagcttacgcgccagcgccggtacggcatcaaagaactcgcgtgcctcttcgatggtcatttccagcacttcgtgaatgcttttgcctttgtatttaatctccagcgtttcacggttatagcgtttgcctttgcactgatcgcacggcacatagatgtccggcaaaaagtgcatctcaactttcagtacgccatcaccctgacaggcttcacagcgtccgccacggacgttaaagctgaaccggccaggattgtaaccgcgtgaacgggactccgggacgccggcaaacagctcacgtaccggcgtaaaaataccggtataggttgccgggtttgagcgcggcgttcggccaatagggctctgatcgatatcgataactttatcgaaatgctccagtccgaccacctcgcggtagggggccggttcggcaatcgtcgcgccattcagggcgcgctgtgcaatcgggaacagcgtatcgttgatgagcgtcgacttccctgaaccggagacaccggtgatgcaggtaaacaggccaacaggcagcgttaacgtcacatccttaaggttgttgccccgtgcgccggtgattttcagcaccttagacggatcgcctttcacccgcgcttttggcaaggcgatttcgcgttttccactgaggaactgcccggtcagggaggcttcttcggccatgatctggtcgacggtcccttccgcgacaatcgatccaccgtgtacccctgcgccgggaccgatatcaatcacgtggtcggcggcacgaatcgcatcctcatcatgctccaccacaatcaccgtgttgcccagatcgcgcaggtgaatcagcgtaccaagcaggcgctcgttatcacgctgatgcaggccgatggaaggctcatccagcacatacatgacaccgaccaggccagcaccgatctgactggccaggcgaatacgttgtgcttcaccgcccgagagggtttcagcggagcgcgacatcgacaggtaattcaggccaacgttgaccagaaagctcaggcgatcgccaatctctttcagcactttctcggcgattttagcccgctgaccactcagcttcaggttttcaaaaaacgacatggcgtgcccaatactcatttctgagatggtgggcagcgtggtattttccacgtagacgtggcgcgcttcacgccgcagacgcgttccttcacagctggtgcaggcacgattgctgataaacttcgccagctcttcacgcaccgccgacgactccgtctctttataacggcgttccatattgttcagcacgccctcgaacggatgacggcgcaccgaggtatcaccacggtcattgatatatttaaactcaatgctctctttaccagaaccatacaggatgacgttacgcacgttgtccggcaggctgctaaagggcgcttcgatatcaaacttgaggtgctcagccagcgagcgcagcatctggaagtaataaaaattgcggcgatcccagccgcggattgcgccgccggccagcgacagctccacattttgcaccacgcgatcaggatcaaaatactgctgcacgcccagaccatcacaggttgggcaggcaccggcagggttgttgaacgaaaacaggcgcggctccagctcactcatgctgtatccgcagatcgggcaggcaaagttagcggagaacagcagttcttcggcggcatcatcgtccatatcggcgacaatcgccgtaccaccagacagttccagcgtggtttcgaacgactcggcaaggcgcgtcgctaagtcatcgcgcactttgaagcgatcgataaccacttcaatggtgtgttttttctgcagttccagtttgggtggatcggaaagatcgcacacctcgccatcgatcctggcgcggatatagccctgcgtagccaggttctccagcgttttggtatgttcacctttacgatctttcaccaccggtgccagcagcatcagacgacggccttcaggctgctcaagaacctggtcaaccatctggctgaccgtttgtgccgccagcggcacgtcgtgatccggacagcgaggttcacccacgcgggcaaacagcaggcgcaggtaatcgtggatctcagtgatcgttcccactgtagagcgtgggttatgcgaggtggacttttgctcaatggagatagccggcgacaaaccctcgatatgatcgacgtccggtttctccatcaatgaaagaaactggcgcgcataagcagagagcgactccacatagcggcgctgaccttccgcatacagcgtatcaaacgccagagatgacttaccggaccctgacaggccagtaaccacaatgagtttgtcgcgaggaatcgtcaggttgatgtttttcaaattatgggtgcgggcaccacgaacttcgatcttatccattcacctttcccggattagcagcactcaccgcgccatacgacacggccagaataaacgcatcattatggcacaaaaaatagactgaacaaatatccagtagttttttgctttttaaagggagatgattaaaaatggaacacctctctaaactgggaaaccaggcgcgggacgtgttagaattgatcgtttagagtttacgtaaaaattcatcgggagacagcaacatggccagtcgtggcgttaacaaagtgattcttgtcgggaatctgggtcaggatccggaagtacgttacatgccaaatggtggcgctgtcgccaacattacgctggctacctcggaaagctggcgtgataaacagaccggtgaaaacaaagaaatcaccgaatggcaccgtgtcgtgctgtttggcaagctggctgaagttgccggcgaatatctgcgtaaaggttctcaggtctatattgaaggccagttgcgcacccgtaagtggcaggaccagggtggccaggaacgttacaccacggaagtggtggtgaacgttggcggcaccatgcaaatgttgggtggacgtcagcagggcggtaacgcgccagcagcaggcggcggtcagggcagcaacaacggttggggccagcctcagcagccacagccgcagcaggcgaacaataaccagttcagtggcggcgcgcagtctcgtcctcagcagcagccaggcgcaccggccagcaacaacaatgaaccaccaatggatttcgacgacgacattccgttctgattaagacattgcgtcgttgtgccgtattgcaaaagcccctacaggggctttttgtttttctgcatgtgttctggcgtgacgcgattcccttcagctcaggtcatgcagggccttatccagcggcggggtcaaagacaggtcctgaaatgccacgctcaggccagcgcgttctggtgtgcagcacatgacaccgacgttaacgctgcccgccgggaaagggcacaaacgcagtaacggccagcgttgaccatcggttgaatactgcagtctcaggctgtcccctttgcgcgtcaatctgagccagaatgcccgcgcatcgccgggaaagatgcccgtggcccagtcagactggccaagcgtcaatacgctgccgatggcgggcgcaccatcattatattcaatgcccgctttcaaccagtgctgcgcatcgcgcatcagcatcagtccggcctgatcgtacagcgtggtaaaatccgcacaaattttgacctggaaagtaaaatcctcctgcatttccgtggcaaagatatgcccggaaaaacgttcaaatccataccaggtcttatgccagaaatccgttttttcatcggtgacgacctgcaacgtgccgtcatgataccgccactgtgcaggttcattgatccaggaaaaggattcgaacacggcgcctccaaaatgcgtcataagtcatagccttaccgttaagagtagtcagagcataaagtataggctcaggtgccttttggttggtcgccgctaccgccattcagccagcagggtttcggtattgacgacgcgcggcacgttacccggcagaccaaaccctgcccacacttcattatgctgaccaattaattgctccgcgctgacgtaagtgcggtcggcggtggtgtgcgcatcggctgccacggtgatgcgataacctaaactcgcgcccactttaatggtggtatcaacacagtagtcggtggcacagccacaaatcacgaagtcggtaaccgataaagtggtcagcagcgacgccaggggcgtttgccagaagctgtcgcacgcggttttggtgatgtaatgcgcattctggggttgttcaatatcaggtaacagggcaaacgcatggctgccttccgtcatgtttccttcgcgatgctgaataaacagggtaatgtcagcctgtctgatcagccggttgatctgggcgactcgccctgcgcgatcgaaacgcggcgatgcaaacacaccattttgcatatcaactaccattactacacgctgcatgatcgttccttgtcaggatgcctgttagcagtgttgcgtattcaaacggggatgacaatctttgcctgtcgtcgtgctttgcgggcaatataaaagacggtgtcgcatataaaaggagaggtgacgtggagggcattcctgcggttttcccctgtgaaaaagatcgcgcgcagtttaagcaatcgcctgaactgcccggcgtggagctttatcaggcacatatctctcgttacgcatttgaaccacatacgcatgaagcgtttggcattgggacgattgaggcgggcgcgcaacgttttcgctatcgtggtacgcagtacaccgcaccggcgcattcgctggtgatgatgaatccagatgagctgcacaccggcgaatcggcctgcgaagagggctggcgttatcaaatgatttacatccagccgcagctgatggatgaactcagcggtgaccgcggctggtggtttaacgacgcgctcaggacggatatccgcctggcacaaccgttatcgcaggttctctcgacgttgtggcacgccgaaacggcgctggcacgttacagtttgttatcagaactgctgcttcatctgcgcccgttggcgcgcatggcctctccccgcaaagcggaagccaggcatcgcttcgacaaggtgcgcgactacctgcgtgcgaatctggctgaaccggtcaggctggagacgctggcagccttagtctcattatcgccctggcattttttacgggctttccgcgatcgtttccacgtgacacctcagcaaatgttaatggcgtaccgactgtatgaagccaaagagaggctggcgcagggcgaggcgatcgccagcgtggccgctgcggtgggcttgaccgaccaggcgcatctcacgcgcgcctttgctaaccgttatggcattaccccagggcgttatcagaaacagataatctcgcgatagcctgagcgcaatttgctacaagcctttcttgcctgatttggtcacactgatgttaaaactcagacaggaaaaaacgatgttgatggggatactgtttgcccttgccgcgggcatgatgtgggggctgatttttgtcggaccgatcctggtcccggattacccgggcaccttacagtcggcgggacgttatgtggcttttgggctgatagccctgccgctggcctggcacgatcgtcatcgactgcgtcagcttacgtccgctcactggcgggaagccttgaagctgtcgctgatcggcaacctgttttattacgcgtttctcgccaatgctatccagcgaacgggcgcgccggtttccaccatgattattggcaccttacccatcgttatcgccgtcaccgctaacctgtgttacggccatcttgaaggacggctgtcctggcggcggctgatcccggcattgatggtaacaggagccggcctcgtctgtgtcaatgcagcagagttgcagtcgcaaggcgcgtcgcttgatggccgccgttatctgacggggattggcctggcggtgatggcagtcatctgctggacctggtatccgctgcgtaatgcgcgctggttacgaacccatccccaacttaaacccgccacatgggcgacagcccagggattagtgactctgccgctggccctgatgatgtacgcgttggtgagtgcgcaactggcgtggcaacggcccgactttgccctgccatttggtccccgaccgcaggtgttcgtctcattaatgttgattatcgggctgctctgctcatgggtcgggaccttatgctggaacgcggccagccaacgcttacccacggttttaatggggccgctcatcgtgtttgaaattttgtttgggctgttatggacttttgtctggtatcaaagctggccaccggccttaacttccgctggtattacttgtctgatcctgggcgtggtaggggccatgcggattaaacctcaaccccgggtgaccgccatcgatccctgataataattaccgcttgtgattgattattaccaggggtgatattcacgctttttcagataatgcctcactcaggattggcgaaataatgccgaaatcggccactggtacggcgaaaatcggcgcccaacagttaaatgccacgcactgttcccggcaaaatgcgatctcacccggccatttaccgccgtgcaaagccttattttgagcaaaaaatagacagttttgtccaggttgcgaccacgattaaccttcaaatggcattgatcggggggcgatgtgtatcctggaagcgaatttaacgcccgaaaaccaggctgccaggccgtttggttaagataattccttataaaaaacccccttttactccagctatccctaattaaatcgggatttcaccacgcttcgcttttatttaatgtttaacaatgggcatcaatagcaccccacaagcggtatttgctgaagaaagtgataagtagcaataaactatttttctgggattattctgggctttttttacctttttatgctgttggaaatcattccgcgatcggcaaaaaatttctcagggccagcctgggctgaaaaaaacagcatgttggcctggatatcattaccagcactgaacataaaagcacaggggatataggttcttttagggatgctaatgaaaaaaaagagagacgccaatctcaccgaaatgagattgggcggataaaagtggcgtagatagcgagacttttgctgttgtgaatcaattttaccgcaaaaaaagaagcgtaaccgccaatccattcattaattacggactgggcgaagcgcaccaccataaatgtcctgttaaatgctcttcatctcttctggtaagaacaaatcgcagcgatgtggccattaaaagccgtcatctcactattagcggttatcagaaccggctgggtaatgataaacgctacggcttatatccagtaaacggcagctgcgccgggttccaacatcaaaagtgctctgtaagaagttgaccgcctgacgtttgtcattcgtggtgaagaagttcttcaggacgctttgtagcatttccttatccgagttgagcgcatgcagttcgcgcgtcagagactgaacttgttcttccagttctttgatttttctgccttcttctgaagataacccagagaacttcttcttccagctgtagaaggttgcctcagagatgccaagctcctcacaaatctctttaactttaacgcccgattcagaagctttaatggcatttgtgatttgatcttcgctatatcgtgactttctcataaatgctcttacctttcttatcaattaatggatgagaattactttattaacctttggtactgtatgatttcattgagtgccgtatttaaatacgtacgttaaattgcgagggttaaattaagatatttagaataaatatcatcatgggataaatcttattttattctgatcgggatgccgcgccttcctggcatgcggtttttgatataaattcatcgcatcccaaagataaaaaacgactgtaaatttgatattcaacattccttgacctgttttattatggaagggtggtttttggaaacattattgatttcactttgaaatcgtttccaattggcggtattcgggccaggtataatcagaattctcctgaattcactcgataaaataagacccgattctcatttccgagccggactggcttgatgtttataatttcgctttgaaatttaaacgcttattacttcgcccccagggatggggatgccgaagcggtagaggtagagtaatactaaggaatagttgatgaaattgagcgtaatggctaatgccgcctggatgatgtctgaaaagattatctccgtttttggcgtcattttcgtgacgtcttatgtggccaaatcctttggtccgaccctatttggtcagatggcgttttcaacgtcattatttgccatggtgcaaaccatagccatatttggcactgaaactattttgtttaaacgtgtcagtaaaaatgcgacaaaagctttacgtttaatgcgcattgcacgcacgttgcgtatgggtttattacttcttacctcggtgccggtattaatttgggtttggtacaacatgcaggaaaatttcctggcatttgcgctggcctcatttgtggcgtctgtttttgtcacgcaggacacctttagcgtctacaacaacgcgcgtttagcttcaaagctcaacgccgttgcgaatgcggctggcatgctgatgagctttgctctgagctttaccattgcctggttacgccttaacccactgtggctaacgctgtcagtggtcacggtgacgttagtgccctacgccatcaaacgctacaccttttaccaggcgcatcaggatcggctcccgccgccggcgacgcgcacgctgtatttgcgttacctgatgtatgccggattgccgctggcgatttccagcatctttatttctatacaggtaaaagccgcgcagatgtttttggcaggcatcgcgtctgcacaagagctgggcttgtttgccgcagccaataccatcgccgcttcatggatttttatcccggtcgcgctgattacctcgtgcttcagtgaaatttttcgggcgcgcggtgatgaagcgatcaggctgacggcgcggctcaatggctacgtgatggccgtgtccctgctgatgctgcttatcgttgcgctgtttggcgaacagatcatcacggcgttgtatggcccggcgttcaggcagtcgggccagctcatcaccctgctgtcgatagcgaccagcttttcggcactgggaaccgtcgcgtatcgctacatggtgaaagaagggggctttgattatttactgaagaaaatcatttgtctggtgatcatcagcatgccgctttcctggtggctaattcaggactacggcattacgggagccgcatggagcgtttttctttcagagctcctgtccctgaccgtcatgaattatttttttaaacacggcgttattcaaaaaatccaggtttcctcactcaactacaaaacctacaaatgaggtcaaatatgctcaagttaaaacaagagcttagaagaagtttgcagtactttatcaagaagatgccctggacttatcaggatcggatttattacttccgcaagttcagaaggcttcctaacctgcatgagccaaaggtcttcaatgaaaaagtgctgtatcgcaagttcatccatggcgattatcagctgtatgcacgcctgtccgacaagttttcggtgcgtgaatttattgctgagaaaatcggtaatgcgtacctgattcccttgctgcacgacaccaccgatcccaccacgctcaacaacctgacgcgctggaagggaacggtgattaaaccaaaccatgcttcaaacatggtagagatcgtgctggaggaaccgagtgcccttcgcaagcagcaaatcattcataactgctacacgtggttaaaaacggattttgccagcgaagcacgcgagatccactatcgctacatcaagccacgcattttggtggagcagtacattggtgatggcaaacaggcaccggttgattacaagtttcacatgttcaacaagcgtgatggcaactttgagtatgtgcttcagatcatttacaaccgcggccagcctcagctttcgatgaacttttatgtgaacaacctgagcgaggtgtttcataaaattcgtgataccgggctcgacgtctcaacggttatgccttcgttagagcaggcactggcattaagcaaaacgctggccagcgatttcgactatgtgcgcgtggactggtatatccatgaccaaaacatttacttcggcgagcttacgtttacgccaggcgcaggcatggtgacgggactggatagcggattagatcagatgatgggtgacatgtggattcaggatcgtcgcggaacgcagaggccggacgtagaagtgcaggatattgcgattcctgtcatgttgaagaaaatttgacgttacacagcaatataaaaaaccccgcgttgcggggttttttattggtcaatcagggcatttgccagttagctggcgcatgactcattacgtcaataaagacgtctttagagacgctgaaaaaatggtgtacgttttccatactcagcgtgatgcccatcaagcccgtcacaaaccagcacgacattcccacgccaacgctgccacagataaatgccatcacgtgatggctatcctggcgaagtcgggtttttaacgtgctggcaaagaacatcattacagcgctcaacaattcccagcgcataacaagaaaactggtggttaaggtagccatcaattttgacctcaaaatcggagattacgcctgactgtctgcgagcatcacgtcggcggaaaagtctgtcaggtcgggctctttcgtcggcaacaaatgtcataatgtgatgtgggtcacactatagcattcgattttccaattttgtacaaaatttgtctggtttttcagcagaagtgggtggcgggtgcaggggaagaaaacctgagaaaagcggtgtgcgcccagccaggcgcacggtgatattcagctaaccggacagcactcgcccatggtgcgctgggtaaagctggtcatattgtcgctgcagtcaaaactcatcaggcgcggacgctgaatcgtctggcggcgcatagcatggcgataagccgtgggcgtttgggaaaactggcggcgaaacaccctggagaaggtctgctgcgagtcataaccatattgcatcgcaatatcgaataccggccgctgagtttgccgcagcgcttctgcggccagagtcagacggcgttcacgaatataaccacccaacgtttgtttcgtcacgctacggaacatacgttgcagatgccatttcgaatagcctgatttcgcggccacttcatcaattgacaggctcttatccaggttttggtcaatccagtgtgtcagtgaatgaatgatctcttcttgtatcatggcctcatccttctggtgaatttccccgtgcgttcatgctgcctttgcgcgcgagtcgcgatgaaaatcgcgcccgtttgctggcgaatgacgtcgtgagggagcgtgtcgttctgatgggaaaagagtataattcctcaagttaacttgaggtaaagtgccaaatgaaaaaagatcgcaattacccaaaaccggtgctgacgccgggtgaagtggcgcgccgcagcggcgtggccgtctctgcgctgcatttttatgaaagcaaagggctcatctttagcacccgcaataacggaaatcagcgacgctacagccgtgatgttctgcgacgggtcgccattattaaaattgcacagcgcattgggattccgcttgccagcgtcagcgacagccttgaaaacatgccggcggataaacgtatgtcggctcaggactggggcaatctgacccagcactggcgtgatgaactggataagcgcatcgaaacgctaacgcgcctgcgtaacgatttggatggttgcattggctgtggatgtttatcgatgcgtgactgtccgctgcgcaatcccggcgatcggcttgggcagcagggttcgggcgcggtactgcttgatcctgaacaggatggtgcactgcataagacaaggtgacgtctatacttgctgcatattcactgacagggaatcatgatgatcaccgttcaccatcttgaacaatcgcgctctcaccgggtgctgtggatgctggaagagctggaagtgccttaccaggtcaaacgctatcagcgtgaacccacgatgctggcgccggacgcgttaaaaaaagtgcatccgttaggaaagtcgccggttatcaccgatggcaatcgcgtggtggccgagtccggggcgatccttgagtatctggaagagaagtacgacagcgaacggcggctgcagatcaccgacgaagaggcacggctgcaggcgcgttactggctacattacgccgaaggttcactgatgccgctgctggtcatgaagctggtttttggccgccttggcagcgcgcctgtgccgtggttgctgcgtcccatcggtgcggcgctcggcaaaggcgttcagaaagcctggctggataaacaacttaccttgcataagcaggtgattgaagatcacctctcggtgcatccgtggtttgccggtcagcgtttcagcattgctgatgtgcagatgagctttccgattctggcgctgagccagcgcgccggactgaaggatgcccccgccacgcaaaaatggttaacgaccgtgcaacagcgtgcggcctggcaacgggccattcagcaaggcggtgaaattcatctttcgggctgatcgcgcactatcctgtcctatcggatgacgccgcccggcgtcatcttcgtctgctttctcgataatgcggcgtaatcatcaccgcatcctgacgcactgaatgttacacgatagtatcaagagcatccccgatgttatcgacctgatctttatagccaggaatcctcacagagcggttgaaaagcggcgggaaaacgccggataatcggccccctttaaacggggatgtacgatgccccgttctgtgcggctaagtaaacgtttgcctttttgtcggcagcctgttggcgatgacagctttcggggaattcagggcggttaccgcgcgatccaacaacaaaaatttttgaggctcaactatgtcaattgaatcacgcccggccagtggaaaactggatgcctggttcgccatttcggcccgaggcagtagcgtgcggcaggaaattgtcgccgggctgaccacctttctcgccatggtttattcggtgatcgtggtgcctggcatgctcggtaaagcggggttttcaccttcggcggtgtttgtggctacctgcctggtggcgagcgttggatcgatcatcatggggctgtgggccaatttacccctggccattggctgtgccatttcactgacggcttttacggcctttagcctcgtcctgggtcaacacattagcgttccggtcgcgctgggggccgtgttcctgatgggcctgctttttaccctgatttccaccaccgggattcgcgcctggatcttacgtaatctgccgatgggcgtcgcccacggcaccggcatcgggattggcctgtttctgctgctgattgcggcagacaacgttgggctggtcgtcagaaacccggcctcaggtttacccgttgcgctgggccattttacgtcgttccccgtcatgatgtctttgctggggctggctgcgattttcggcctggaaaaacgccgtgtcccgggcggcattttactcaccgttattgcgatttctgcgctggggctggcgttcgatccgtccgtgcgctggcaggggctgtttgccttgcccagcctgcgtgatgcgcagggcgagtcactgttattcagcctcgatatcatgggcgctttgcagcctgcggtcttacccagcgtgctggcgttagtgatgacggcggtctttgatgccaccggtacgatccgcgcggtggcgggtcaggctaacctgctggataaagacgggcaaatcattaacggcggccgggcgctgaccacggattccgtcagtagcctgtttgccggtcttgtgggtgcctcaccggcggccgtgtacatcgagtctgccgccgggacggcggcagggggcaaaaccggcctgacggccattgttgttggcctcctgtttttgctcattctgtttatgtctccgctggcttatctggtgccggcgtacgctaccgcgcctgcgttgatgtacgttggcctgctgatgctgagtaacgtggcaaagatcgacttcggtgacttcgttgatgccatgtccggtctgctcacggcggtgatcatcgtgctgacctgtaacatcgttaccggcatcatgatcggtttcgcgaccctggtggtgggccgtctgtttgcgggtgagtggcgcaggctaaacgtgggcacggtggtgatcgccgtcgcgttagtcgctttttatgccggaggctgggcgatctgactgttcaaccggacgtgccgcggcatgtccggaattatccgctttttgctcgttgaagcacgcgtagcttttcccgccctcgccagtttgttttacacttttaacctaatgttgattcgaagataactaccgcctaaggaaagcatggaaatcttttttactattttgattatgacgctggtggtctcgctctccggggtggctgcccgtattctgccttttcagattcccctgcctctggtgcagatcgcggtcggtgcgctgctggcctggccgaccttcgggctgcacgtggatttcgacccggaactcttcctcgtcttattcattccgccgctgttatttgctgacggctggaaaaccccggtcagcgagttcctgcattacgggcgggaaatccttggcctggcgctggtgctggtgctgattaccgttgtcggtattggctatctgatttactggacggtgcccgggattcccctgattcccgctttcgccctggcggccgtgttatcacctaccgatgccgtggcgctgtcaggcattgtcggcgaaggccgtattccgaagaaaattatgggaatactgcaaggcgaagccttgatgaacgatgcttctggcctggtttcactgaaatttgcggtcgcagtggcgatgggcaccatggtgtttagttggggcggagccagcgtcgagttcctgaaagtggccgtgggcggcctgatcgccggtgtcgcggtatgctggctctacggtaaatcgctgcgcgtcctgaaccgctggagcggcggggacgatgctgccacacagattgtcctgctgctgctgctgccttttgcctcttatctgattgcagaacacctgggcgtttccgggattttagccgccgtcgcggccgggatgaccatcacgcgctccggtattatccgccaggcgccgctgaccatgcgactgcgcgccaacagcgtctggcacatgctggagtttgtgtttaacggcatggtgttcctgatgctgggcctgcagctgccctctattctgcaaaactcgattgaccaggcaacagccgatcccaatgtggatatctggatgattttcgcggacatcgtcctggtctacgcggcgttaatggtggtgcgtttcggctggttgtggatcatgcagcgtttcagcaaacgctggttgaaaaagaaaccattagtgttctccagctactcgttgcgtgaactgctgattgcctcttttgcgggcgtacgcggtgccattaccctggcgggtgtgctgtcgattcccctgttcctgaccaacggccatcctttcccggcgcgttatgagctggtgtttatcgcaaccggcgtgattctgttctcgctgctggttggcgtcatcgttctgccgatgctgctgcgcggtgtagagacgatcgataaaagcgcccatcggcacgaactgcaacatgcaagagcggtgatggccggtgtcgctatcgagagtctgcataagatggaggcgcggcttgaaaaggaaaccgaagaaaacatcgaccctgagttactgaaagaggtcagcctgcgggtgatcgggaatctgcgtcgtcgcgcggaagggaaaaacgatcttgagcacgcgctgtttgccgaaaatctggaacgtcgttttcgtctgaacgcgttacgtgccgagcgtgcagaggtctatcacctgcgtgcgactcagcagatatcaaacgagacgatgcaaaaactgttgcacgatctggacctgctggaagcgctgctgattgagaaagaagagtaatcttcttgttatgcactcccgttcgcccgataacctgcgctctgcgattatcgggcggtctggggcgctagacggaaagacgcggcgcattatcaggccagtgttcccggcaacacgctatccaggcccgcgcgctgcgtgacacgtagctgccttcacgccagatcagccccagatgccactgcagctcggactccagcggaagccacaataacgactgcttatctaaccgctggcaaatgggctccggcagtatcgccaggcccatctccgcctgcaccatggccgccagaaaatcccattgcccgctgcgtactgcaatctcaggcgtgatcccctgacgctgaaacgctttcatcaactggcggttcagcgaaaactcttcattaaagatcagcaaaggatgggaggccaaatcgctcaggccaagctgcgtgcgctgcagccagggtgcctgacgtggcagtagcacacacagcggatgctgcataagcgataacgtttcgaggggcaactcggcatcaacggggagggccgtcagtgcaatatccagcgtgcccgccagcaccgcttcctgaaccgttaagccgccaaactcagcaatactgagttccacacccggatagcgacggcgaaacgccgaaaccgatccggcgatctgcatgcccaccatcgggggaatgcccagccgcagcttgccggttttcagctgattgatatcgcctatctcggcctcaagctgatgaaactcttgcagaatagccagcccgcgctgatagaccgcttgcccgctatccgtcaggtgcagtcgtcgcccatcacgaatgagcagtgcgcagtccagctcctcttccagctggcgcaccattttgctgatcgtaggctgtgtcacgaacagcttctgtgcagcacgggtaaaactttgctgacgtaccacttcggtaaagtaacgcaacgcgcgaacgtccataactattcctttctggcatgatttgaataattttaattcatttttttcacagtacctcgtgattctatactgagcgcattaacttgatgggagaaaaacgatggcactggcattgcgccgcctgaacgtcggcaggctgcaacggctcagcttacctttacagctggtgctgtttatctcggtttttatcgccagcgagcaactggtgaactggctgcacctgccactgcctgccaacattgtcggtatgctgctgatgttgatgctgattgcgttacgcattttaccgctgcgctgggtgaaagccggtgcaagctggttgctggcagagatgctgctgttttttatcccggcggtggtggcggtggtgaattacgctgacctgctgcagatggaaggctggcggattttggtggtgattgcggtcagtacgctactggtgctggcggcgacagccctggtggtcgatcgcctgtaccgttttgaagtcacgcgcgcggcgcgtaagcagggcaataatgcataatctgctcatcagtctgttatgtgccgccgtcacgctggtgatttattacctgaataaacggctgtatcgtcgctggacaacgctgttactgatgccgctggtcatgacgccgctcattctggtgacgctgctgttgctgacccatatcagctggcaaaactatattgcggaaagccactggctactgtggttactcggccccgcgacgttagcctttgcggtgccggtctacgaaaatctggacgtgattaaacgccactggttatcgctgagtgcgggcgtgttaactgccacaacggtgtcgatatgcagttccgtatggctggcgcgtttactgaatttaccggaaaccattcagcgcagtctcgccgtgcgatccattaccacacctttcgcgctggcggcagcgaagcctatgggcgcgcagcccgatctggtggcactgtttgtggttgtgaccggcgtatttggcatggcggtaggggatgtactgttcctgcgcatcgcgatcaaacagggcgtggcgaaaggcgctgggctgggcgccgcttcgcacggtgccggtacggcacgcgcctaccagttggggccgcaggaaggcgtggtttcaagcctggtgatgatgttgtctggcgtcgtcaccgtcatactggctccgtttatcgggcacctgatgtgggcgcactaaggcaagcctgcgccggatacggttaacccggataacgactgttctccgcgtaattcacagcgacttgtcctttttggcacaaaatgacatctctttttacgtaaagctttccaaatttagttgtcacctcatttcagactgctacccttgatgcggaattatttgacccttcatggagtagaatcatgtttaagcaacttgtcactggaagcgctctgagcttcattatgctgagcggcgccgcgcaggccatcgaaggcagcgttgatgttggcgagcacagcaccaaccttaatctcggtttgggcacgacgtcgccgggcctgttcctgaacggcaactggttgcgtagcgatcatgacggcagcacctatggtgcgggtctgggttacaacgttgatgtcggcgatctgcgactggcgccaaccgcaaaggcgatttttacccatcctgaagacgggaaagacggatttgcggtggcgctgggcggtagcgcacagtacagcttcaacagcatgtggggtctgtacggtcagtattattatgcgccggaaggccttaccgatcatctcgacagctaccaggaagcgagcggtggtgtgagcttcacgccgatctctctgctgaacctgcgcgtgggttatcagtatattgagctgaataacaaaggcggtcgtaaagataacgtactcgttgatggtccgtacgtaggcgcgtcactgcgcttctgatgtcggcttgagaaaaagggcagtgaccttgcggtcactgcccttttttatgctcagttaacgcggttagtgcgctttgcctttctcaataccggcaccggtctgggagcgaataaactgcgcccggaagcgtgatcgctcttctgcaccctgttgcgaatggtcagtaacagaaaacagccaggtgcccacaaaggcgatagtgatagagaacagggccggatactcataaggataaatgggcgacgcatgtcccagcacctgcacccagacggttgggccaagaatcatcagcaccacggcggtgatcagccctaaccagccaccgaccattgcgccgcgcgtggtcagttttgaccagtacatggacagcaggatgatcgggaagttacagctggccgcaatcgagaatgccagcccgaccataaaggcgatgttctgcttttcgaacaaaatgccaagggcgatagccacaacccccaacaccagcaccgtaatttttgaaacccgcagctcgtcgcgctcgctggcctgtcctttacggtagacgctggcgtacaaatcatgagagaccgccgaggcacccgccagcgtcagaccggcaaccaccgccagaatggtggcgaatgccactgctgaaataaagcccaggaaggtgctgccaccgactgcatccgccaggtgcaccgccgccatattggtaccgccgatcaatgcgccggaggcatctttgaaggccggattagcccctaccagcagaatggcaccgaaaccgataataaaggtcaggaagtagaagtaacccataaaaccggtggcccaaaacacgcttttacgcgcctctttggcgtcggcaacggtaaagaagcgcatcaggatatgcggcaatcccgctgtgccgaacatcagtcccagccccagcgacagagcggaaatcggatctttcaccaacccgccaggctgcataatggctgcgcctttcggatgtaccgccatcgcctcggtaaacaaggtattgaagctaaacccggcgcttttcatgaccataatggccataaacgtggcaccaaacagcagcagaacggctttgatgatctgtacccaggtggtcgccagcatgccgccaaacagcacgtacatcaccatcagaatgcccaccaggataacggcaacgtgataattcaggccaaacaggagctggatcagcttacctgcaccgaccatctgcgcaatcaggtacagcgcgacaacgaccagtgagccgcaagccgacaaggtacgaatcggtttttgcttcagacgataagaggcgacatcggcgaaagtatagcgacccagattacgcaagcgctcggcaatcaggaacagaatcatcggccagcccaccaggaagcccagcgaatagattaagccgtcataacccgaggtatacaccagggccgaaatacccagaaaggaggctgcggacataaagtcacccgccatggccaggccattctgaaagccggtgatgttgccgccagcggtatagtaatcgctacgtgagcgggttcgcttcgacgcccagtacgtaatacttaacgtggcaccgacgaaaatcacaaacatgacgatcgcctgataattgacgggctgtttctgcaccgcacccgtgatggcatcggcagccagagcagaaaagggcagcagcgctgccagcatccacagcataagacgaatcatagtttcacctcgctgaggatggctttagtcaggcgatcaaactcgccatttgcgcgccagacgtaaacgcctgtgagtaaaaaagagatgacgatcaaccccaccccgagcgggatgccgcgcgtcacattggtaccggcatacaggggcgtacccagccagccaggggcaaaagcaataagcagaataaagccgatatacagcaccagcatgattatcgacagcagcagggcaaaggactggcgcttgtgtaccaattcctgaaagcgaggattactttcaatttgttggtagatcctttcctgttcgggcagggcatcattcatcacattatctccagaagcatgcaggcgtggacctcacgcaagcgcgtgaattagttatatttttgtgactacagaaacacactacgtagggaagtggtggcggaaagcctgatgctttccgccggatgattacggcatggtgatggactgtttctcttcaagtaatttctcgacgacgccaggatcggcaagcgtcgaggtatcgcctaaattactggtatcgcctgcggcgattttgcgcaggatacggcgcataattttgccggagcgggttttcggcagagagtcggtccagtgcagcacatcgggtgtggcaatcgggccaatttccttgcgtacccagttacgtacctcggtataaagctcaggtgacggctcctcgccgtgattcagggtgatataggcgtaaatggcctggcccttgatgctgtgcgggaacccgacgacagccgcttcggcgattttaggatgggaaaccagcgctgactcgatttcggctgtgcccaggcggtggcctgacacattcagcacatcgtccacgcggccggtaatccagtaataaccgtcctcatcccgtcgcgcaccgtcgccgctgaagtaggcatttttgaaggtagagaagtaagtttgttcgaaacgatcgtggtcaccgaacagcgtgcgggcctgaccaggccaggagtctgtgatcaccaggttaccttcgcaggcaccttcctgaggatggccttcgttatccaccagcgcgggctgtacgccgaagaaaggcgtggtcgcggaaccggccttgagcagggtcgcgccgggcagcggggcgatcataaagcccccggtttcggtctgccaccaggtatcgactatcggacatttgccgttgccaatcttcttgtggtaccactcccaggcttccgggttaatcggctctcccaccgatcccataatacgcaggctgctacgatccgttccttcaatcgctctatcgccttctgccatcagcgcacgaatagccgtgggggcagtatagagcagggtgactttatgcttatccaccacctgcgccatacgggccggagttggccagttaggcacgccttcaaacatcagcgtcgtggccccgcaggccagtgggccatataacaggtagctgtggccggttacccagcccacatcagccgtacaccagtaaatgtcgtcctgatggtagtcaaaaacaaatttaaaggtggtggcggcgtaaaccagatagccgccggtggtatgcagcacgccttttggcttgccggttgaacctgaggtatacaggataaacagcggatcttctgcctgcatctcagccgcagagtggttagtgctggcggtctgcatcagctcatgccagtgccgatcgcgcccttccacccaaccgacatctttgccggtacgctgaaagaccacgacgttttttacgctgtttacattgggattttttaacgcatcatccacgtttttcttcagtgggatggtacggccagcacgcacgccttcatcggccgtcacaattaatgcggcactggagtcgataacacgaccggccacggcttcgggtgaaaagccgccaaagatcaccgaatgtacggccccaattcgtgcgcaggccagcatagcgactgccgcttccggcaccatgggcatataaatcgcgacgacgtcgccttttttaacaccgagcagttccagtacgttggcaaagcgacagacatcagcatgaagctgacgaaaggtaagggttttgctttcgttggcatcatcgccttcccagatgatggcaggatgatcgcctcgggtagccagatgacgatccagacagttcgctgccagattgagcgtgccgtcctcgtaccaacgaatagaaatattgcctggcgcaaaagaggtgtttttaactttgctgtaaggctttatccagtcaaggattttaccttgctctccccagaacgtttcggggtcggtaacggattgttggtacatcgcctgatactgttcggcagtaatcagcgcgtttgctgcaatattttctggaacaggatagttatgattttggctcatggcgaatctccttgaagatgttaatcatatgtcaatcaatggttaagtgaagcccgacagccggttttgtttcttttttgcgccatagatcacgcgttaaccttgctgacataaaaacgtcgtaaaccgaggaaataaacgctaactccctgcggagaatggggatttaagttgcaacattttgtgtatgttgctgtttaaaaaatcagcaaacgaaccgcacacacattgagcatagtctgaatagctatgcgaaaacttatcgaagtattacttttcataacagcaagttagggattaacgtctgcgccagcattttatgctgaccagatggtgaagttttaatcgaagccaccaagggttgcatttactgcagtgaaaatggtacttatccgcccctgataatcaggtatcaactcagaccgcgtctgaaaatgggtatggaaatcatcgcatttaaatgcgggacgccgtctacaaacaccctctaatttaccgggctttttgctcacttccctgtgtgtattgtcttctgcaccttcgcagtagagagaaacgggttttgactgaggaaattacgcgttatgaaaggttttaaaatcagccttgcctggcagattctgatcgcacttgtacttggcatcatcgtcggtgccgtgttgcataatcagccagaagatcgtgaatggttagtcaataatattctcagcccggcgggcgatatctttattcatctgataaagatgattgtcgtgcccatcgtgatttcatccctgattgtcggcattgcaggtgtcggggatgcgaaaaagctgggccgtattggtttcaaaacgattttgtactttgaagtgattaccaccgttgccattgttgtcggtattaccttggccaacgtgtttcagcccggcaccggcattgatatgtctacgctggcaacggtggacatctctaaatatgaagccacgaccgcccaggtgcaggaaggcacccacagcctggtggcaaccatcctgtcgctgatcccgcagaacatctttgcctcgatggcgaaaggtgaaatgctgccgattatctttttctcggtactgtttggcctgggcctttccgctctgccgtcagaacagcgtgatccgctggtaaacctgttccgtggcgtgtcagaaaccatgttcaaggtaacgcatatgatcatgcgctacgcgccagtgggcgtgtttgccttgattgccgtcaccattgctaactttggtttcgcctcactctggccgctcgctaagctggtgctgctggtgtatgtcgcgatcctgttcttcgcctttgtggtgctgggggcggtggcgcgtttctgtaagctacgtattacgacgctgatgcgcattttaaaagatgagctcatcctgtcttactcgacctccagttcagaaaccgtgctgccgcgcatcatggagaagatggaagcctatggcgcgcccaaagcgataaccagctttgtggtcccgaccggttattcatttaacctcgatggatcaacgctgtaccagagtatcgccgctatttttattgcccagctgtacggcatcgatctgtcgctgacggacgaaattattctggtcctgacgctgatggtgacctctaaaggcatcgcgggtgtgcccggcgtatcctttgtggtgctgttagccaccctgggcagcgtcggtatcccgctggaagggctggcgtttattgcgggcgtggaccgcattatggatatggcccgtaccgcgctgaacgtggtcgggaacgcgctggccgtgctggtgattgcccgctgggaaaatcagttcgatgtagaacaggccagggcgtacgaattacaattacggacgcaaactgccagttaatcgcggtttatcatataaaggctcaacggtggttgggccttttttttgcccctgttttcattcccgctaacgatgaaagaaaaaaacgtctgcaatggatgaattattcattcgttgtgttaaaaatattcagaataaattattcctgtggaggacgatcgtgaaaatcgatctcagtcagatgatcactgaagggcgtaatccagccagccagcatattgatgaaatgagcaccgaggcgatgctgcgggtgatcaacgatgaagataaaaaagtcgccctggccgtggaggccattgtgccagcgattgcgcgcgcggtggatgtcatctgcgccgcattccgcgcgggtggccgtctgatttactgtggtgccgggacctccgggcggctgggaattcttgatgcaagtgaatgcccaccaacattcggaaccccgcgcgagcaggttattggcctgattgccgggggacatcaggccattctacaggcggtggaaaacgcggaagacaatgtggaacaaggcgctcaggatctgaaagatatccagttcagccgcgacgatgtgctggttggcatcgccgccagcggacgcacgccctacgtgttaggcgcgctggactatgcccgacaatgcgctgcatccacggtggcgctgacctgcaatccccacagcaagatggcgcaggtcgccgatatcgcgctgacgccagtggtggggccagaagtggtcacggggtcatcacgtatgaaggccgggaccgcacagaagctggtgctgaatatgctcaccacaggggcgatgattcgcagcggcaaggtttacggcaatttgatggtcgatgttgaggccaccaatcagaagctggtacagcgtcaggtgaacattgttatgcaggccaccgactgcgatgaagccagcgcccgctcggcgctgtcggcctgtggcgggcactgtaaaaccgccattctgatggtgctggcaggattaactgccgacgaggcgatcgcgctgctcgctcagcacaaaggctttatccgccaggctttacaggatgcgggagcacgctgatggcaaaaatgaccgatgcacttctgcacgctatcgtgcaggcggttggcggggcggaaaatatcgccgtatgcggcaactgcatgacccgtttacgactgacgctgaaacacaaccaggccgatattgcccggctgaaaagcctgcctggtgtgctgggcgtcatcgacagcgataatcagttacagatagtgctcggtcccggtaaagcgcagacggcggcagaacgaatgctgacaatactggcgcaggcgccgggcgagtcaccggttttgcagcaggtcgccgcgcaacaaaaacagcacataaaagccagacagaccagcgcgctgcagcagtttctggcgcgcttcgccaccatttttaccccgctcatccctgggtttattgccgcaggtttgctgctggggtttgccacgctgattgagcaaagtcttcacctcagcacgcctggcgatcatcctgcctggttaattcagggcgtggcctatatgaaagtgtttggcaaagggctgttcacctttctcagcattctgattggctacaatgcgcaaaaagcctttggcggcacgggcgtaaacggggccatcatcgcgtcactgtttattctgggctacgtgcccgatgcaaaagtcggctactacagcggcatggacagcttttttggcgtggcgatcgatccgcgcggcaatattatcggcgtcctgctggcggccatgtttggcggctggctggaaagacaactgcgcaaggtcatcccggacaatctggatatgattcttacgtcgctgttgaccttattgatcaccggcgcgctgacatacttgctgatcatgccgttaggcggcgagttgtttaagggcatgtcgtggctgtttatccatctcaataacaatccgtttggttgcgcactgctggccggactgtttttaattgccgtgatgtttggcatccatcagggctttattccggtctattttgccctgatggaaacccagggctttaattcactgttcccgattctggccatggctggtgcaggtcaggtcggggcctcgctggcgctctggtgcaaagcagaaaaaggtgcactgctgcgtgcccagatcaaaggtgccatcgtaccgggcttactcggcgtcggtgaaccgctcatatatggtgtgacgctgccgcgccttaaaccctttatcacggcctgcggcgggggggccatcggcggatttttcattggctcagtggcgtggctgggattaccggtgggcatgaatacggtatttggcccctctgggttggtcacgctgccgttgatgacctcccatcagggtatttttgccggcatggcggtttatctgggaggattgatcgtcgcctggataagcggctttttactgacgtggtggttcggtatgcgcaatatcgatctgagctgaattcataagcagtaaatgatgaaaaccgcattggcacgcctgaaagtgaatggatttggcgtgccttttagcgcaaaaccccagtaaacctgctgtgtgctaaccagtagcggcaaagtaagctcagccgacgtgatgtatccgatcccctaaaaacagagaaagccgcgataaagcggcttttttaatgcaacaaatttacgtgtagcactaaagagtcattacgcaagtgccgaaaacataaaaaaaggtaatctttaccttttaacattcactcattaatgcttctggtgcaagtctgactggtactaacaaggacgcctatgcgtaacaaccaacctgtttctcagcgtgaatatgtctatgacgatcatgcaacgctgatgtctaccaccgacctcaacagttatatcacctatgccaatgacgcttttattgaggccagtggattttcatctgatgaggtaaaagggcagccgcacaatatggtgcgccacccggatatgccgccagaagcgtttgcagacatgtgggcaaccttaaaacagggcgagccctggacggcgctggtgaaaaacagacgtaaaaacggtgaccattactgggtgcgggcgaatgccattccggtcgtgcgtgatggcaacgttcagggatatatgtcggtgcgcaccaagccttcagcgcaggaagtgaagcagtgtgaagcgctttatcgcgatttccgcgaaggacgcgcgaaaggccgccagtttcataaagggctgattgtccgcagcggctggcgtcgtctggggtcgatattgaaaacgctgccgctgcgctggcgcatccgtaccgccttactggctgtattgccgctgtccgtggccggtgtgtgggcaatgggcgtctcgctgctggcgctgagcggatttgctggtgggatggcctgcctgctgttgctggtcagcctgtggctcgaacagcagatttcccgtcccattgagcgcatgtgtaagcaggcgctgcgggtggcaaccggtgccagtcatcaggttgagcagatggatcgcatcgacgaagtgggcatgacgctccgagccattggacagctgggtttgatgtttcgctggttagtggatgatgtcagcggccaggccattaatgtgctgagtgccagtgatgctattgcccgcagtaataacgaactgagccggcgtaccgaacaggcggcagccaacgtgcagcaaacggccgcgaccatgaacgaaatgaccgccacggtgaaaagcaatacgcagaccgcccaggaagtgaattcgctctcggttaacaccagcgaagctgccattaaaggcggcgacgtaatgaaagaaatgatggggatgatggcggaaattgctgacagctcacagcgcattgccagtattaccagcgtgatcgacagcattgcctttcagaccaatattctggcactgaacgccgcagtcgaagctgccagagcgggcgagcagggtaaaggattcgccgtcgtcgctggtgaggtgcgcagcctggcgcagcgcagtgcaaaagccgccagcgagatcaaagcgctggttgaaaccagtgccagccgggtcagttcaggcaatgagcatgcgggcgcagcaggccataccatgcaggacattgtgcagcaggtacagaatgtcacttctctgattgcgcaaatcagtgccgcgaccgccgaacagtccaccgcgctgagtgaagtgagcacggcggtggaagatctggatgatatcacccatcaaaatgcggcccgtgtacaggaaagcgcggaagcctcgggtcgcatgactcaccaggctaaccggctggtggaagcgataagcgtgtttcgctaagaaacggctgcctgcgtgctgacatactcggcacgcagcgcacccggcgaccgtccgataatccgtttgaacgcgcggctaaaagcggccagcgaaccgtaccccaaatcgaaggctaccgtttccagcgcttcgccatgattgacgatgcgcttgacggctagccgcatacgtaattcggtcaggtagcgcagcggtgtcataccggtggcatgaagaaagcgttcggcaaacaccgagcgtgaacttccggcttcgcgcgccagacgttctaccgtccagttctcgcctggcgaacggtgcatggccgcaatggcctgactcaggcgcggatcgcgcatcgcctgcaccagcccgctactttgcccgcagccattctccacccagccacgcaccaccagcgcagcgaccacatccgccagacgcgaaaggatgcccgcatggcccgcatgtcgggtgcgggactcacgttccatcgcttccagcatcgggcgaatctccggatattgcgacagcagcgtactgaccagcatgacgtccggcatggtgttgattaaaggctgcataccgcccagttcaaacgccatgctggcgctgaataacaagacgctgtggtcatcttcacaggcatccgcgggcgcggtaatggcgcagatgctgtcgcagatcggcttgcttgccagggagtcaatacactgacagtccgcctcctcactggaaagcaggctgtgcggtttaccgtgtgggatgagcagggcatcgccactgttgagcgtgaagagtgcgccggatgcacctcgcaccaacagcgtaccgcgacccacgaaatgaaactgggcacgtcccggcgaggcgttaaagcgcaagccaaacggggcgctgacggcaatacgttggtagttaacgccgtacaggcgcatgcccattagcaactcactggttaactcatcgtaacggctcatggcagaatccagacgaattatcaaaaataacggtgtaaccatcatagatcgtcttgctcttcccctctatgctcagcactacttttttttatccggagaagcaacatgagtctgaacaccgatgtggctgatgaggtttccttatccacgcgtcctgcgtggggggccgtctttgcgatggcgtttggtgtgtttagcctgatcaccgcagagtttttaccgatcagcctgctgacgccgatagcgcacagccttaatgtctcagaagggctggcagggcaaaccgttaccgtcacggccctgattgcactctttaccagcctgaccgtaggcagcgtggcaggacgtatcgatcgccgggtgatgatgctggcattctcactactcctcatcgtctcggcattgatggtggcctttgccgccaatctgaccgtcattttgctggcgcgcgtcctgcttggcgtggcaatcggcggtttttggacgctgtcgaccgccattaccatgcggctggtgcccgccgatcaggtgccgcgcgccctctccatcgtctttagtggtatttcactggcgaccatcatagcgacgccactgggcagttatctgggtgggctggtcggctggcgcgctatctttctgtttacggcgggcctgggggcgacttccctgctgtggcagtttttcacgcttcccgccatgccggtggaaggcaacacgcgcagcggcggcgtgctgtcattgctacggattaatgtcatgcgctggggaatgctggcggtgatcatcatgtttaccgcgcactttgcttttttcacctatctgcgtccgttcctggaaagcgtggcacgcttgaaccttagccagctctctctggtgctgctggcattcggcatcgctaactttttgggcacctatctggctggttatctggtgacacgcagtgtgtcactgacgctgagcggaatggccttgctgatgggcatcacagcctcactgttggtagggtttggtcatgtgggtgggctggtcgccgtgggcgtcgcgctctggggcctggcctttggttcgatgccgacgggctggtcgacatggatttcacgagcggtgcctgacgatgccgaatccggcggcggtttactggtggcgaccatacagctggccattacggtgggcgcggctgcaggaggctggatgttcgattttcgcggcgcgggcggtgtgtttcttgccagcagcgcgctgatgctggtggcggcgctcacgatatatacgcgtgtcaggcatcacggttgagtggacctatggcagcaatatatgctgcctttttattttatcctggttttttaaccttttgtgttttaaccaagctaaacgtgctctttactttcagttttattgaacaacttaagcaaaagcctctgcttttttctgatcaagattcggcctattatgttttcacacaaggcagaacgccttaattaaactgaaaaagaccgaggaattaatcatgaaagctatcaaaacttttgctgctgttatcgcccttgttgtacttcctgttgcaggcttcgcgcaaactgtgaccgcgaccggttctactctggacagcaccgaagcgaaaattgctgcgcaggcgcaagaagctggtgcttcctataaaatcaccgaagccaacaccaacaacggcgtacatatgacggctgaactgctgaaataatgctggaagttgtgtgctgacaggacgcctttgggcgtcctggcggcgtttgtgggtgcatatccgtctccgtcttatcctttctcatccttgtttccctgccagacgttcacctttttaagcacgcaataatcatttcagcctgcatcaggcgcttgcctgaatttcaaacacactaacgcgcttgctgcaccggtaacggcgtcatgcgggaaacgttttgctgccagcagcagcaaggtgataaacacgcttaccccgaacggtcgccaacgcgtgaaacggtaaggctgccgtagccctgtcaggcgccaggggatgtgagaggacatcaccgatttaggtgaggagagcgtgactcaggtcagggggagaaaggcgaaaacgcatcagcatcacccggaaggccgctaagacggctcccagtctggcgatcgctgtcaacggaaaagcacggtttgtcagcgtcaaaccgccggaatggcgcaaagcgctgccagcatggcctggcagcatcctgtgcatgacgctggacgcatgatgattcgcctgctgcgcgaatccgccgcaggcgaagactcaggttatgacacgtcttcagaggcgtcacgcatcatctcaccgtgcggcacgtcatccagaatctgctcaaagctgcgcagacgtttatagatagacatcagctcaaccagcgttgaccacgaggtgatgaggtactggaacgagctgcgcacctgatcgaaaacgttggttatctggttaagcaggcccagtgtaatggttccggctacgatggacgggaacagcagaaacagcccaaacacgttatccacctgaagataaagaatgcggctgatattgaaatagagatagtggaaatacaggcggaaatagttaacccggacattgttgaacagcacttttaccgtgggcggcgttgcgcggtcagcattgtcttcgccgtaaaccagctctttacgataggcggcttcaacccgctgattacggaactccagaccgggaagtttaattccgaccagcgccagcaggccggtcccgaacagggaccagagcaccgcggcaatcaccagcgcatacggaatattacccagaatcgggatattttcgacgtgatgtgacagggcaatcagcaccggcaaaaacgccaccagcgtcataatggcctgaataaagtttacgccccagctttccagcgtcgtggcaaaccgcatggtgtcttcctgcacacgctgggctgcgccttcgacatggcgtaaacgctgccagtggtgcatgtaataattattcatcgcggtacgccagcggaatacccaatggctaatgaaaaaggcgttcatcacgccaatcacgaccgcgattaaggcgatacctaaaaatgccatcacctgagcataaaattcgttaatttgcaccgaaccggctttcgtcagcgctttttgaatcaaatcgtaaaaagggccataccaggcattcacggcaacaccgacctgcaccccaaaccaggtaacaaaaataatcagtgccgaaccccataccgaccagcgctgccagggatggttatcaaccaaccgccaggcgaccgcgaagatcgcgaccatcagccagtaataggcataaaaccacaattcacccggtgcaataaaacgcatcaccgtcgtgggtaatggctgcttcattgccgcctgaaaagcaggccaaaaatgcccgggtaactcgctggcgaagccaaaccaggcaaaaatggccagcaaactccaaatggcggccgtgctgaaaaacagccccggtcgcgggaagaaagacttaaacataggtactccgctgttgtgtaatcgcttttataacgtttaaacggctatctgtctgtagcctgttgtttctgaacatgacatcgacaaaatatatgttaatggaattgtgcttttttgtttccttaaactaaatgtttattggtaatggtgttacacttgcaccaactgttaccggtaacagttggttgtacccgaaatccgcagataaaaaccactacaacgcactcacttctctttttcgtaccgcagttgatgcggtgatgaggcaatgtcatgtcagaccagaaaaagggtcattcacgcagggattttttgctgaagaccatcaccctggcgcccgcagtggcggtaggcagtagcgcattcggtgcattttctgcacccgctcaggcggccgcacccgccgaaaccccgtctgctcgcgattatcagcccacctggtttaccgccgaagaatttgcctttattaaggctgcggttgcgcgtctgattcctgccgatgaacgaggccccggcgcgctggaagctggcgtgcctgagtttatcgatcgccagatgaatacaccttatgccaccggcgcgaactggtatatgcagggcccgtttaatcccgacttacccaaagaaatgggttatcaactgccgctggtgccgcaacagatttaccgtcttggcctggcggatgcggaccagtacagcaagcagcagcacgctaaggtgtttgcccaactcgatgccgggcagcaggacacgttgttacaaaacatggagagcggtaaagccaacttcagtcagctgcccgccaacgtgtttttttcttatttacttcagaacacccgcgaaggtttctttagcgatcccatccacggcggtaatcagggcatggtgggctggaagctgatcaacttccctggcgcacgcgccgactttatggactgggtagagcgcggtgaacgttatccgttcccgtcggtgtcaattcgtggggagagaagctgagcatggcgaatgcattaaacaaagtcgatgccgtgattgtgggttttggctgggcgggcgccattatggctaaagagctgaccgaggcgggcctgaacgtgctggcgctggagcgcggcccgcatcgtgacacctatcccgatggttcttacccacagtctattgatgaactgacctacaacgttcgcaaaaagctgttccaggatctgtctaaaagcaccgttacgattcgtcacgatgcctcgcagaccgcagtaccttatcgccagctggcggcctttttgcccggcaccggaaccggtggcgcaggactgcactggtcaggtgtccatttccgggttgatcccgtagagctgaagctgcgtagccactatgaggcgcgctacggcaaaaactttattcctgaaggcatgacgattcaggactttggcgtcgactaccaggagctggagccgttttttgataaagctgaaaaagtgtttggcacctccggtagtgcctggagtattcagggcaaggtcgtcggcaaagacaagggtggtaacccgtttgctcccgaccgctctgacaactttccgctgcccgcgcaaaagcgcacctggtcggctcagctgtttgcacaggccgccgagtccgtaggttatcacccttacgatctgccgtcggcgaacacctctggcccttataccaacacgtacggcgctcagatggggccatgcaatttctgtggctactgcagtggttacgcctgttatatgtattccaaggcatcgcccaatgtgaatattttgcctgcactgcgtcaggagccaaagtttgagctgcgcaacaattcttacgtgctgcgcgttaacctcacggaagataagcagcgcgcgaccggcgtcacctatgtggacgcgcaggggcgcgagcaggtgcaaccggcggatctggtcatcctgtctgctttccagttccataacgtccatttgatgctgttgtccggcatcggcaaaccttacaacccgatcaccaacgaaggcacggtagggcgcaacttcgcctatcagaacctctcgacgctgaaagcgctgttcgataaaaacaccaccaccaatccctttattggggcgggcggggccggtgtcgccgtggatgatttcaatgccgataattttgatcacggtccacacgggtttgtcggcgggtcgccgttctgggtgaaccaggcgggcactaaaccgatatcgggtctgcccacgccaaccggcacgccaaactggggcagtcagtggaaagccgccgttgctgatacctacacgcaccatctttcgatggatgcacatggtgcgcaccagtcttaccgcgcgaactatctggacctggaccctaattacaaagatgcctacggccagccgctgcttcgtatgacgttcgactggcaggacaacgacatcaagatggcgcagtttatggtggggaaaatgcataagatcgccgaagccatgaaccccaaaatgatcattggcggggccaaaaaacccggcacgcatttcgacaccaccgtgtatcagaccacgcatatcagcggcggggcgattatgggcgagtctcctgagaccagcgcggtcaaccgctatctacaaagctgggatgtgccgaatgtctttgtgcctggcgcgtcggcgtttccgcaggggctgggatataaccccaccggtatggtggcggcgttgacctactggtcagcgaaagcgattcgcgaacagtacctgaaaaacccaggcccactggtacaggcataaggaagatggcgatgaaaaacggcattttagccctgattctgggcggtattacctttgttgccctggccgatgagcctgctggcgatctgataaaacgcggcgagtatctggcccgcgcgggtgactgcgtcgcctgccacagcagtgacggcggcaagccctttgcgggtggattgccgatggcgacgccgattggcactatctactccaccaatatcacgccggataaagcgaccggaattggtgactacagctacgacgactttcagaaagcggtgcggcacggcgtggcaaaaaacggcgatacgctttatcccgccatgccttatccctcttatgcggtggtcagcgatgaggacatgaaggcgctgtatgcgtacttcatgcacggcgtcgcacctgtcagtcaggccaacaaagagagtgatatcccctggccgttgtccatgcgctggccgctggcaatctggcgcagcctgtttgcaccggacgtgaaggcgttccagccagccgcgcaggaggacccgacgctggcgcgtggccgttatctggtggaaggactgggccactgcggtgcctgccatacgccgcgtagcgtcaccatgcaggaaaaagcattaaataacaccgagggcaccgattatctggcgggcagcagtgcgccggttgacggctggacggcgagcaatctgcgcggggataaccgcgatggcctgggccgctggagtgaagaggatttacgccagttcctgcgctatggccgtaacgatcataccgcggcatttggcggcatggtggacgttgtcgatcacagcctgcagcacctgacggaggaagacatcacggcgattgcccgttatctgaagtcgctgggcgcgaaagatccgcatcaggtcgcgtttagcgcggatgacgccaccgctaaagccctgtggaagggcgatgacagccagacgggtgccgcgacgtatgttgacagttgtgcagcctgccataaaaccgatggcagcggctacaaacggttttatcctgcgctgcggggcaatcctgtggtgatggcggacgatcccacctcgctgattcacatcgtgctggtcgggggggaattgcggggcgtcaacggcgcgccttcgaccattaccatgccggcatttggctggcgtctgaacgatcagcaggtcgcggacgtggtgaactttattcgccgcagctggggcaataatgccacggataacgtgacggcgaagcaggtggccgaactgcgtgaagacgtcaaagatcgtcagggtaatgcggacatcaaggtgttagaagggaagtaaaccgcagtgtttcagccttccccgcagggggaaggctgaatgttcagatgttttccagcctgatactgcgcgtcttcggaccgaaaaggcccaccgacagcataaccatcagcatactcaggacgataaacacgataaccccatgtgttcccgcatactgcaaaatcacaccgattaaaatactgctgaacgcggtcgacaaccggctgaatgagtagcagaaccccaccgcccgggcgcggatgtgcgtggggaaaatctcagtctgataggcatgatagctgcaggtcagccaggcattcgagaaggtgatcaggaaaccgcaaataatcagcaagaccgggttggtttgcagggcaaacagcgtcccaaacaccaccgtcatcagcgaagagagaacgatttgccatttgttttcaagctggctggtaaagctgccacaaatcagcgatccaatcggataggccagcgtaataaaaaacgcatacagcaggctgtgggtgatggatgtcccctggcctgacagcagcgccggcagccagttaccaaaaccataaaaaccaatcgcctgaaagaagttcatcaccaccagcatgagcgtgcgcttacgatagcgggatgaccaaatctcacgaaaacggctcttttcctgtcggcttgccgcgcccgttaacgtcgtcagcggcaggccaggggtgatgccgcaacgtttttccatttttgacatcacctgatgagcgtcatcaaggcgtccctgctgcgccagccagcgtgcggattccggcagatttttgcgaacaagccagataaccagtgagcagaccgcaccggcaatcaccacccagcgccagccttccaggccaagaatgttttgcggcatcagccaccatgacattaacgccacggcgggcaccgataaaaactggataaaaaacgaaaaggcgaacgcccggttacgcaagtgagtgggcacccattcactcagataggtatcgatggtcaccagctctacgcccaacccaatccccactaaaaagcggcacaggatcaccatctcagcactgtgctgaaaagccatgatcagtgagaacacaccgtaccaggccagggcgcagataaaggtcagtcgacggccaaagcgatcggcaaacggcgtgagcaggctggcaccgacaaacagcccgagaaaggtagccgaggcaaatgccgcctgatcggtgatgcccagtattccggcgctgcccgcatggaaaataccggctgccagcaagcccgtactgatataaccggtttcaaacagatcgtagagttcaaagaagcctcccagcgccaggagcgagataaagcgccataagccggcagaggaaggtagcgcatcaatgcgctcagctaagctggtgttggcggtcgacgatgccggcgacggtgccatccctgtgatgaaggcggatgtcatgtaaggtgaacctcatatcaggatgattgccattcccactacaggccgtgatgtgttttgaaataattgcccattagcgagccgtgaagcagcagaataatcaattacctgattcttgccgacaggaatagtgatgaatttttagcaacgcatattgcaaggttgactggcacggcttttcaggtggacggcaagactgcagatgtcaacggcgcacgagccggtgagggcaaaaagcgcagtcagcaggtatcttgacgggcacagcggtaaaggcagacgtcagccgggtcattcagtgccttaccccgcccggcaacacatctgtttcccgccctggcattatcaccagagcgggagcctgttttacgcgcccgacaggcggaaagcagaaacggcgtgggtaagatgctgcgcctgctcttccagcgaggcggcagcggcagccgattcctggaccagcgcggcgttttgctgagtgacgccatccatctcggttaccgccttttcaatctggctgataccgtgatgctgctcatcggacgcggtggatatgtggtccatcagttcgttaacccggctgaccgaggcgataatggcattcatcgcttcgccggtgcggctgacctgatcagacccgacgcgtatcgttgcgaccgattcggcaatcaggccttcaatttctttggcggccacggcgctgcgctgcgcgagattgcgtacttccccggcgaccaccgcaaaccctcggccttgctcaccggcgcgcgccgcttcgactgccgcgttcagcgccaggatattggtctgaaaggcaatgctgttaatgacgctggtaatgtcctcgatctttttcgagctttcgttgatttttgccatggacacgatcacctgctgagaaacgttctcgccggtttccgcattctgtaccgcttcattggccagacggcaggcttcaaacacgttgtccgtgttctgtttaaccgttgcccccaactgctccatactggccgccgtttcggtaagcgctgcggcctgctgttcagtacgggacgccagatcgatatttccgctggcaatctcttgagaagcacaggacaccgcgtgggtagagtgacgtacccggataatgatgtccgtcagggacgtccgcatctgctccattgaacccatcagttgctgaatctcgctccgtgagccgacgttgaccggcaccggatggtcgagcacgcctgccgcaatctcgctgcagtgcgcttttgcgttattcaatggcgataagatatagcgtctgacaaagatcagtatcgcaatgatgatggcaaggaataacaggccaaataccatgagcagtgtgatcccggatgaaaagttgctttgggcatccgtgttcagtttcttcgcgtaagcctcatgctgggccagcacctggtccaggacaatttcatactgccggtcaaggcgcactacgttggcgatctggtttttaaagcgcgtctgatcgcgggcttcggcggcttcaattaaaggctgaattccctgattgcggtaagccaaataggcctggcgatagcggtcggcgtcggcctcttcaccgggaatacgcggcgcgctcagataagcctggaaggccgcatcggctttcgcggccacgcttttcacgctgtccagcgacgagttggcctgagtgccgtcactctcaatctccttcatgtactccatcaggcgtacgcgtaacgtgcggctgtgattgatgggatcgataaccgatagcaccacacggatttctttattcacggcattcaacgatgcgttactgcgagccagtaaccagatgctgaccgatatactgataaggaaaagaatcaacaggaacgagagaaccaggagtgaagatttttttaacgacattacacagtcccgaataatgaattaagaacacagttatcggcatttgggtggtaaatatttagcaggaaggtactgaaaggaataaagaataatgtgtataaaacatgagcaaaataatgaaccagctgattcaatataattaagcgactgtctgtcttaccgcttcgcttatttagcgtatgacgttactgaatctgaaaatttcagggccagccaggctggtgcctgaagtaagaaaaacggtttaagcggaacagctctggcgaagttcgttattctggcgaacgtttttttctttaactggctataaataaaggctttatcagaagtaataaatagtgattattgcgaataaaacaataccgaaaggttattcaagacaaactattcttttttctggccctgttctggttgtaaaaatatcagggggaaacgcttttagctgccaggtaaataatccgaatgatgaagattttcccggttatcatcgttatccccgacctgtcgtctacacttattatctctgtataagaaagactttactcaccggtatcgaggtaataatgcaagtatgtccctatttgtttctctatggtcgctgtgaagaagcgatggaattctatttgcaggcaacgggtggacaactgctgcaaaaaatgacctttggcgataatccggagcagggcgaacaggtcggcgatcgatccgcaccgccgctgccacctgaaaagattatgcatgcccatctgcgtattggtcagggcgagctgatgatgagtgacggtaatccgtaccagccaccggcctcagaacacgcgggctatgccgtgagtctggcaacggacgatgcagagcagggtaaagcctggtttgagaagctgtctgcgggcgggaaagtcaccacgccgtggcaggaaaccttctggtcaaacggctttgctatgtttattgataaattcaatattccatggcgcatcaacgtggtgaaatccgacgcgtaatgcacggtatgaaccctgaaaagacgagaggccttcttcaggaaggcctcaacgtttttttagggtcgtgccagcaatcagaagttatagccagcaaccaggtagtaaccccagcccgtagacttgatttcagacgcgctgtcaccaaatcctaactcctgaccggctccccactgaccgccgttatggaaataacgtgcaacggctgagaagtgccagtgagcgtaacccagtgacaagatatggctggaggcgattgcgttgctggtgcgaatcgggcccgacttatcgcgtaagtccgaaccccagtcgaagttggtaaagccaacatagccaagattaccgccccacagggtcgtgatcggcacaaagtatttcactttgaagcgatagccatcccagctgttttcattcgccgcaccgtagttttcccactggtatttggcatagacgttaagtgacaggccgatatcgctgtgcgtatcaatgtctgtgcccaaacccatataccaggtattttgacggttagcgctgttacggcccatatcgtagatatagttgttcgcaaaataccactctttaaacggaccaaaggccaggctggtgccggtcagtttatcaatcgagaaacgtggctcaatttccatgaacagcggcgaaccgtggtcgaaaatgccgttagcattgctgttgcccgcgccaaagaagtttggcagatcaacgtagccgtaaaaatcaaaccagtctttcttcgcgaaagcttcgtattccagatacacatcgttattgaactgtggtccgaaacgggtgtggtagctgcccaccacgttgacgctttgatgccaccagtcggaaacgtactggggatcgttttctgcagcctgcactgcaccgtttaaggagcctgccagcagggcacctgccattaacgttttaaatttcattgtattttgaccactggtttcttatgcgcaagacaatcgtttgcgcgctgtttggaaatcaatcccaaaggttgggcggtgaagtatctgggccgcatttttttagttagcatagcgtgccttttacaatgagatagaaaatagcttttgatcacatttgtcaaaatgtgttgcataacaattcatcaatattgtgacttgaatcacaatattgctggaggcgaacggaaccaggcaaccgtttacgttgtcgggttccggttcgaacgacggggattaaggaaaggtgacgcgcacctgaaaaccgcagcggtcaccttgcggagtcaggcagttggacagggcaacgtggatctgatgtttctgcgcaacactgcgcacaatcgacaaccctaaaccgctcccctgcgcttttacatcgggcgagcgggcaaaacggtcaaacgcgcgttcgataaaggactcaggcatacccgggccgttatcaacgatatccaccacggtttgccccgccacccgatgcagcaggacatccaccaggctgccttcgggcgtgtgcaacatggcgttgccgatcaggttgtcaaacaggctccgcagctctgaacgtccggcctgcaaatggtagtgcgtggttccgctaaagccgatatcgataccgcgcttatcggccaccaccatgagctgctcaatgctctctttcagcacatcttccagcgcgatattttccatgctggcgacgacggactgatcttcccagcgcgacatattcagcaactgggtgaccaggtgacgtgtacgggtgacgccggattccagttgcgcaaactggcggctggcctcgccaggctgaatgtgctgacgcaggttttccaactggagcgtgaccgccgtgaccggcgtccgcagttcgtgagcggcatcttccataaactgacgctgtgaagaccaggcggcacggagcttatccagcaaagagttataggcggcgaccagcggctgaatttcgtcggggaggctttcaggggaaacgctgtgtgggtgatgggcgtcctgcgcggcaatttcacgcgaggcaacgcgcaaatctcgggtgattttgcgtaccaccagccagatcaccagcaacgacagtggcatcattaaaatcagcggaataatggctgacagcgcccgtctcaccatcatttctttcatgtagctgagattgagcatcacctgaatggtttttatctcgctgcccggctggcctgagcgggtgtaaatccgccattcgcagtcgtggcaaccgccaatctgcacatctttatagccgttttcagcctgcagcggcgcatgcagttcaggccaggagctggagcgtaactggcctttggcgtcccataactgaatcacgaaggcgcttttaatcttgtgtgcgggcgcaataagcggcatcagcggggggatttcgcggttcactgaccaggcatcggccagcttggctaactgctcatccttgatgacgccaaccatttcaccgtagcagctgaaaaagtaccaggccacgccgccaatcatcagcaaatgaatcaccagtaacgtactgagtaatttattacgtaacgatcgcataaaaattttcatattgccggtacccgccaacccagtccgcgtacattgcggatcacatcattatccagcttgcgccgcatcccgtggattaagacatccactgcattactgctgacttcttcaccccagccataaatacggttttccaactgctcgcgtgacaggatggcaccgggccgttccagcagcgcatagagcagggcatattcacgcgcggttaactgctcacgttgccctttgtacagcacttcgcgtgtcagcatatccagttgaacatcaccgctgcccagcagcgaatcggcagagccatgatggcggcgggtaattgcccgcatccgggccatcacttcctgcagatcaaaaggcttaagcagatagtcatccgcaccgtaatccaggccctgtacccgctgggcgaccgtatcacgggcggtaagaattaaaaccggcgtggcatcgccgcgcgcccgcgcgcgccgcagcacctgcaaaccgtcgtcgcggggtaagccgagatcgagcagtacgcagctgtagccgccttcgctccaggcgttttgcgcgtaaacgccatcgcgcacccagtcgactgaccagcctgccgcttccagcgcctgctgcagatttgcgccgatcatttcatcatcttcgaccaacaacacgcgcatggatgacgtcccccgaaaaatggcaacagtgtagcgctggattattagcgcagaattattggcatgccgagtgcggcaaaatgccgttacgcgcccggttaaggggtgataatgcaccctgaaacggacgattttaccgctttgctaattctgcgctaagttttcgctaattaagggataaatttagcgcgctaaagtgtgttccctgcacatctgctttaaccaggagaacaccatgaatcagcgcgagtttattcgtagtttgctggaatggatagaaagcaatttaggacacgatctgcatctggacgaagtggcgcgccgggcgggctattcccgttggcatctgcagcgtttatttcgccagcacaccggcttctcactggccgagtatattcgtcagcgtcgtttgaccgagtcggccttaacgctgctcaacagtaacgaggcgattttacaggtggcgatgagctatgggtttgatacccagcaggcctatacgcggacgtttaaaaactattttatggtgacgccaggccagctgcgccgccagcgccgggtggagcctgaccgtttattgtttccctatgccatggcaagttagtcactgtatggacattcccatccgctagcctgtgggaatgtccatgcatcgccagggctgtcccgcacgccttttccgctactgacgctgttagccttcccgccgttgctttattcttactgccagatgcatggcgtcattgctgtgccataacccgcagccgccgttctggcccgtaggaaaccgatgaataacagcgataacctgatcgccatgatgttgtttgcgcgcgtggtcgagcttaaaagctttacggaagccgcgcgtgtactcggcgtatcgaagtcccatatcagtcgggaaatcgccgggctggaacaacggttgggcattcggctgctgcagcgtaccacccgcagaatgacgctgacggagctgggccaggcttactatccgttttgtgtacgtatgctggatgaactgcatcaggccgaggattttgtgcaacaggcgcaccaaaatcccgtcgggaatgtgcgtttacaggcgcccgtcacctttggctgccagtgtattgtgccgctgcttaatcgctttctgcgccgtcatctgcacatcaatgtcgatctcagcctgacggataataacgacgagacgattggcgacggggtggatgtggcgattgttattcgcgcccatgcgccccgccagggcaactttcggctattaagcgacatccactgggggctgtatgccgcaccggtttatctggctcagcatcctgccatctcgcatccccgtctgttacctcgtcatgatttattgatgtttcacggcccggcgcatactgccgcgctgccgtttcgtcgcgacaagctgcgcctggcggtggacgtgcgtagccgttttcgggccaataacagcatggcgctgctgaatgcggcgctggcgggcaacgggattgcttatctgccctcctacatggtgcaggaggcgctgacccaggggcagattgttcaggttctgcctgagtggcagatggatcgcttacagagttatctgctgatgcatcaggacatcgcgcctgcctcgcccgttagcctgctgtgcgacatcctgatcgaccaactgggcggacgctgattgttgcagtacagcaacaaactatgccagtcagcaaatatcacgcgccgactgttgttgcctcgtcaccattgttagcctgagtccctgaactcgatggggatatcgcatggaaatgacgtctgaggcacctgcctttcgccactggaaacgtaacgtatgggtttgcgtctttggctcttttacgacccttgtcgccatgaccttactgttaccttttttacctttgtatgtgcaacaactgggtgtacaggaaccggcggccatggcgcgctggtccggcgttgcttatggtgccacttttctcagcgcggcgttgaccgccccgctgtggggcaggttgggcgatcgctatgggcgcaagctgatgctgatccgggcgagcctgggaatggcagttgcgatggcactgattggcatggtaaccaccgtatggcagctggtggcgttacgtttactggcgggattactcgggggctactcatccggttccaccatcctgattgccgcgcaaacgcctaaatctcataccggatgggcgttgggcatgctggcttccggcatgatggccggtaacgtgatcggcccgttgctggggggcgtactgccgccgctgatcggtattcgggccacgttctggcttaccggtgcggtcattttcgtggcttttctcgccaccacgtttttacttaaagaaccggcaccgacgcgcaaagtagacagcgcccgttcccaaccggtcgtagcccttgccccctttaaccggacggtggtcaggctgatgtggctcaccgccatgctgctggtgtttgccaacatgtcgatcgagccggtgattaccttgtatatcggtcagtttttacatcaggatcatgccatcacgctgatgtcgggcctggtgatggccgcggcggcactgggcagcattatttcggcaccttataccggtaagctggctgaccgcattgggcactggcgggtattacgcgcgggtctgcttggctgcgcgctgttactgatccctcaggcttttattaccgatgcctggcaactcctgccgctgcgcttcctgatggggatcgcgttgggcggtctgatgccctgcatcaccgctattatccgccaccatgttcccgccacccaggtggggcgcatgctcggctattcgacatcggcgcagtatatcgggcaggtgagtggtccgctgtttggtgggatcatcggcggggcatggggaatgcggcccgtgtttctggcgacttgtgtggtgatggggttatgcgcctggctgaaccagcgacaggcaaaaggaaaaggggcaggtggatagcaggcataaaaaaaggcggaccggagtccgcctctgtacaggggttagttacttctggtcgggcagcgcataggcaatcacgtaatcacccagcttggtaccaaatgaaccatgaccaccggcagcaatcaccacgtattgcttgccgttgacttcatacgtcatcggtgttgcctgaccaccggctggcaggcgcgcctgccacagaagctcaccggtatcagtgctgtaggcacgcaggtagttatccgcggttgcgccaataaagaacactttacccgccgtggcgaccggaccgcccagcattggcatgcccattttaaatggcagcggcagcggcgagctgtcacgaacggtaccaatacgttgcttccagaccacttcgttcgttttcaggtcaaccgccgaaacataaccccaggcaggctgtttacacggcagaccgaacggtgacaggaacggattcagttcaacgccatagggcacgccgtactgcggctggataccggtttcggtacctgaaccgccagaagcgccttcttgtggctcttctggattacccggaccgcgtggaatcagcttcgacacgaacggcagcgccattgggtttgcaatcgcaatctgacgatgtggatcaaccgaaatgccgccccactcaaacatgcccaggttgcctgggaaaaccagggtgccctgttcagacggtggggtgaacggaccttcatagcgcagacgcttaaagatcacgcggcacaccagctggtcatacattgtcgcgccccacatgtccttgtccgtcaggttttgcttcggacggaaggtcagttcagagtaaggctgagtcgcggctacatggtcgcctttagcggcaccctggggtacaggggtttccggggcgggcaccacggttttacccgtacggcgatccagaacaaaaatgttccctgttttggcgggagcatagataaccggaaccgttttaccgtctttatcggtaatgtcggccagcgtcggctgcgagggcagatccatatcccacaggtcgtggtggacggtctgatacgaccagaccagcttaccggtggtcgcgttcagcgccagcacgctactggcataacgttcctgctctggggtgcggttgccgccccagatatcgggcgtggtcacacccatgggcaggtaaacaatatccagcttcggatcgtaaaccgcaggtgcccatgagttaggtgagttcatggtgaacgtatgctcatccgccggaatcgcattaggatctttcgcgcccggatcgaacacccacagcagcttaccggtgttcacatcaaagccacggatagcgcctgagggttcacgggtcgagtagttgtcggtgacggcaccggccatcacaatggtggtgtcggtgataaccggcggcgaggttggctcatactggcctggcgtagtgaccggctgctgatgctgaagatccagctcaccgttattaccaaaggccggacagcgttcaccggtgtccgcgtccagcgcaaacagacgaccatcattgacaggcaaatagatacgacgcgagcacagcgctggctgagtattggacgcatccttcgctgccgggaactcgtgataggacacgccacgacaggtcacatgctggaaggtaggattggttttcaggccgggatcaaacttccatttttgcttaccggttgccgcatccagcgcgaacaaaatctggtgcggtgagcaaagataaagcgtatcgcgaatcttgattggcgtcacttcatcggtgatttcacccggatcgctaggttttttcagatcgccggtctggaactgccaggccacctgcaattctttcacattgtcatgattgatctgcttgagcggcgagtagcgcgtaccttgctgatcgcgcgcataagccggccagtcagcatcggcaatgttgctcaacggctgggcctgaggggcattatcggccgtcgcaggcactgcaccattcaccacttgcgggtcattaaagacggcataggttagcacggctgcactggcaatcagggcgatgcccatggcacccaacgcacctttacctgggctatataagctccgatagacaaagggcaagactaaccagacaccaaagatcaccaggacatcggtacgcggtgccagcgcccagaaatcggtaccgacttcccacacgctccataccagcgttgccagcagtaaaagtgcatacaccagcagggcagcactgttacgccgccagagcagaaaagcggtaagcagcatggctgcaccgccaatgatgtagtaccaggaaccaccgatcgtggctaaccagataccaccaattaacatgaacgcacccgttagcacggcgaacagcaccgttaaaaaacggaccacgctaaaggatgaggagtttttccccataatgttgacctcatttcgttgccataaaacacaagaaaacaatcagatagattgttatcagtcataaagtacaaaagatgaaaggtatgcttatttcgctcttccgtgacgcttgatgatccatatctgttaaatgttatagcaaaactggtatgagttttgatttttttggcttaaagctcttaacaagagacctcaggcaacactttagacggagttaatggttcttgccgatatgattcaatagtaccaggggataagaaaggttaaagcgtaaagggaatgagatcgcctgatgcacgttgtaattgccagccacaaatgtttaatgccgcgagttgttctgctgttaacgtcggttcatatccccgcacgattatcctggcaccttttccacgtagtgattcaataaaaaaaggaaaggtgaatttccgatagttgtcattaaagaatgtatgacttaagacaattgcagaaaaaggaaaggattccaccaaatgacagtctgcaccaggcggtgcaaaatcaaaaagccagaaacgataagcgttagttaattccagtaatttttcctgatgagtcttcaggttgcgataattaataccgatacgcacccgcgcatcctgcaaatgtaaataacgcccggggtgataaatccattcttctaactgtgaatcacaaaggggaataatgattaatgccgcttcagtcgcaaggtggttgtgtaatgaaataatgttgtcatcgttaagtatccattgcgcaggctgcgggtagtcagaattaggaagatggtagcaaataccggccacctgactcgtgacgtggtgaataggctcagtaatataggggttatataagctatttttcattatctcatcgaaactatttaacgtttgctgtgatttatattctttgcataaccagaggaaagtccggcgattaatatacgcgattctcctggcaatacacgttttttatatattaatcagcgcttttttctcacccgttatttaaatttatatgcactctaatgataacgttgaatggtcttttctaacgtgattacccgatggaactgttaattaatcacacaggatgtttctgctaaaaacctgtaataaacgcgacaagatgaccagcagaaacggccatttttctgcttcatttaccgtttcgtttacggctttatcttatcctgagtaaacttatcagcagagctgacggtttttttaatacgtcccacgccgtcatcatcatgaaaagaagccggtgtagcgcacctgatgcagggggaacggcggtcatcaaggtggaaggcggggtaaaaagaaagaataaaaaaaccggcctgaggccggtttaagtaaggtgccagtcagtcgagctatgaataacctgatggtctcgggggagtgagatatcaagagggaactagtgggttcccgtttttcccaggttggcgtcaaaacgtttccagctttcggtcagatcaacgacgctgcgggttttacgcgcttcatcaatcttaatcgccgtcaggccggcttccagtgcgtcaacgacggagacttttagcggcgttccctgcttgatgtgcttaacgatctcttctgccatcaaggcatcggcaccgtaatggccgtcgtaggcattgccgctgtaggcggtttccacctctttttcaccggtgcgtgcgttgtgcacgcgaaaatagttacgtacaaaatcaccttccgccatgccgtcagtgcctatcacgcagaaccggcggaattcgtccggtacattaaggttggcgtgaaaagagagcgttgcgccactggcatattcaatcagggcggtctggtaatcgacaatatctgcatcgctgctaaataccgcgtcggtactcgaccagccgctgggcttagtgtggtaaatctcagactgctcggttatcgccccttgcggtgcatgctgaggcgtaaaggatttgcgtccgccaaagctggccacccgaacggggcgctcctgcattaatccctggtagagatcgatgtcgtgacagcatttttccagaatataaggaccggcatatttttcgagtctgcgccagtcgcgctggaagaacgcgccatgataaggcttgatatgttctgtcgcttcaatcgaggtgatttcacccaggcgacgatcgtcacgtgcagccagcaggtcgtgatagagcggtgagtaacgcagcaccagtccaaccagaatacggtcttcgccatattgctgaaccagttttgccatcgccatcgtttgttcttcgttaatcacgacaggcttttcagtaaacacagtatagcctgctgccagcgcctgtgtgacatgctcaagatgcataaagttaggcgagccaaccagcagcaaatcaaagccaccgtgttgcagcagcgcctcaacggaatcgaatgcgttgccgggatcgataccgaaactgtgcagattcggcaaaccggccggtgctggatcgtaataccctaccagcgaaaattcggtatcagctttgtgaaactctttaacaacgtgagaaagacgaaagccgagaccaataatgcctactttcatggtaaacccctgatcctgaattctgacaacggtgagtacgccgctgacgggacgtaatgattgaaagactggctaccaacttattacgacggaaaaactaatgtcaataacgggttgtgtgatttgcgtacgtctttttgtttatttcattgattttaaataataaatagttattgttttttccctatatttatttgttattgcgatttaagtttttttcacctatcgttcgcagattacagaatcgagatgagttacggcgggaggaagcgcgtgcaatcacactatctccttggcattgatggcggcggcacgcagtgtcgcgcccgcttgaccgacagtcatggcaacgtgctggcgcaggccgttggcggccccgccaacgtctggtcacagtttgatgctgctctgaattgcgttgaacagctcattgccgcagtgctgtctcaggcggggctggcgtcacaggcgctgacgcagacctcgctggtggcagggttagcgggggcgaatgtggcctcggttaaggcgcgcctgacgcaatggcagcccgcctgcgcggcatgtcaggtggtcagcgatgtcgagatcgcctgtgccggtgcgcatgcggcggcccccggcgcggtctttattatcggcaccggtagccagggcgctgcgtgggacggcgagcacttcacgctgctgggtggctgggggttcgcactgtccgatcaaggctcaggggcagaactggggcgacgggcgctacggctggcattgctggctcatgaagcgattatcgacagcacggacttcacccatagcctgatggcgcagtttaaccatagcccggaaaccatgttgttgtggacgcgagatgccatgccagccgactgggcgcgcgtggtgcctgagatttttgccgccgcgcaggcggacgatcggcatgctattgatttactgcgtcaaactgcgaacgatattggcttaatggtgagtcgtctctccgcgattagccagggccgggtggccctcatgggtggcctggcggcaccgattcagccctggctggcaagggatattcatgcccggctggtcgccgcgcaatacgatgccctggacggggcattaatgatggcacggtcaaatctgaggactttatgatcgctccaaacgtcaccgcgcgcattctgagactgattgtggaacatgcgcctgttagccagtccgacctgaaggtccgtagcgggctaagcatgtcgaccgtttctcaggcgactaatcgcctgctggcgcagggaatcgtgcaggaactgggattgcgccgggtgtcgatggggcggcctaaaaccctgctggggctcaatcctgaccgcgccagcgtcattggtattcagcttaacgccgaacgtaacctgattgtgatgacagacctcagcggcaatttgctgggtgaacagcagatgccttcgggcgcgatcacgccacgtcagctgggcgatgcgctggccaaatttttacgcggcgttgaagagaagcacgtgggggcgatcggcctggccttatccggtttagtcgatgccgaaaacggctactgtattcgttccaaggtgctggactgggagaatgtccctatcgcgcagatgctggaaacgcgcttttccctgccggtgtttatcgaaaatgatgccaacgccatggcgatggcgacgctggtgtttggccagttgggcaacgcacagtcggcggtcatcgccacctacggtaaaggcatcggcgcaggcattattcttaaccgtcggctctatcgcgggcggcacggcaaagccggtgagatcggtaacggtctggtcggtgatgggtcgctgcggctgcttgaagatgtggcatcgtcccaggctatcttgcagcgtgtctcccaggatgacgcggacggcccgttaaccttgcgggcgctggatcagtggcccacagccgaggtgctgaccgcactggaagaggccggacgtgaactgggtatttcgctggccaacctgtcggtggcctacgatcccgatgtggtgtatctggcgatggagccgcatatggcttcgcgtattctgctggaccacatcacccagagttttcaggcttaccgcctgaagctcactccccatatgacaccgctacagtttctgacggaatcaaaccgcatgtgggcgctgggcgcggcaggctttgccgtcaatatgctgctcgatctgctggcggctcaggcagacgaagagcccgtgacctgaaggcgccgaagcgccatccggtttaacgcagacgctgcccctgctcatcaaacagcaggcagtggtctgccgacagtcccagcctgacctccacgcctaaatcccgccgttgtgcctcgcgcgcctcgacaaccaacatctgctcaatgcccacatccagataaagataattggtatgccccagcatttcggcaaaggacagcgtaccgctaaactgcagcgctggcggcgtactggcggcgggctgcatgtgctccgggcgaatgcccagggttacgcgctggccttcacggcagggcgcagcaatcttcagcaccagttgcgacatcttcaggtccggcacacgtagctggacttctccctgaccggtggcggtgacctcggcatggaggaaattcatcttcggcgagccaataaaaccggccacaaacaggttgtccggatcgctgtagaggtctaacggcgcgccaacctgttcgattcgccctttacgcaggaccacgatccgatcggcaagcgtcatcgcctctgactggtcatgggtaacataaatcatggtgttgcccagcgaggcgtgcaggcgggcaatctcgatgcgcatttgcagacgaagctcggcatccaggttggagagcggctcatcaaacagaaagatgcgcggatggcggataatggcccgaccaatcgccacgcgctggcgttgaccaccggaaagcgcacgcggcaggcgatccaacagttcggtcagatgtaaccgcgccgcggtgtgttcgatggcctgagcaatctctgctttagactttttcatgacttcaagcgggtaagccagattgccacgcaccgtcatattgggataaagcgcataagactgaaagaccatggcgatgccgcgttcggtcgcgggctgctgggtcatgtctttgtcttctatcaacaattttccgtcagtgatttcttccagcccggcgatcatccgcagcagggtcgatttaccgcagccggatggccccacgaacaccacaaattcgccgctgtttatcgtcagatcgacgccgtgaatcacatcgatatggtcataggacttcttaacattctgcaagcgcaggctggtcataaactccctcactcaaagtaactggcccatataaatggcgttgctgcgcaggatgtggctgaatcccatgcgttgataaaaagcgcaaacctgttcattttgcaggctgacgccaagatggacgccttttatgccggcttgccgcagcgcagccagttcatgcgcgatcatcttgcggccccagccgccctgttgtaccggcggcagcagattgatatgcaaatgggcgggccactgcgccactaactgcgcatcggcacgatcgggttgacgaatgctgtcgaggattttgctgtcatatggggcgctggctgtgcgatcgcggtatttatcctgaagctgaggccaccagtggtgctcaagctgcgcttcaaaggcgcgggtatctggcgcggcgacgacatagcccatcacctcaccctctacctccagcacaaaagcaaaatccggcgcaaaacgggcatagggcaccgcaaaacgctgcccgggatactcgggatcggaatagtggttacgggcatccttaccggcattggcggtttccagacagatgcggtaaagcgctggatagtccgactcggtggccggacgaatgacaccttgattcgccatcgtcatctctcacaggtcagtagttgaacaacctcacggtaatgaaagctgacttagttttcaagatggaataattaccctgttatcccaaacctgcatctgcattggcattaatggctgaccagaccagtctctgtgggcttctgtggcgggcagcagcctgcctgtcaggaattggcagggtaaataaaaagttaaaaatgtgagcgtcataggattttcatattttttatcagcaagttattacgccactttaggcgtggtttatcctgctgtctggaggcgaacgggcacggataatgcgctaaatccaccttgattagcccgtgcttatgctgactgcaggcccgccattgtgtttttttgcgcaggctcacaacctggtaattcactccgtgggatgtttgactttatttttttattaaagtaactatgagtgagaaggtgatttatgcggctacagtctgcaggattgcagaccctgtgaagaaaggatgtccatcctgtattggagaaagtgagcatgatgtctgattcctcagttcgttcgttccgttttcgcacttcggttcgtagcctgttggcggcgggcttgctgatgggcagcgttgctcatgccgacagcaccgtcactctgaatgagtgggatatctacagttatcctcagcaaacggcggccgttgacgaaggcattaaagccttttcccagcaaaaccccggtatcgtcatcaaccggtccgtgcactcctttgaagacacgcgcattccgttgaagctggccctgaccgccggtgaaggtccgcagattgcccaggtgaatcagggcggcggcgatatgggttcgctggtcaaagacaaactgctgttgccgctggacagctatgcagccgaatatggctgggcccaaaaattcccggactcgattctcaaacgcaaccgctggtctgacagtggccagtttggtagtggcaagctgtacggtgtggccagtcttggtgagatggtcggcctgtactacaacaaggcgctgctggataaagccggtattgcagtaccgaaaaccctgagcgaactggacgccgcgatggcaaaactcaaacagcaaggcactgcgccgatgatgctgggtttgttagacggcaatatgggacagcagctgctcagtacactgtgggaagcacaaattgaaagcagtgaccgcaaaaaactggatgatttgatttacgacgtaggcggcaccttcaaagatgaaaaactgacgaaagccgccacgatgatgaaaagctgggctgacaaaggttacctgttcccgggctatcagggcattggccatgatgatgccgcgacgctgttccagaacggacagtctgcgttcctggtcagtggaacctggtatctgggtcagtttaaagacaacaaagatatccattttgccgcgatgccagccggtgacggcgttaaacagccgttaatggtcggcggtaccgatttggccttctcgatgaccagcatggcgaaaagcaaagcgcagcaggatgccgccgccaaatttatcaactatatggtgtcagacagcatggcaaaccggtggctgaacgtcggtttcctgccagccagcaccaataaaaacgcaaaaattccggcggataacccactgttgggcgaagcctggcaggtgtggctggcgctcaatgcctatgatggcctgggccactacgtcgactgggcaaccccgaccatgaacgccgaactgaatcaaaacgttcagctgttactggcgggccgacagacggcagagcagatggttattaacttcgataacaactaccagcgttatatgaaaaccctgaaacactaagccgatcgcccggcagcgaacctgccgggcctgaatgtcgatctcactacgacgagtacggttatgttgaatcaaagcagttggcgtaattttctctatcttcttcccgcagtgctggtttatgggctgtttctgctgttgccgctgctggcttcactggggatcagctttaccgagtgggatggaacctccctgccggttttcgcgggcgtcagtaactacctgcgcatgttcagcgatccggtcttctggattgcccttggtaataacgccatcctgatgctgttttatacgctgctgcccatcagcgtggggctgctgctgtgcagctttctgtatgacacgcgtaacaataccgaacgcagcgtactgcgcatcctgttcttcctgccctatatcatgccgatggcggttctgggcgtggtctggcgctggctgtataacccggcctttggccccatcgatcagttcctgcgtgccgttggattgccacagctggcgatgtcctggctcggtgattttacctgggcactgccggccgtcggcatggtcgccacctggtacttttttggtttctgtctggtgctgtttatggcgggcctgcaacgcatggacccgtccctgcttgaagcggccgatctggatggttcctcgcgtcgccagaagtttatgcgcattacgctgccgggactgcgtcctgagttgcgcatcgcgctgttgctgacggtgatcgccagtctgaaggccttcgatctggtgtatgtcatgacgcagggcgggcccggcacatccaccatggtgaccaacatctttatgtacaagcagggttttgatctgcactacttcggctatgcctcatcggttgccgtgttcagtatggtgattgtgttagggattaactacctgattcatctggcattgaaggaacattactgatgaaaagcaccccgatcctttcccgtgcgctgatctggatagtggcgctgatgaccatcatgccgtttttgatggcgtttatgacctcgtttaaaacccagatggagctgtttcagggcgtctttcatttgcccgcctcactgaatgtgaaaaactacatcaccgcctggcagcaggggcactttaacgtttacttcatgaactcggtgctggtggtgttcccggtggtgctgtgcagtattttgctgggtattctggccggatttggctttgccctactgaagattcctggcaaaaaagtagtggcgggcatgctggcgctgggcatggtgctgccgagtgaagcctttattattccgctctatcacgaactgcactggatggggctgaccaatacctatctggccctgattctgccgcaaatcgcgctgtcgctgccgtttaccacgttgatgattgccagcgcttttcagcaggtccccaaagagctggtggaagccgcggtgatggatggcgcgccgcgtgtcaaaatcctctggggtattttagtcccggcgatttggcctacgatctcgacgctggcgctgctgctgtttatctggacgtggaacgaattcctgattccgctgattctggttaacaaagatgagctgagaaccctgcccattggcatgatgttttttcagaacaaaaacaccattgatataccggtactgatggcaggcgcgatgatcgtcattatgccgcttatcgtggtcttcctgtttttccagcgtaagtttatcagtggcgtaacggaaggtgcggtgaagtaaacccacccggtaattcctctttaactaaggctggatgatgcatctttcccttgccgactttcaccccgtagcggacggtgaaaccccggatacgcgtgttctgcaacgggcgattgatcagattgctgcggctggcggtgggcgacttacgctgccgcctggccgttatcgcagcggcagtctgcaccttccttctgatttcgacctgcaccttgaagccggtgcggtcctgattgccagccgtcatctggctgactatcaacagtgcaaaacgctcagctgtgcagaaaaatcccacaatgtcctgctgtatgccctggggcagcgtaacctgacggtgagtggtaaaggccgtattgaaggggacgccgaagcgtggtttgcggtggaccctgacgaacagggctaccgggtgccaaaacccgacaggccgcgcatgattgtgtttgaagattgcgagcaggttacgctgaaggacatcagcgttatccatgcgccgatgtggacggtgcatcttgtcagttgccgccatgtgcacattgaccatttgaccatcgataacgccatgacgctgcccaacaccgatgcactggatatcgacagctgcgaggcggtttttatcagcaacagctacttcagtgccgccgatgacgcgatttgcatcaaaaccacctttaagcctgcaggcctgcgccgaccggcccgacggatagcggtcagcaactgcctgctacgcagcgacagttgtgcctttaagattggtacggaaacctgggacgatattgaagacatcaccgtttcaggctgtaccctgtttgattccaaccgcggtattggcattgtgtcacgcgatggtggggcgattcggcgcgtgctgttcagcgctatcacctttaactgtcaccatgttgccgcctgccactggggcaaagccgatccgctgtttatctcggtgcgcacccgtgatccgctggtgccgccagggatcgttgaacagatccagtttactcatctcagcggtgtggcagagggcgcgatcaacctgcatgcggcgcagcccggctggatacgtgatatcactatcaaccatttacagctgcgacaaggtgtagcgcagggcgtgcagggacagtacgatgtgcgtccgccctgtaacccggattccccgacggggatggggctggataacgcttaccggctggataaaaccaccggcgacgcttacggtgttgagcgctatcccggcggcctgccgggactgtttgcacgaggcgtagagaacctgcagttaaacaacctgacgattcagcggcctgagccgctgccgtcaggctggcatccggacagcgtcgtgcagctggcagagtaagttacagcgccgccgcgatcgcggcacccaactgctgcgtgtcggcgctgccaccgaggtcgcgggttaaatgctcaccggcggccagggtacgctcaatggcattcagcacagcatcaccggcctctttgtagccgagatgctccagcatcatggcaccacaccaaatctgtccaatcgggttggcgatatttttaccggcaatatcgggcgcggagccgtgtacgggttcaaacaggctcgggaatttgccttccggattgatattggcggaaggggcgatgccgatggtgccggtacaggccgggcctaaatccgacaggatatcgccgaacaaattgctggcgaccaccacatcaaaccagtcgggatgcaggacaaaattggcggtaagaatatcaatatgatacttatcgacccggatatcaggataatgctcacccatcgcctgaacgcggttgtcccaatacggcatggtaatcgcgataccgttcgacttggtggcagacgtcaggtgttttttgggccgacgctgggcaagctcgaaggcaaacttcaaaatacgatcgacgcccacgcgggtcatgacggtttcctgaatgaccacttcccgctctgtgccggggaacatggtgccgccgacgctggagtactcgccttcggtgttttcgcgcaccacatagaagtcgatatcgcccggtttacgattagctaacggcgctttaacaccgggcatcaggcgcaccggacgcaggttaacgtactgatcaaactcacgacgaaactgcaatagcgatccccacagcgaaacatgatccggcaccacatcaggccagcctaccgcgccaaaatagatcgcatcgaacgttttcagctcagcaaaccagtcatccggcaacattttgccatgctgttgccagtaatcggcgctggcataatcgaaccactcccagcgcagcggaatgttgaatttttcggccgccgcgttcatcacgcgcacgccttctggcatcacttctttgccaataccgtcaccggggatcacggcaatacgatggatcttctctgtcacagggcacctctgaggttggtcgggttggcccgccgggtttcggtatgctgtctttatgcagcttgatttatagccgggcgttagcgcagtataactctccacctgaggtaaacaattggcctgaaagttaatcccatgttaaatcaaagtagagaatcacgaacctcaagcgacgatttagcgttttttctgcgcgtggcatctttggacagtttaacagcggcggcgcgggagctggggctttctctggcggccgtcagcaaacgcctgagcctgctggaacagcggctcggtgtccagttgctgcgccgcaccacgcgcaagctggaactgacgccggaaggccgccgttacctggaaggtgcccgtccgctgctggagcaactggtggcgctggaagacgcagtcagtggtgaaacggcccagctacgcggcacgctgaatatcaatgcctctttcggctttggtcgccgtcatatcgcgccctgcgtttctgcctttgctgccctgcatcctcatctggcgctttccctgcagctgagcagtcagccgctgaattttcttgatgctcatgtggatatcgacattcgcgtcggcgaaccgccggattcgcggctggtcgcgcgcaagctggtgcagaacccacgtgtactttgctgctcgccggcttacgcggcaaaacacgggctgccggacagcatccgggcgctggcgcagcataactgcattttgctgagacagcatgacagcgacttcgccctgtggcgctttgtcagcgatgcagagagcctgagccagaaagtgcgcggaaacctggtgaccaacgatggcgaagtggcgatgcgcatggcactggatggtcatggcattttgctgcgctcctggtgggatgcgaaacacagcatcggcgcaggggcgttactgcacgtgctgccggaatggcgctcgccggacggcgatatttatgcggtctggcaggcgcagcgtcagcaaccggcccgcatgatggcgtttgtcacctttctgcaggaaaacctgcagcttgataccgcatcaaccaacctgtgatggttcgcacaaatcctccacgtaaaacatcaccatcagtaaagtattttgacgctttgtcgatagcgatctgaggtgtctgcgcccgttgcgccgaccataattgcccgcgtttccgtccggaggcgcggtttaacctctggtggaagcgtagcatggataaaaaccgatcacgcgcgggggagggcgtttcgctccagcgtattgcacagcaggccgatcggctgatggtggtgctgtgttggatattgttggtgatttccgtcattgtgggcagcctttatcaggcaaccctgctggcggtcatcgtgggggctggcctggccctggtcgccacgctggtgggatggctggcgaatggcacgctgttttcacgattatggctggccttcacgctcatcggtttcgcgggcttactgattcagttgggccagggggaaaccgaatttcacttctcggtgtttgtcttgttgtcagtgctgctggtttatcgcgacagcagaccgctactgatggccgccgcgacaggtgcagtgcatcatctgctgttcaactatctgcaggaaaacgatcggtttggcatcgtggtctttcatcatcccggcctgaatatggtgttattccacgggttgttcgtggtggtacaaaccgcgatgctggtggtgattgcgcgtcagatggcggcagacatgcgttcggcgagcgaggtcgcccaactggccgcctggatcaaccgtgaaccgggttgcctgacgctgtcggcggatacgcagcagagtcaaacgccgttcgctaaaaccttcagccagacgctcggcaccatgcgcggtacgctaaatcaggtcagccacggcgtctccgcactgctgcaggaatccgacagcatgctgtcgcgcaacgccgccctgtcgcagcgcaccgacgagcaggcgcaggcgctgggcgttgccactgcggcaatgtcgcaaatcagcgtcgccgccagtcatacgcgggataaagcgcaaacggcctgcgaactggcccgtgaaacctgtcaggttacccgtcagggacaacacaatattcagcaggccatggcctccatggcgcaaattaacgtggagtcggggcgggtcaaaaccattcttgagctgatcgacggcatcgcgttccagaccaatatcctgtccctgaatgcctcggtggaagccgcccgcgccgggcaggaaggccgtggctttgccgtggtcgccaacgaagtacgcaccctggcgcaacggtgtgaaaatgccgcccgtgatattcgccagctcatggatatgtccagttccagtgccgagcagggcaccgtacaggttgatcaggccgcccagaccatgcaggccattctcgtcagtatcgacagcctttcccggcttgtgaacgagctgtcggagatgagcgtgcagcagaatcagagtatcgaacagattcagcacagcattaacagcattgacgacagcgtgcatcacaacgttaaacacgtgacggaaacgcttcaggtggcacagcaacagcgtcagcaggccagcgcattacagcaggctatctcactgttccgttttagttaagcggggcaggcagaaacgcggtcgtgggggcgcgcggctgagggcacaggtgcaaacccggccattgccgcgcagagtggcgcgggcccgtcactgacgtcgtattgagccgccgtaaatcagcaggccagccagcttcacgggctggcctgctggacgacggctgttttcagggcaaacggttattcgacgcctttcaccagcagaacacggtaattagcgcctttcaggcggtgctgtttcgcctcctgatattctggactgtcataccaggcgtgggcggcgtcggtgcttgggaattcgataatcaccacaccttccgcttcaggcccttccagggtttccagctcgccataaaaggctaaaggcttgatgggatggttgccatgggccttacccgctttctcagcgtagatggccatttcatcctgattcagggtattgtcacgaataaatacaacgtaagcgctcaacgtgtttctcctcaggcttttttatcttgggtttgtgtatcaaagtccgatgcgtcatgacgctcgcgcagctgatcggctggctcgcccattacacggtttactttgcggccgcgtacaacggccggacgctgggcgatctctttggcccagcgcaccacatttttgtaggactgaaggtcaaggaactctgccgcattgtactggttgtagagcaccatgctgccgtaccacggccaggttgcgatatccgcgatagtgtaatcatcgcctgccagataacggttgtcagcgagctggcgatccagcacgtcaaactgacgcttcgcttccagcgagaagcggttgatcgcgtattcaatcttttccggtgcgtagtgatagaagtggccaaagccgccgccaaggtaaggggcagagccttgcagccagaacagccagttcagcgtttcggtacgttgagccggatctctcggcaggaaataaccatatttttccgccagatagagcaggatgttgccggattcaaatacgcgaatgggcggggtagcggaatgatcgcacagtgccgggattttggagttggggttgatctcaacaaaaccgctggtgaactggtcaccttcaccaatattgattaaccaggcatcgtactctgcatcgttcacgttcagcgccagcaactcttccagcagaatcgtcactttctggccgttaggtgtgccaagagagtagagctgcaacggatgcttacccactggcagggctttttcatgggtagggcccgcggtaggacggtttgtgctggcaccattacctttcgcttccgggtcccacttccagactttagcgggctgatagtgttgttcagacatgatgaggttcgccttttttgtgtttggagttttcacgagtgtagcagttgccagcgcgccggtttaaccctgatggcggtgactttgtatcgctttactaccgtgctacagacagctttaccgctttttgacgtgcattttcctggcgcaaatcacattcattacgcctgagcgttgctatgctaaaacggtttagtaaacttttagctgcatctgagtagggagaataatatgtcagcgcgagtctggtgtctgggtgacgccgtggtggatctgcttccggacgggccggggcatttaatacagtgtgccggtggggcgccggcgaatgtggcggtcgggattgcccgtttgcagggcagtagcggttttattggccgggtaggggacgatccttttggtcactttatgcaacatacgctggcgactgagcaggttgatacccgctatatgacgctcgacagcgcccagcgtacctcaacggtggtggtggcgctggatcatgaaggtgagcggacttttacctttatggtacggcccagcgcagatctgtttctggaagacggcgatctccccacctttcagccgggtgaatggcttcactgctgctcgattgccctggcggcggaaccctcgcgttcaaccactttttctgccatgcagcagataagtgatgccggcggttttgtcagctttgatcccaatattcgtcacgatctgtggcgtgacgacgtccagttacgggactgtgtgaaccgggcgttgcagctggctgatgtggtcaagctgtctgaggaagagctggtgtttctgacccaggatgcgccaggcgatgacagtatgcaggcgctggctgaacgctttgcgattccgctactgatggttacccagggcaaagccggggtaaaagtctggcatcaagggcagcattatcactatcccacgctgcctgtagtcagcgtagataccaccggcgcaggggatgcgtttgtcgccgggctgctgtggggcctggcggaaaaaggaatgccagccaatgaggctgaactggcggcacggctcagcagcgcccagcagtgcggcgcgctggcgaccacggcgaaaggggccatgacggcgctgccttatcgtcatcaaattgaaggataattagtcgataacaccgcgattcatggacgaaccgccatcgcccgcatcaggtcagcctgcgggcggtgccccggtcagcgtcaacggatcgcgcgacaaagacattaacgggccaaccattcaggtggctatgcagcctgtcgcgtcaggctgcggttaaccaatcggcccttgcatttgctgaatcactggccgctggcgataggcagcgttaaggctgggattgccagtgccagtgccagtgccagtgccagggttcgcccctttgcctgttgcaggccgccaggtgcccacggcgcagcgcgcccggttttaaccgctgtcagtctgtttccccgcccatttttggccgcccccgcttgtggacggcccgtgctgtccggttccgcaaggacagcgacacggatcataaacttcatcgccagtcacgctttgctgtgaggcagttcactcattcgcccttccttgctttacatccccatcccggcctcgtaatgtcagcttaatgtgagcggataacaattttacgcaggagactgccatgaccctggatacacattcactagcggccgtactggcccggcgcgactgggaaaaccccggcgtcaccgaactgaaccgactggacgcccatcccccactttacagctggcgcagcgcggaagcggcgcacgagaatgcacaatccgcgcagcgaaaaagcctgagcggcgaatggaaatttgccttttttcctgcgcccgaggcggtgcccgacagctggcgcacccacgacctgagcgatgcggtcactctcgccgtgccgtcagtctggcagatgcagggctacgatgtgccggtttataccaatgtgacctatcccattccggttgatccgccgcgcgttccggctgaaaatcccacaggatgttattcgctcacatttaatgtcgatgctgactggctgcaaagcgggcaaacccgaatcgtgtttgacggcgtgaattccgccttctatctctggtgcaacggacgctgggtgggatacggccaggacagccgcttgccatctgagttcgatctgagcgagtttctgatcggcggtgaaaaccgactggccgttatggtgttgcgctggagcgatggcagctacctggaagaccaggatatgtggcgcatgagtggcatttttcgcgatgtctccctgctgcataagcccgccagccatatccgcgacctgcgcattcgtacccactttaacgacgatttcagtcgtgcccggctggaagccgaggtgcgcgtagccggggcgctggatgacgacttacgggttagcgtgcagctcttcgcggctgaccaactgaccggcgaagcgacctcgccactgggcagtgcaattattgacgaacgcggcgcgtggaacgaccgggccacgctgtgtatcaaggtcgataaccccgcgctgtggagcgccgaaaccccgcatctctatcgggctgttgtgcagttacatcgggcagacggcacgttgattgaggcggaagcctgtgacgtaggatttcgtcacgtcagcattgaaaacggcctgctgttgctgaacggtcagccattgttaattcgcggcaccaaccggcatgaacaccatcctgaacgcggtcaggtgatggatcgcgacaccatggtgcaggacattttgctgatgaagcaaaacaacttcaacgcggtgcgttgctcccattatcctaacgatcccttgtggtatcgcctgtgtgactattatggcttgtacgtagtcgatgaagccaatatcgaaacccacggcatggtgccgatgaatcgtctgagcgacgatcccacctggctgcctgcgatgagccagcgcgtcacgcgtatggtgcagcgcgatcgtaatcatccctgcattattatctggtcactgggtaacgagtcgggccacggcgcgaaccacgatgcgctgtaccgctggctgaaaagcgaagatccgtcccgtccggtacagtacgaaggcggcggcgcgaatacggcggccaccgatattatctgcccgatgtatgcgcgggtcgatcaggatcaacctttcccggccgtgccgaaatggtccattaaaaaatggctgtctatgccgggcgaacagcgtccgcttattctctgtgaatacgcccatgctatggggaacagccttggcggctatgcaaaatactggcaggcatttcgtcagtatccgcgtctgcagggcggttttgtctgggactgggtcgatcagtcattgattaaacatgacgataacggcgaaccctggtccgcttacggtggcgattttggcgatacgccaaacgatcgtcagttctgtatgaacggactggtttttgccgatcgtacgccccatccttcgctttatgaagcccgtcacgcacagcagtttttccagttcagactgctagcgggcagcgaacgcacgctggaagtgaccagtgaatacctgttccgtcacagcgataatgaaatcctgcactggtcggttgcccaggacggcaatctgctggcctccggtgacgtcacgctggatatcgccccgcagggcagccagcagatcaggctaccggacgtgccgctgcctgcatccgcaggccagctctggctgacggtgcgggtggcgcagcctcagccgaccgcctggtcagaagccggtcatatcagcgcctggcagcagtggccgctggacgaaattctgagcatcgccgtaccctctccggcggcgaacgcgcctcaactcagcagcagcgaagccagctacagcattgtggtcaacaaccagcgctgggaattctgccgtcatcagggcgcactgatgcagtactggattgacgataagccgcagttactgacaccgctgctcgaccagttcacccgcgcgccgctggataacgatatcggtgtcagcgaagtcacccgcatcgatcccaatgcctgggtagagcgctggaaagcggcgggccactatcaggcagaggtgatgaacctgcagtgcagtgctgaaacgctctccagtgcggtcgtgatcaccaccgcccatgcctggcagttccagggcaaaaccctgtttatcagccgtaaaacctaccgcattgatggatttggcgagatggcggtaacggtcaatgtggaggtggcgagtggcacgccttatccggcccgcatcggtatgagttgtcagctgaccgagattgccgaccgggtgaactggttaggcctgggaccgcatgaaaactacccggatcgcctgacctcggcctgctttgatcgttgggatttaccgctgagtgagatgtacaccccgtatgtcttccccaccgagaacgggctgcgctgtggcacgcgagaactcagctatggcgcgcatcagtggcgcggcaacttccagttcaacatcagtcgctacagtcagaaacagctgatggaaaccagccatcgccacctgttacagcctgaagcgggcacgtggctcaatcttgatggcttccatatgggcgtcggcggagatgattcctggagcccgtcggtatcaccagaattcctgctcagcgcaggacgttatagctaccagtttatctgggggcagcaaaaataatgcgcgggcaggctcgcgcctgcctgatgcttgcttgaggacgtccgttatgtactatttaaaaaattcgaatttttggctgtttggttttttcttcttcttttactttttcatcatgggtgcctatttcccgttcttccctatctggttgcatgatatcaaccacatcagcaaaggggataccggcattatttttgccagtatttcgctgttttctctgctgtttcagccgctgtttggcctgttgtccgataagcttggcctgcgcaaacacctgctgtgggtgatcaccggcatgctggtgatgttcgcccctttctttatttacgtttttggcccgctgttgcaggtgaatattctggcaggttcgattgttggcggtatttacctgggctttatctacaacgccggggcaccggcaattgaagcctatattgagaaagtcagtcgccgcagcaactttgaatttggtcgggcacgtatgtttggctgcgtaggttgggccttgtgcgcctccatcgtcggtatcatgttcaccatcaacaaccagttcgtgttctggttgggctcaggctgtgccgtgattctggcgctgctgctgttcttctcccgtaccagcacctcgtcgtcagccacggtggcccaggcggttggcgcgaatcagtcagggttcagcctgaagctggctctggagctgtttaagcagccaaagctgtggtttttgtcgctgtatgtggtgggcgtgtcctgtacatatgatgtgttcgaccaacagtttgctaacttcttcacctctttctttgcctccggcgagcagggcacgcgggtatttggctatgtgaccaccttaggcgaattactgaatgccgccatcatgttttttgccccgttgatcgtcaaccgtatcggcggcaagaacgccctgttactggccggaaccattatgtcagtgcgcattattggttcctcctttgccactagcgccgtggaagtggtgatcctcaaaacgttgcatatgtttgagattcccttcctgattgttggctgctttaagtacatcaccagtcagtttgaggtacgcttctctgccacgatttatctggtgtgcttctgtttcttcaagcagttagccatgattttcatgtcggttctggcaggtaacatgtacgaaagtattggcttccacggtgcctatctggtgctgggctgtattgcgatggcctttacgttgatctcggttttcaccctcagtgggccggggcccttgacgcttttacgccgtcaggctgcctgacctcactgtcataacctgaccggatgggctcgatggcgcatccggttgtctgctttctcaccgctttcccgccttctttttctgccgcatcgcttcattttgcgaactgtctcacattcataaaatcggtttagcaaattactttgcctgaaaatacatcgatgaatatcatccgcaaactaaaccggtttagcaaaaaaacgacatcattaccgttaccttttctgggatgtaaaacgatgagaaaaaaggcacttgccgtcaccgttggtctgctattgagttcggggccggttctggcagcagaaccaagcatgagcagtattgaagcacggctggcagcactggagcagcggttacaggcggcagaacagcgggcgaatgcggcagaaaatcgcgcggaagcggcagaaaaacaggctcagcagcttgccagcgcgcagcaaaagagccaggccaccgcgacacaggttgaacagcgtacggcgaagcttgaacagaaagcgagtagtgaagagggttttgaatttcacggctatgcccgctctgggttgctgatgaacagttcggcgacgaaaacccagggtggccccaccgtgacgcctgcgggggaaaccggcgggcacgtgggacgtctgggtaacgaacccgatacttacgttgagctgaatctggaacataaacaaacgctggaaaacggcgcgaccacccgcttcaaggcgatgctggccgacggtcagcgcacctataacgactggacggcttccagcagcgacctcaatctgcgtcaggcgtttgtcgaactgggccagctcccgaccttcacgggggcgttcaaagacacaaccgtctgggcaggtaaacgctttgaccgggataatttcgatatccactggatcgactccgatgtggtgtttctcgccggtaccggggcgggtatttacgacatgaagtggagcgatcaggctcacagtaacctgtcgctgtatggacgtacgttcggtgatattgagaataacgataacaccgcgcagaactacatcctgacggccaacaacttttacggcccgttccagctgatgctgagcggcatgcgcgcgaaagacaacgatgaccgactggatgtgaacggccttaaagtcaaaggcgacgccgcaaatagcggtgtccatgcgctgctggggctgcacaacgacagcttctatggcctgcgtgaagggtctgcgaaaaccgcgctgctctacgggcacggtttaggcgcagaggtgaaagccattgggtcagacggggcgctgttaccggatgccgatacctggcgactggccagctacggcataacgccactgggcggcgactggcatatcgcgccagcggtgctggcacaaagcagcaaggatcgttacgtcaagggcgacagttatcagtgggccaccgccaacatgcgtctgattcaggggataacggagaactttgaaatgcagtatgaagccacctatcagtatatggatttacgtccagagggcttcaaccagcgcagtgcggtcagtggtaacttctacaaactgaccgtcgcgcctacgctgaaagccagcaacgtaggggaattccttaagcgaccggaaattcgcctctttgccacctggatggactgggaccaccgactggataactatgcgcgcggcgatgcctttggcagcagcggttttgaagccggcggtgaatggaactttggcgtacaaatggaaacctggttctgacgatccggccctgcggggccgtttctggcgggttgacaccatcacacgataacacagaggttttttatggattttgtacacatctcccgtgcattactgccgttgctgggtggcaaagaaaatattgccagcgcggcgcactgcgcgacccggctccggctggtgctggtcgatgacgccaaagcggacaccagcgcaattggtaagatcgacggggtaaaaggctgtttccgtaatgccggacagctacaggtgatttttggcaccggggtggtcaacaaagtctacgcagcctttgtcgcggaagccggtatcagcgaatcgagtaaatccgaagcggccgacattgccgcccgcaaactcaacccgttccagcggattgcccggttactgtcgaatatttttgttccaattattccggcgattgtcgcatccggcctgttaatgggcctgctggggatggtcaaaacctatggttgggttaacccggaaaatgccctgtatatcatgctggatatgtgcagttcggcggcgtttattattctgccgatcctgattggctttacggcggcgcgtgagtttggcggtaacccatttttgggtgccacgctgggcggcattctgacccatccggccttaaccaatgcctggggcgtggcgtccggtttccacaccatgaacttctttggaattgaagtggcaatgatcggctaccagggcacggtgtttccggtgctgctggccgtgtggtttatgagcctgctggaaaaacaactgcggcgcattatccctgacgcgctcgacctgattctgaccccgttcctgaccgtcattatttctggctttgtggcgttgctgattatcggtccggcgggacgcgcgctgggtgacggcatttccttcatactcagcacgttaattgcccatgctggctggctggccggattactgtttggggggctttactcggtgattgtgattaccggcgtgcaccacagcttccatgccattgaagccggactgctcggtaatcccgctatcggcgtcaattttctgttacccatttgggcaatggcgaacgttgcccagggtggcgcgtgtctggcggtgtggtttaaaaccaacgatcctaagatcaaagccattaccttaccttcggcgttttcggccttactggggatcaccgaagccgccatctttggtatcaatctgcgctttatgaagccgtttatcgccggattgatcgggggagccatcggcggtgcctgggtggtgtccgttaaggtctatatgaccgccgtcgggctgaccggcttacccggtatggcgattgttcaggccagttcgctgctgaactacgttattggtatggttatcgcctttagtgtcgcctttgtgatcgctttcctgctgaagtacaaaacggattctgaataatggccctgaaaaacctgctgcccgccatgcttaaggcggtaatgaaaggccagcccaacgcgcgtgaggacagccactatcccggctggcacctggcaccggtgacggggctgctgaacgatcccaatggatttatccacttcaacggacagtatcatctgttctatcagtggaatgcactgggctgcgagcataagcacaaatgttggggccactggcgttcagccgacttactgcactgggaacacgagccggtcgcgctgttgcccgatgaagagtatgaccgcagtggatgctattccggcagcgcggtggacaacaacggcgagctgaccctgtgttacaccggtaacgtcaaattcgaggacggctcgcgcaccgcctggcaatgcctggccgtgcagaacagcgagggcggattcgacaagctgggaccggtcattccgctgcccgaaggctacaccggtcatgttcgcgatcctaaagtctggcggcatggcgcgcactggtacatggtgctgggcgcgcaggacaggcagttacagggcaaagtcctgctgctgcgttccagcgacctgcaccactgggataacctgggcgaaattgccggtagcggcctgggaggactcggcgcggcgggctatatgtgggaatgtcccgacctgtttaccctgggagcctcgacgtttctgatctgctgcccgcagggcattgcccgggaagagaagcgctatctgaacactcatccctgcgcatggctcagcggcacgctcgactatgagcaggcgcattaccagcacggtgcctttaatgaactggatgccggctttgagttttatgccccgcagaccacgctgacgcaggacggacgcaggctgctggtggggtggatgggcgtaccagacggcgaagagatgcgccagccgaccgtggcgtttggctggattcatcagatgacctgcctgcgtgagctgacggagcgggaaggccgactgtaccaacagccggtcgcggagctgcaggcgctgcggctggacgagcagcgctatcacggcagtgcggactgggcacccgagatagaggcccggcgtcttgagctggtgctgacgtctgacggcgatatcacgctggactttgccgatacgctgcggctgagctggcatcaggatgcgctttgtctggcacgccgcagtctggaaaacggcgaatggctttatcgtcactggtgcggccacgcacgcaaactgcatattctgtgcgaccactccagcgtagagatttttatcaacgacggagaaggtgtgatgagcagccgctacttcccgcagcatcctgcccgtttacacctgagcggcagcgcagaagtcactgcctgctactggtcgttacgatcctgcatggtagaataagcccttgtttccttaaacgaagcaccgacgtgaaaaaaacaaagcgcgttaccatcagtgatatcgctgcgcttgccggggtgtcaaaagccacggccagcctggtgctcaacgggcgcggtaaagagctgcgcgtggcagaagagacgcgcgatcgcgtcatgtcccttgcacaacagcaccattatttgccgagtatccacgcccgactgctgcgcgaaaaccgcagccatacgttagggctggtggtaccggagatcactaactacggtttcgccgttttttctcacgcgctggaaaacctctgtcgtgaggccgggctgcaactgctgatctcctgtaccgatgaaaatgccagccaggaaacgttggtggtgaacaaccttgtctcacgtcaggtggatgggctgatcgtcgcgtcaagtcagcagagcgacagcgattacctgaagctgagtgaacaactgccggtggtgctgtttgaccgtcatgtgaataacagcagtttgccgctggtgatcaccgattccattacgccgaccgccgagctggtagagcgcctggcgcgtgcgcatcccgatgaggtgtatttcctgggcggtcagccacgactttcaccgaccaaagatcgtctggccggttttatgcaggggctggagcgcgccggtgtgagtccacgtccggaatggattattcagggcaactatcatcccagcagcggctatgagatgtttgccgccctgtgtgcccgtcttggcagaccacccaaagcgctgtttaccgccgcctgtggcctgttggaaggggtactgcgttacatgagtcagcaccgtctgctggagagtgatattcacatcgccagtttcgacgatcactacctgtatgattcgctgtcactgcatatcgataccgtggagcagaacgtccctcgcctggcgcaggagtgtttttccgtcattacccagatgattcaggggcaggaaccggcggacaagcaaattatcttgcccgccaggctgcgttaccggtcctctctggcgcgttaacgccgcttagcgacaggcagccaggtccgtcatctgctgcttatcaggcaggccaactatctgttggagtttttggtcatgattcaggtaatagatagcgggcgtgccgttggcacccagctcctgcatcagtgcctgattatgctgaatctgatcgaacagcgcccgtggggtgctgtccgggaagaccggtttggtttgcccctgcgagcgttcaaaatcctgccaggctttggcgggatcggctgccgccagaatggcagaagcatagcgcccgctttcaggtttaagaataccgacgagctgcgttttgatgctgagcgtgttgttctgcacccacggctgcacctgctgccagaacgttcggcagtaagggcaaaacggatcggcaaacaccaccacctgacagcgggctgtggtgctgccttcattgatgcccggcatggcctgaagccgcttccacattgcacgcccggcgggcaggtaaatttcatcgttgatgattttttcgctgaggttattgccctgagcatcgtacatatagcccgaaatcgcatgctgaccgtctggcgtcaggtaaacggtgacgccggtgccttgatatttacctaaccagccctgaaccccgccgggggccgtaaagggtttgattatttccacgccctgtttttcaatttgctggacgggcgctggcagcgtagccgcctgggtcgtgctgctaaacagcacggcggagatcgctatcctgaaggttttcattaatccctgtcttgtgtgaattcacgttatgttggtggatgagcggttgtcgaaccacgcaaaaaacagcatacctgccagcatagccatcatgaagactgcgcctttaagtacaccgccgccgatcagtaccagcgccgggccgggacagatgcccgccagtccccagccgatcccgaacaggatagcgccgatgataagccttttatccagtgccctgttggcgggaagatggaaggtttcgccccataccgggcgcttccgtcgggaagccagccagaacgtcagccgcccgacgataatcgcgccgcacatcaccagggccagagacgggtcccaggtgcggaaaatgtccagaaaagccagaaccttagccggattcgccatgccgctgacgagtaagcccgtgccaaataacagtccactcagcagagaaaataaaacggccatcgtgcctcctgggttttacccgtgacccatcacgccaacggtcagcatggcggttaacataaagaccagtgtcgcaaccagtgagcgcggcgacagccgggataatccacacacgccgtgaccactggtgcagcccgaacccagacgcgttcccagccctaccagtaagccagcaagcaccagccgcccccacgaggcgtcaatctcgattgacggcagggcgctgaaccgttgatacaccagcggcgacaggaccagccccgcgatgaaggccagccgccagggcttatcggatgaccggcgtttaagcagaccgcccagaatgccgctgataccggctatgcggccacaacatagcactaacatgcccgccgccgcgccaatcagcagcccgcccgccaggctttgccacggagtaaaatggatcaggtcaatatgcatgacgctcgactccttatgccctgcttacgtcttaagtgaaaagcggtttaacgggattttcagatagcgctcgccgtcgctctccggttcaggtaaccgtccgccgttgatattgacctgcagcgccatcagcatcagttcaggaagcgggagcgtggcatcacgctgctgtcgccgggcaataaacgtgtgttgatgctgattaacgacccagggattgttttcccgctgctggcgtaccgtgctttcaaactgcacgtcgcgcccgtcaggacgataatcatgcccggtaaataaacgggtgtcgtcaggtaactgcaggatgcgctgcaggctgtcccataatacggcagcgctgccgccggggaaatcagcccgtgccgtgccgctgtcgggcataaagaacgtgtcatggataaaggcacagtcagcgatgtggtaggttaccgacgccagcgtatgaccgggagataagatgacctcgccacgcaggttacccacataaaacacatcgccgtccttgaacaaggtgtcccagattttatccgctggattaaggtcgggcaggtgatagagtttttgccacagccgttgtacctcggcgaccttttcgccaatgcccgtgggcgcagcggtttgctcagccagccaggctgcggcagagaagtgatcggcatgaggatgggtatccagaatccacgcaacctgccagtttttttgctgaatgaaatcgagtaggcgttgagcctgctgggtggataccgcgcctgagcggcgatcaaagtccagcaccggatcgataatggcacagcgtttggcctgcccgtcagcgatgacatattgcaggcttccgctctcgggttcataaaaatgatggacttctgcctgcggcggtttgcgtactctgttggcataccaggtcagggctttgtcggcgtcggcaccgaactgctggcattgagcgcggaattcggcctcgtcaatcagcccttcgcgtaaatcgtgcagcaaaaacaggcttacggagcgcgcgccgcttcgacagtgggcaaggattttcccaccgcgttccacccggcgatgaaaagcatccacatattcccagctcagcgtgtcaaacgtgaacggcatatagacatagtccatgcccagttgctcagccagcgctttctcctgttgatggtgaagaaaggggccgtcttcctcatcaggacgattattcaccacgatctgatagcccaactgatgcaactgccggaaatcctctgcaagcggggcatcggcaaaggcgatttgcgcattaaaatggcgaatattcatcaggttttcccgttttttcagagatttttaagcaacatgtaactggccatcaccatgagcatggtcgaaaagaccgcgttaatcgcgcgctcattcttcttcagacggttggccaccgccacacccagtaaaccgcccagcaggccgcccgcaatcagataagcggtcatgaccagcgacacttttccggccagggcatagcttgcgctggttgagatccccatggcgaataccaccatcagcgacgtcgctatcgcctccaccacgggaaaacgaaacaaccagacaagcaccggcaccactaaaaacccgccaccgatgcccataaatccggccaaactgcccagcagcagcacgcttccccagacgaggatgggggaaacgtgtttctcatgtgcaggcgcgtcgggcgaatgacggtgtttcctcagcatcatcagcgccacggtaaacatcaaaagcgaaaacggcagtaacaggtattgcccactgacgattttccccagttcggcgccgatcagcgcgccgcacaccgccacgagcgatatcgtcgcgcccgtcgcccatctgacatttccctttcgtccgtgggcaaaaagattgatcagggcacttattgccacggcgatagcgctggtgccgatgacccgatgtgtgtcggggactttcaccaggtacagcagcaacggcacgcacacgaccgatccgcccccgccggtcagcgccagaaaaaagcccacggcgatacctgttgcgattagcaggcacatcgtgagggcagaaagatgggtaaattcctgaatgaccattttcattcctgacgctatttttaaggtattaaagaggggcgacaaataactgtcaatctattatttcttttcgctatatcatatagctaaatattataagtgattttttttataactttaaagtctattgattcgctttatctctgtgccgcaatccactacggttaaacgaaagggaggcctgcatgaacgataaaaataatccccatcaacctcatcttgttgttattggtggtggatcagctggaattggcgtcatcgcaagtattaagaaacgcattaagaacatcaaaataaccctcattgagcctaaaaaagagcactattatcaacccgcctggacgctggtcggcgcaggattattttccgctgaaaaaacccgcagacagatggatgcggttattccggcaggcgtcaactggattaaggatgcggtaacccatatatcacctggacagaaatatattgaaactacctctgcccaaaaaatagattatgactacctgattatcgccagcggtctggtcctgcgctgggacaaaatcagtggtctgaatgaaaccctgggccgcaatggcgtaacgtcaaactatcgatacgatctggcgagctacacctgggaactggtgcaaaatctgaagcaggggaaggctatttttacccagccggggatgccgataaaatgcgcgggtgcgccgcagaaagcgctctatctctctgccgatcgctggcagcgtcagggttgtctggcgcagattgatattcaattttgtctggcgggtcaggtggtcttcggcgtgcccgaatttgtcccaccgttaacggcttacctggagaaataccgggcgcaggtgaatttcggccatgtccttaccggcgtcgatggtatgaataagcaggcgatatttaccgtcaccgatgctgacggcagcacgcgtgacatcacgctgccgttcgatatgctccatgttgtcccgcctcaggccgcgcctgagtttatcgccgaaagcggtctggcggatgctgctggctggtgtgatgtcgataaagagacgctgcagcacagccgctggccagatatttttgctttgggcgattgctgttcaacaccgaatgccaagacggccgccgccgcccgtaaacagatcgtggtggtggcggaaaacctgagacaggtcattgacggaggtgtgcctgaaacgcgttacgatggctacggctcctgcccgctcaccgtggagaaagggaaagtcgtgctggcggagtttggctatggcaaccgtctgcttcccacttttccgctccattcagcccgacccagtcgcgccgcatggtggttaaaagcctggtttttgccgcgtttctattgggctgggatgctgcgcggaattgagtggtttgctaaaagtaagccgctgtagagcaagccgatcaagggcgaatgtataatgcgccctgcgactgctggtcgataatataggtaatcgctgccggaaccacgtgaaaggttactggcagcatgctgacgtcaatatgttgcgcattaaggctattctgacagagtaataatgtgacggtcggtgcctgcttaagggcgtcagaaataatcctgccaataacatcgctaaccgcgtcgccattaaagacaatggcaatgtcgccgttaaaacccgcttctttaagcaggttgcctgcattagcaaaagcattgtcaatacggtttttatcggggacgtgcaaaattatcttcattctgtgcctcggcggtatttaccgcaacggaaaaagacgtcgatggcacaggataaaacatcaacagggacagatgaatttgacgattgaaagcaaatatgtcgtcggcgattcccgttaaataaaaacagaaacgcttgttgtattatcgcggtaataaccgggggattgctgtatgcgtctttccaacaggaaaaggggcattgcccctttgttcagattaatttttcagattttcaggaaaatttgcgggtaattcacttgcggcacaggcaatcacgtcttcgttattttttcccgcatcacgcacaaaggtgatggtggcaaactcatcaatcacttctattggataggttgggccggcatcgcggtacttcgccatttcttccagatggtcgttctggaaacacacggtacgctcaggattgttgatgacccagcgcgggaagaagatggtaccgtggaacagtttatcgcccaggttagcaatcaggctgacgctggtgccggtcggctcagtccaggagactttatagatatcttcaccgactctgacaacgtaaacatgctggtttttgacccagcggttgcccaccatgccgctgtgaatgcggtaatcgatggtgtcttcatttttaatatacagctcgtagttccagccgttgtcataggtataaaccagatgtttaccgataaagccgtcaagattatgtttgtcaaagctgctcataatttgttctcctctttggttgaacccagcttaaccattcactttatgaattaaaaacgctaatttacgatgaaattgattcaaaaattggatgggttatgcacaagacgacgctggagcagtggagtttgctggacaaggtggtgcgcgagggcagctttgccagggccgcgatgcttaccaatcgcagccagtcctccgtgagctataaccttgccatgttgcagcagcgcattggcattacgttgttgcataccgaaggacgcaaggccgtgctgacgcccgcaggggaattgctactggcgcaggtgcggccgttacttaaagccttccattcgctggaggcgtttgcaggctcaatacgcagcggcgtcaggacaaagctggaactggtggtcgacagtatctttccgcgtcgtcgcctgttttccgtcctcaaggcgtttcagcaatgtcatcctcacactcagatcaaccttaccgaagtgctggaaactgacaccgactacgccgaggccgacgtgatggtggtgactcagcgccaggatatggccgggcggggtgagtggttaatgaacgtggatttcgttgccgtggctcaccgtgaccatccgttgcaccatcgcggggtgacgctcgacgaagaacagctggcgctgtatccgttgattcgtatcgccgaccgggaacatttcacggtgcaggatgagagcagtaatggcgactactggtcgttttcgaccatcgaggcggcggtagaggcggtgatgcatcaggtgggctatggctggattccgcatgagcgcatcgagcaggaactggcgcagggaacactaaaaatattgcccttacagcatggcgtccgccgcgccaccacgctgcatttactgattaagaaagacatcctgaggctggacccgcaaatcgtcactctgctcgatctgctgaaaaaggctaccctgacctgaccggccagctaaacgggtctgcgttaacgagcgtggccagattatggcccgtgccggtctggcggcgacacagcaaaccgtgacagcggtcgaaatggctgggtttgtgggccagcctgaacaccaccgctgcgcataaacagcgtccagaaatcccccaacgcgccactctcgacagggcgtttagtgggcccgttttttggcccagtaagccataaagttgatcgcttcacgatcgacgccgcgttcaccaatcaggtgacgacgtaataacttcactacggtcgactcggcggcgacccagccgtaaaactcgctgttgcgggcctgagcgcgatcccacagtaattcgccttctgcctcttcctgtacgtcctgctgatgaccgccatcaggcaccttaacccgggattttatcgcctcgaccaggcattcgccgtgtgaggcaaaagcgggtttgcgcggcagccaggtgatgtcggcaaatgcataagcctgtaaaccgacgcaatcctccgcatccgggacttcaaaaaacgcctgcacttgcggcggattttgctgccgggacagtttttccaggatgcctttcgccgcgggtaacgcggtttcatcggcaatcagtaacgcgttgcgcagcgcgtccggcggcgtccattcatatccgccgctgtcagatgcataggccgcattaggcgcaacgatcaccaggctgtcacccggctgggcgttgatcgcccaggctgatgccgggccttcggttccgtggctgacaaactcgatggtgagttcctgctggtcaggatcgagatggcgcagcgtataggtgcgcaacaggggacgctgctcttttggcagcgacagaatggtctgataccactcaccgttgtcagggagcgtgggcatgctgccatcttcggcaggcagcaaaattttaattcgctggtcaggcgcatcagatttcatctgtgcgatgtcggggccattaaacaccaggctcagcatagagggagaaagatgacgcttgcgtgccagttttacgtcaaacaggcggtagctatggacttcagccatcgtcgttccttttagttaataagccgataaggtggagcggcggcgtgcgcgccagatcaacgctgacatcgccataaacagcagggcagcagcgaaggcggcaccgatcagcgctgtctcgccatgcgactgcgacaccagtggcaccagcagcgcgcataatccgtagcctaaggtatggctggtggctatccagcctgcccccgcgccgtctgccagcttgtcatttaacagcagctgataggctggcgtgcccagtgcagcaccaaacgaaagcaaggcgcagccggtataaaacagccagagcggcgtgctcagcatcattcccagccccagagacatcaacagccctgcgctcagcaacagcgcaagcggcgtcagtaactgagggcgcaacaccgtgaactgcgcgccgagtgaggcgatcgccgccacgctcagaagccaggctacctgatggctaatcgcggcggtatcaccaacaaactgtcttgccagcgccggggacaggcccaactgcatcaggctcaccgttgccgccagcagcagagcgcacagcagatagggcagacagtcgatgcgtagccgggcattgttacgcgccacggccggttgcggcgcgttaccgcgcaaaggcagtaacatcatcagcgccagcaacggcgcaaccactaacagtaccaagggggcaagtggatgaatcactaacattccggcggcacacagcgggccaaacagcctgccacagctcaggccggaactgatggtggcgagtgccgtcatgcgcttaccttcaccggcccggtgtagcgcccatacctggcacgccggcaccattgccgacaccatcaggccataaataacccgggcaataattagtatgcctaatccaatcgaggggctaatggactgcgtggaaagaagcgtacagccgatgcccagcagcaaaaaactggcgccataaccggccagtgaccacagcacgaccggtttacttcccacgcgtgcgatctgttttccccaccatggcgaagagggcaaaaacagcattgagccaagcgttaacagtcctgcccacaccgacaggctcagactggtctgcgcaaccagcatcgggatagccaccagcaaaccattctggccgatgcccagcaatccggcgcttatcgctaagggccagttagataaggctttttgcggcgtcgcggtcagttcaagagatgtcacgatgttgctaacccgtatctttgttgtatgtatttgtaaaatttattccgccaattctaacaattgtcgttgataatgagaactgttatcggcagaattcgcattatcataacgcctggaaattgtttgataatgattcaatcaacacacgagggagcctgggatgtggcagcacagtgcttcctgaattccctgatccgtgaaaccaaggactggcaactcagccagggtgaacccgtagaattagtgattccgttggacgatgagaaggccctacactttaaggtggcttacttttctcccacccagcaccaccgttttgctttcccggcccgactggtcacgcatcgcgacagccagccagtggcgttcgcgaccgttgccagactgattgtcgataagctgcaaaaccagcagcagctgcccgccgctggctgtgaggcgttttaccagcgtgttatggaaagtcacgcccataccggtgaggcaatcgctgcccgtcatgactggaacggcctgcgtgagcaagccctgaactttgccgaggccgagcaggcactgctggtcgggcacgccttccatccggcacccaagtcacacgaaccctttacgcaaccgcaggccgaacgctacctgcctgattttgcgccacatttcccgttacgctggttcgcggtggataaagaccacctggcgggcgacagtctgcaactgactttacagcagcgcctgatgcgctttgcggccgaaaacgcgccgcagttactgcatgcgctgaccgatcggcagtggctgttcccgctccatccctggcaggcggactatctgctccagcagacctggtgtcagcaactggtggagaaaggcctggtgactgacctgggggaggccggtgcgccctggctgcccaccacgtcatcgcgttcgctgtactgtgcgaccagccgggacatgatcaagttttccctgagcgtgcggctgactaactccgtccgcaccctgtcggtgaaagaggtcaaacgcggcatgcggctggcgcgcctggcgcagaccgaacgctggcaggacatgcaggcgcgtttcccgacgtttcgtgtcatgcaggaagatggctgggccggactgcgcgatgcgcagggcaggatcatggaagagagcctgttcgcgctgcgtgaaaacctgattgtcgacaggccgcagagccagaccaacgtgctggtttccctgacgcagtccgcgccggacggcggcgactcactgctgtctgcggcggtgaaacgtctgagccagcgtctgaacatcagcgaaaaacaggccgcccatgcctgggtcgacgcctactgccagcaggtgctgaaaccgctgttcactgcggaagctgattacggtctggtgctgttagcccatcagcaaaatatcctggtggagatggcgcaggatctgccggttggcctgatctatcgcgactgccagggcagcgcctttatgccacatgccgcaggctggctggacgtgattggcgaagcgcaggcggaaaacgtctttagccgcgaacagctgctgcgctatttcccctactacctgttagtgaactccacctttgccgtgacggccgcactgggtgcggcaggcatggacagcgaagcccatctgatggcacgggtacgtgacgcgttaagcgcgctacgaaacgaggtgacgcacacggactgccttgactacgtgctgacaagcccgcactggaacgtcaaaggcaatttcttctgctacctgcacgatcacaatgaaaacaccatcgtcgatccctcggtgatctactttgacttcatcaacccactgctgtctcaggagcgctaaatgtctcaggcaaagattgttcatagtggccacggcctgcgctgcgaaaagtcaggcaacacgttgaatctcggctggggacaggacaacagtgcggtgctgcatttttccggtccgcttgccgaaggctggctgcgtgaggcgctggaccagatgtttatcgcggccccgcagctttccgccgtggtgctgcccttcgcagaatggcgcgaagaaccacaggcgctggcgctgtttgacgcactaaagagcgatatcgtgcatcgcgatatgttctggcaactgccgctgtggctgtctgccccgcgtcagcaggcctccggcgagatgacgtttgatgccgagcgtgagatctgttttccccagcgcccgccgcgccccaacggcgaagtttatcgccgttacgatccgcgcgtgcgccgtacgctgagttttcgcgtagccgatcctgcccgggacgcagaggcgttcacccgctggatgaacgatccgcgcgtagattatttctgggagctgagcggatcgctggcggtgcagaccgcctaccttgaacgccagctgaccagcagttatgcctttccgctgattggctgctttgatgatgagccttttagctactttgaaatctactgggcggcagaagaccgcatcggacggcactacagctggcagccatacgatcgcggtttgcatctgctggtgggtgagccgcagtggcgcgggccgcactttgtgcagagttggctgcgcggcatcagtcactatctgctgctggacaacccacaaacccagcgcctggtgctggaaccccgggccgataatcagcgcctgttccgccatctggcaccggcgggctacagcaccgtgaaagagtttgattttccgcacaagcgctcccggctggtcatgacccagcgcgcgcgtttcttcggcgaggtgggcctgtgatgaatcagcacgcatgggacgccgttaaccgtcagctggtcgcgaaaatgctggctgagctggagtacgagcaggtctttcaggcgcagcctcagggcgagaaccgttactgcatcagcctgccgggagccgagtggcacttcaccgccgaacggggcatttggggctggttatggatcgatgcgcagagcctgcgctgtgcggaggagccgatactggctcagacgctgctgtatcagctgaagccggtgctgtcgatgagcgatgcaacggtggcggaacatatgcaggatctctatgccacgttgcgcggcgatcttcagcttatgcaggcacgtcagggcctggatgcgaacgcgctcattgatatggatgccgaccgcctgcagtgcctgctaagcggtcatcctaagtttgccttcaataaaggccgtcggggatggggacaagaggcgctggagcgctatgcacccgaatacctgaataccttccgcctgcactggctggcagtgaagcgtgaccatatggtctggcgctgcgacagcgcgctggatctccagcagttgctacatgccgcgatggacagcggtgaatatgcgcgtttcactcaggcctggcaggaccaggggctggacgacagctggctgccgttaccggttcatccctggcagtggcagcaaaaaattgccctcgattttgtggcggatctggcgacaggcaagatggtctcgctgggagaatttggcgatcgctggctggcgcagcagtcactgcgcacgctgaccaacgccagtcgtcagggcgggctggatattaaactgccgctcaccatttacaacacctcctgctatcgcggtattccgggcaaatacatcgccgcaggcccgctggcatcccgctggctacaaaacgtctttgccacggacacgacgctgcagcaaagcggggcggtgatcctgggtgaacctgccgccggttatgtttcccatcaggcttacggcgcgttggccgaagccccgtatcgctaccaggaaatgctgggcgtgatctggcgcgaaaacccctcacgctggctgcacccggacgaaacgccaatcctgatggcaacgctgatggagtgcgatgagaaccatcagccgctcatcggggcttacattgcccgctctggcctgagcgcagaagcctggttacgtcagatgtttcgcgtctctgtggtgccgctttatcacctgttgtgccgttatggcgtagcgctgatcgcacacgggcaaaatattacgctggcgatgaaggacggtgtgcctcagcgcgtgttgctgaaagattttcagggcgatatgcggctggtgaaggacgattttccagagatggattctctgcctcaggacgtccgcgatgtgacggcacgcctgagcgctgactatttgattcatgacttgcagaccggccattttgtcacggtcctgcggtttatttcgccgttaatggcgcgccttggcgtaccagaacgacgcttttaccaactgcttgccgcagtgttgagcgactatatgcaggaccatccgcaactgtcggcgcgttttgcgcttttctcactcttcaagccacaaatcattcgtgtagtgctgaatccggtaaaactcacctggcccgatcaggacggcggaagccgtatgttgcccaattacctggaaaatttgcaaaacccgctgtggctggtcaccaaggactgaatcatgacaaacactgttgattttattggcgttggcattggcccgttcaacctgagtatcgcggcgctggctcacgaggcacaagggttcaccagccagtttttagacagtcgccccgattttgcctggcatcccggcatgctggtcccggactgccatatgcagacctcgttcttaaaagatctggtgtcggcggtcgcgcccaccagcccgttcagctttgtgaactacctggtcaagcgtaaaaagttttaccgctttatgaccaccgaattgcgcaccgtttcaagggatgagttttccgactatctgcgctgggccgccgaaggcatgaataacctgcgctttaatcagacggtagaacgcatcgattttgacgacgcgaataaacgttttgtgattcacagcaacggcggcgaaagctatgcccgcaacatctgcctgggcattggcaagcagccctacctgccgccctgcgtgaaccgcatcagcgccacctgcttccatgccagcgaaatgagcctgcgcaagcccgacctgcgcggcaagcgtgtggcggtgatcggcggcggtcagagcggtgccgatctgttcctcaacgccttccggggcgagtggggcgaaccggctgaggtcagctgggtatcacgccgcaacaatttcaatgccctggatgaagccgctttcgccaacgaatacttcaccccagagtacgtttccagctttgtcggcctgaacgagcctgcccgacagaaaatgctggctgaacaaaagatgacttcggatggcattacggctgagtccctgctgacgatttatcgcgagctgtatcaccgctttgaagtgcagcgactgccgcgcaatgcccatttgctgccgagccgttcggtgattgaactcaacagccatcatcagggctggcagctccagttacagcatcagctcgatcagggttacgacctgatcgactgtgatgtagtgatttttgccaccggctatcgcccggcgctgccggaactgctctctccgctgatgagtcgcctgaccatgaaagacgagtgcacgttcagcgtgcgtgaggacttcacgcttgagtggaacgggccaaaagacaataacatctttgcggtgaacgccagtatgcagactcacggtattgctgaaccacagctcagcctgatggcctggcgctccgcccgtattctgaatcgcgcactggggcgtgatttgttcgatctcagcacgccgcccgctctgatccagtggcgcagcgtcagccgggaaaaaccgcagcatggcgctgcttctaccaaaaactataccgagtccttggggtaagtcttaacctcgcacgcaggaacgatgatgaaagctaaaaacaagaatatctggctgctcaatccgctgctgttagccatgatggcaccggcggttgcacagcaaaccagcgaaaatgaaatggtcgtttcggccagtcgtacgcaccgtacggtggctgacatggcccaaaccacctgggtaattgagggggccgaactggagcagcaagtccagggcggcaaagagtttaaagatgcgctggcgcagctggtgccgggtctggacgtcagtagccagggccgaaccaactacggcatgaacatgcgtggccgcgcgattgtggtgctggtggacggcgttcgcctcaactcttcacgcacagacagtcgccagctggattcgatcgatcccttcaacatcgatcacattgaggtgatctcggggtcgacttccctgtacggcggtggcagtaccggtggtctgatcaacatcgtgaccaagaaaggccagccgggcacgcagtttgagtttgaaaccggcaccaaaaccggctttaacagcagtaaagatcacgacgaacgcgtggcgggcgctatctctggcggtaatgaccgcgcctcgggacggctgtctgtcgcttatcagaagtttggtggctggtatgacggcaacggcgattcggttctgctggataatacccagacggggctgcaatattccgaccgtctggatgtgatgggcaccgggacgctggaaattgatgaccaccagcaactgcaactggtaacgcaatactataagagccagggtgacgatgattatggtctgaatctgggcagaaacttttcggcagtaaccggtaacggcaacgcctacaccagtaaagggctggactcggaccgtattcccggcaccgagcgccaccttgtcagcctgcagtactccaataccgatttcctcggtcaggagctggtggggcaggtttattaccgggacgagtcactgacgttttatccgttcccaaccgtttctggcggacgcgtgaccagtttctcctcctcagagcagaacaccgatcaatatggtggcaagctggcgataaccagtaagcccgtcgatgggctggcgttaacctacggtgtggacgccgatcacgagcgtttcaacgctaaccagatgttctttgatttgggccagtcggcagcctcgggcgggctgaacaatcagagcatctacacgaccggtcgctatccgggttatgacattaccaacctggcgaccttcctgcagtccagctacgacattaatgataccttcacgctgagtggcggcgtgcgctatcagtacaccgaaaacaaggtggatgactttgttggttatgcgcagcagcaggcgattgccaacggcaccgcccgttcagccgatgcgattccgggtggctcaaccgattacgataatttcctgtataacgccggtatcctgatgcatatcacggagcggcagcaggcctggtttaacttctcgcaaggcgttgaactgccggacccgggtaaatattacggacgcggcacctatggtcgggcggttaacggcaatcttccgctgatcaacagcgtcaacgtggatgccagcaaattgcagggcatcaaagtcgattcatgggagctgggctggcgctataccggtgacaatctgcgcacgcagctcagcgcctattattcgctctcagacaagagtgttcagcagaatcaggatctgaccatcagcgtcgttgacgataagcgtcggatttatggtgttgaaggtgccgtggattactttatcccggataccaactggagcaccggcgcgaacttcaatgtgctgaagaccgagtcgaaagtggatggcagctggcgaaaatatgacgtgaaagtcgccagtccgtcgaaagcaaccgcctatgttggctggtcgcccgatccctggagcctgaaagtccagagcaccacctcgtttaatctgagcgatgatgcgggctataacattaacggctacaccaccgttgatttgattggcagctatgagttgcccgtcggcaagctgagctttagcgttgagaacctgctggaccgcgactacaccacggtgtggggacagcgcgcaccactgttctacagccctacctatggttcaccgtctcagtaccagtacaaaggccgcggtcgcacctttggtctgaactactccgtgctgttctgattcctgcttctgtgcccggcaccgtccgggcctgttttttacattctttcccctttatcacaacaggttgcgacacaataaagttagctacctaatgaattgtgtaatatttcatcgtcagatgccgatagtagaaacatcctctacacaatgtttcctctacatcaggtgaataaagctatgaccattacccagagactgtttctgaccttctcgttgctagccgcctcactggctgccttagccgtggtcgctatcctggtcgtgaccggctttcagtcacgctttgactatgttcagcaaaataccattccgtcgattatcgacctgaacaagctggtggacagcagtcatgcactaacgctgctactgtaccgacaccagagtgccaccgatccccgtaagcaggcacagttcgaaaaagatattggttcggcgataaacgacttaaagaaacttaaccagtattacctggaacacgatatctctaatgctgaagataagtcgttaactgaacaggcctttggcacgattaaaaacatcgaaaccagactgccggaatttttagccggttcccgtgcacaaaacgatgccgtttccctcggcgctattcagagcgacagcggagttggacaggcggtacgcgatctgatgaagggatatcagaagcaactggcgctgaatgtggctatcggtgaggcgtacagtaaggaaaacggcaaggcgtatcagaaaaccctgtggggcatgtcagggggatcgatagcgattatcctgctgctcggcgcgttttcggttaagacgattttcagcatccgtcgtcagcttaacgccattcgcgccaccatggaacacgccagtgagcggcttgatctgacgctgcgcgcagacgattcacgtcgtgacgagattggcttaaccgccagggcttacaacctcctggtgaacaacgtagcgcagtcgctgtcatcggttgagcaggcgtcccactcggtcagttctgcctcgtcccagatttcagccggtaacgacgatctctcttcccgcacggaacagcaggcggcgtcgctggaggaaacggcggccagcatgtctgaactgagtgaaaccgtacgccagaccgccgaaaacacccgactcgccagccagctatccaaaaacgcgcgtgaaatctcggaggacagctcaggcaaagtcaaaacgatgctgggcaccatgaccgatatcagaagcagctcggcgaaaatcaacgacatcattgcattgattgaaggtgtggccttccagacgaatattctggcgctgaatgcggcagttgaagcggcccgggcgggtgagcagggacgcggttttgccgtagtagccggtgaggtgcgtaatctggcacagcgttcatcttcttctgcccgtgagatcaaagcgttaatcgagtcatcgatgcgctacgtagcaaccggtgccgcgcaggctgaagaagtcggacagaatatgaaccggatgaacgatgccgtgcgccaggtcaacgatctggtggatgaaattgcggtagcggcccaggagcagtcgcagggcattggtcaggtgcatgaagccgtcaaccagatggacagcgtgacccagcaaaacgccgcactggtggaacaggcttctgccgccgcgcgttcgttaaccgaacaatccacttcgctgcaacagctggtggctgcctttactatccatcctgcccaggttgtcatggataagcgtccacctttcaccgtgacggctgcgcccgtgcttaagcgcccacagcttgcggcagccggtgccggtgcgcaggaagacaactggcagagcttctgatagcgaaaaaaacagtggcccgttaaaaggccactgtttgccgcaggctatgaacttttgtgcagcgtcagcggcgtcgataaccagcgggcgacgcgcttacctgccttaatggcgggcttttctatccagaaaaacatcactgacgccagcgccacgctgatgctgatggacaacacaaagatcataaaattatccgtccaggctttatcggccaggctgttcatcagcaatatcatgagcgggtaatggatgagatagagcgaataagagatatcaccaaagaaaatcagcgcacggttatgacccctttcgctacggtaaccgagcatcaccgtgatgctcataatggccgcggccagccagaaacccccgtgcaggccaaacggctgcggcccaatcatcagcgccgtcgcgaatgccagcaccagcccgacctgcagtattctgcgcccctgaggcgtcagctcaggcagcttctgcttcacgattaactccgccagcatcatgcctaagataaactccatgcaaatggtattgctgatgagtttgatccacgcctgccaccagtgcgtcaccgccatatggggcgatacctgggatgaaaaatcaaaactgccgttgtaatagagctgaaaacccacgctggaggcgagaaaaatcagcgcacacaaatagctacgatagcggtagttgatgcacatcgcgacggtgaacacggcgtaaaacaggatttcgtaggacagcgtccagggcggacccaatgcgctaaacccaaaggtcgggccgggactgctgtaatcctgcagacagaaatagagcgcgcaggacatgtcctgaagtgaacgatcgtggtaaaccaccacgaacgagagcagccagaccacgaagaataccggccagatgcggaaaaagcgtttcaccatgaacgaggtcggggcttcgttaaactggtgggtaataaaggtcatgatgaagccgctgataataaagaacacgtccacgcccagcgcgccgggaatgtgccgggtccagtggccttctaacagcgatgagttgtgtgccagcaccacgagtaacgcagcgagaccgcgcagatactggattgagacgattttcatgagcgttacaggcctgtcggtttactcaataacggcgatcgcctaagcgagccgattagggttaagcgtaggccgtattgtaaaaacgacttaatgattatcaaccctcatttacaggtggggtaaaataattaacgcggatttcggttattttgcggaagatgaggctgatatcgcagtagtttggcgcacaggataaaatgtgcgccgcagggatttcagagggttcttaactaaaggttatgtctggcgccccggtcttgcgctcagagaggctggcgtcgccgggcctgttcacagaaggcgcgtctgaatatctctatcgtccacatccagagaatatgccccagggtttctgacgcgatttccgcgagcggcaggtgccataacgccggtgcccagccgttcatcggcagtattacgccgtgaaacgccagcgtgatgacgatggcgaaagcgacaccctggcccagggtgactgccgggacgatctccgcgagtgcgcagtagagcagagcaaagaaaatggagaacaggtgatgtacaccggcaatgccccagttcaccacgtgatcggaatagtgataaaccaggctgctgacgttgatccccatatcatgcagcatctcagcaggcggaatcgccctgtcaggcgttctgggtggaaagggattttcggttccccattttacaaaactggcgacattgccgccgcaaaatcctgcccacagcgccagaccataatgccggtcggcaggggatgtcagatgaaacaacctgttcatagtcaaccgctcctgctgagtgtgataaaaaaacgtgaattactgaccgtaataggcattcgccccatgctttcggagaaagtgcttgtccagcaggggctgctgcatgtgcgtgataccgggcgtcagctggcgggagaaaatgcccatataggcgatctcttccagcaccaccgcgttgtgcaccgcgttgtcggcgtctttcccccaggcgaatggcccgtgagcgttaaccaacacggcggggatcgcgaccggactgataccacgcgtgcggaaggcttcgatgatcacttcgccggtattgtgttcgtaatcgtgggcgatttcggcctccgtcatcagtcgggtgcagggaatcgcgccgtagaaatagtcagcatgggtggtgccccaggcgggcagatcctgaccggcctgtgcccagatggtggcgtggcgcgaatgggtgtgcacaatgccaccaatatcgtcaaaggcccggtagagcgccaggtgcgtcgcggtatctgatgagggctttttgctgccgtccaccacccgtccgctctccagttccaccacgacaatgtcgtccactgtcataccgtcatagtccacgccggacggcttgatcgccaccaggccctgggcgcgatcgacagcgctaacgttgccccaggtaaaggtcaccagttgatggcgcggcagcgccaggttggcggccagcacctgctctttcattgcggctatgctcatactaaacctccttcctgcattttctgttcaatccagcgccgggcctggacgatttcggcaaccggttcttcggctttttctgtccacatttcaatcaggaacgacccgcgatagttcagtgctttgagcgtgcggaacacgccgacaaagtcgacgcagccttgaccaaagggcacgtcacgaaactgtcctggtgagcttgcggtcacgggttgagtatctttcaaatgaatggcggcgatgcggtcaatgcccagggtcagctcggcggtcacatcgttgccccaggcgctgagattgcccacatccggatacacggaaaaccacggtgaagcctgctgctgctcccagactttccacttgctgatggcgttcataaactcggtgtccatgatctcaaccgccagcatcacctgggccgcggcggcgcgctgcaccgcgcgtgacagcccttcggcaaagcgcgccacggtgctttcatcgtggggttcgtaatacacgtcgtaacccgccagctgaatcgtgcggataccgacgtcctttgccagctggatagcccgatcgatcagatcgtccgcgcgctggcggatcgccggatcgtgactgccaaagggaaagcggcggtgtcccgacaggcacatggaaggaatggtgacgccggtttcaatcgtggcattcaccagcgacagccgctgctctttgctccagttcaggcgcgccagccgcgcgtcggtttcgtccaccgacatttccacaaaatcaaaaccacaggcttttgccagcgccaggcgttcaggccaggtgaggttcgcgggcagggctttctcgtaaatacctaacggatgctggtgtttcatacggttccccaaatgctggcaatggcctgatggaattctgcggcgcgctggatgccgctggcgggatcgctgagggcgcgtccggcgataaacgccttaacgtcaacgtctttaaattgtgaaagatcctgaggcgtaatcccgccggtgatggagagggcgaaacccaaatcggataaggctttcatggtatccaggtcgtgctgattccactgctgaccgctggcctgcgcatcccggccacggtgataaatggcctgttttagccccagttgccgccattttcgcgcatcatccagcgtccagttgccaaacagttcaatctgaatatcgccctggtgctgctgtgccacctccagcgcgctggcaaaggtcgccagcggggcggcacagatgaccgtcatccagcttgcgcccgccgtaaaggccatgtctgccagggcgccgccggcatccgccactttatagtcagccaccagggttttctccgggtgctgctggcgcagacggcgcacggcttccaccccacagctcaggcatagcagcgtaccggcctcaatgatatccacgtgtgggtgcagctgttgtgcggtactcagcgccgcctccagctcggtatgatccagcgccagctggagtaagggcaggctcataaggtggctccttgtgcatcactcaggacgcggatcagatgctgataacgctgatacttctgctgataacgggcatgtcttgtgctgtctggctgccaggtcacgatatccggcgctaaggcctgctgcgcctgttgcagcgaggcgtaagcgcccgtcccggttagcgcgaccagggccgcacccagacagccgctttcgctgatctgcggcacttctaccgtcaggccgctggcatcggcaaacatctgcatccagggggcggatcgcgtgggaccgccgctcagacgcagggcggtgacctgaggaaagcgttgcagaatgcggttcagatgcgtcaggtgggaaaacaccacaccttcgtagatggcctgcaccagatgggcgcgggtgtgacccgcctgtaggccaaagaagctgccgtgcagatcggccccggcgttggtgccgtacaaaaaaggcagaaacagcagcgcgttgctggcgggttcgagatccgtgacccactggtttaacagctggtagtcgctgatgccccactgctcacagaaccattccaggttggccgccgaggtcgggctggcttcatggatcaggtactggccctcgatggcataacggccataaacgtagggatagtctgtttcatcgcggatgcagtcggtaatgccgctggttaccgaccaggtgcccatcaccgcgttcaggcgcgttgcgtcattcagtcccgcacacagggcagtggacatcacgtcaaacagaccaccgaccacgggcgtaccgggcagcaaaccgcatgcggcggcagcctgcgaggtgacatagccggcaatctgcgtcgacccaataatcgggggcagcgcgggaacgatttcgctgatatccagcatctcagccaacgccggcgaccagtcggcggcctgcatgtcgtacagattggattccgagatattggtttcttcacaggccagctcaccggtcagacagaaacgcagatagtcgtgggccatcagcacgctaccaatcgcggcatagcgctgcggctgatgctgctttagccagcgcaggagtgaaaccggatggccggtccacagcgtctgtcgggtgagcgggtagagctgctgcggcaggccttcctgctgccactgttggaccaggctcagggcgcgacgatccgaagataagatgccattccccagtggattgcgatctttatccagcagaaacagccctttaccctgagcagagatgcctaatccagcgacgtcggcggcatcctgaccgctactggtcaggacctcgcgaatcaccgctgccgcttgctgccagagcagcgtcatatcgcgttcagcataacccggctcaggcaccagtatcggcaggttttgccgtgcaacggccagctcgcggccctgcatatcgtacagcccggctttaataaaggtgccgccacagtccagtcccagccagcgtttcataccgcctcccgtttcgcagaatcacagcgggcaggcagcgtcatggccagcagcgccgccagcgccagcgaaatggcaaggctgtaaaccccggcatctttgctgtagaacgcaatcagcatgccgaccatataaggcccgcagaagccgccaaggttgcccagcgcgttgatcaggccgcgcgctccgcccgcgacctcggcattgaacagacgcggcggaatactccagaacacgcccgccgcagactgaataaagacgccacagcccaccagcgccgcgtaggaccaccagatgtgtgctttaagcaataccgacagcgccatgcacagcgcaaagccggccagtggcagcgcgacaaacagcttgcgccggccggttgcatccgacagaacagagaacagaaacatgccgaagatcgccccgacatagggcaatatggccagcataccgacctgttcgacgttgccgtgggtcagctctttcagaatggtgggcaaccacagggtgtaaccgtaaataccggtctgatagaaaaaattgaccagaatcagccgccacatcacgggctcgcgcatgacccgcagcagagaggcattacgcacgttctgccctttgatcatcagctgctcgttgtgcagggtggtgatcagatactgcttttcagccggagaaatccacgtcgcttcctgcggccggttgctgatggtgaaatgccacagggccatgaccaccagcgataatgcgccttccacgtaaaacagcatgcgccagtcccaggcggtaatgatccagccggagagcggggcggtaatgatcccggcgatcggcacaaacatgatcacaatggcattggcgcgaccgcgttcggcatccgggaaccagttgccgatcatcgtcagcaccaccggcaacatgccgccttcggcgatccctaacgcgaagcgcagtgccagcagttgatactgactggttgccataccggtcagcatcgagatgatcgcccaggccagcagtgaccagccgataaagcgtttgccattgccatacacggccagcttgccgcccggcacctgtaaaaaaagataaccaataaagaaaatgccgcccgccagtccagccatcgacgcgctgatgcccagttcggcgtccatgccgcccggcatggcaaaggcaatattgacccgatccatataagaaatgatgcaggtgatcaggatgggtggaatgatccttagccagcgcagggcggggatcttctcacgattaacggcggtcgatgtcagactcatggcattcctccttgcctaaaccagatcgcgggtggggatcttgaccaccactttgcgaatcggtccgggcttgcccaccgcgcaatttggacggtgaatatcctgcgggaaaaacacggcgaaggtgcctggcagcatgcgcaccagggtttcttccggcgcgtgctggtaaaaaataatgtcgcgctcgctgtcgtaaggctgatgcaccggtaaatccacgggctgcgtggcgacgccgatgacttcttcccctgccaccagatactgcacatcaatatgctggcgatgcgcttccgggtagttctcttcaggcgcggcggtgtgcagatccagtacctgcatggtccagcccgtttcgctgtcctggtaacgtcccgcagccataatggtcaggtcgtggcgggcgagacaggcgatcgctttggcaatcgccgggggatagtgacgcgggtcggtgttcgcaatatgtccggtgatcatggtttcccccttacagcgcctgaatacgcgcccagatgcgatcgtccactggaataccaagacgctggttttcagcccgcaacggcggaaacttatcgccgggcaggcgaatggcctgctcgctgtcggcgcgttcagcgttgataatcgatgcccggatacggtcgagcttgtgctggcgggtttcaccatcaatgagccggtcgacatcaatcgcgataaagacctgcgagatgccgaattcatcgccgttgtcatgtgtcacttcggtgacggaggcaccgttggagagcagggtggccagcatgtccagcacgaccgacagcgcggagcctttccagtaacccataggtaagatgcggcggttttgctcaagggtggccggatcgcgggtgtaattgccttcatcatcaaatccgccatcgaccggcaggcttttaccggccagacggttcacttccagcatgccgtaggagaacatcgacatcgacatatccaccatggtgatcggctcgcccggcacggcgatgatcagcgggttagtcccgatcgccccacttttcgcgccccagggcggcatcacggcaatagaattcgtccagcaaatgcccacaaagcccttttccgccgcctgccagccgtaactgccgccgcgcatccagtgattggcattacgcagcgccaccagcccaatcccgtggtcggatgccacggccatggcgcgttccatcatactgtgcgcggtgatgttgccgatggcacgctgggcatcccattgctcgatcgcgcccagcgacaggactttttgcggctcggcgtcgggaacgatatggcccgcgtccagttgctgaataaaacgtgggaagcggtttacgccgtgggaatacacgccgttgaggctggtttcggtaaacatatgcgcacaggcttcggctttatcctggggcacgttacgactcgtgagtacgcggagaaactcctcatacaactgctgatagctgattctcatacgactgatactcccagcgttgccgcttatttcataatgtggaatgtcatttcaactaaatgctatggggaaaagacagggcagtcaaagaaatgactgaaaaattaatcattaaaaatcatgtagttatatttattgctggcttttgtgatctcaggcttatttgccagattttgcccacagaggggccggtcagccacagacgcgctgacctgacaggtccttcttgccgttctgcctgcgcagccggtttagcgcaacgttacccggtagagcgaggtgttggctgtgatatagagttcatgattatccggtccaccaagcgtgcagttggataccgtctcagggatcgggattttgcctttacgcgccccctgagcgtcaaaaataatcacgccgtccgcgcagctacagtaaatgtccccgttggcatcgacacaaaagccgtccgggaagcccggcgtgacatcggcaaaaaatttccccggcgacagttcccgtccttcaacctggtaaacccggagctgatggcgtcccagcgtcgggaagtccaccaccgacatatcggccacataaagcaggctctcatcgggtgagaatgccagcccgttagggcgctgcagatcgctggccgcaatactgagctgcccgctgacgggatcaaaacagtagagatagcagccgatgacctggctgggggccagatagccttcgtgatcgttaacgatcccgtaaggcggatcggtaaaccagatggtgccgtcagaacggatcgccagatcgttgggcgagttaaagcgtttgccctcgactttgtcgatcaacacgttgaccgtgccgtctgattcggtccggctgatagcccggcggccatgttcgcaactgacgacgcgtccctgactgtcccgggcattgccgttggcatagttagcatgatgacgccagatgctgagctcgccgttgcgctgccagcagtacatgcggttgcctttcacatcgctgaacaccaccgcatcgagctgcggcagccataccgggccttcggcccagatggcaggggaacacagtttttctacctgcatgctgctggcctccgttacttcacgccccagatggttttgtaatgcgcctgataaccgttttcgggatcgtaattgttctgcggcccgccatcgcggctaatgttttcctgggtaattaaatgcgcgggcgtcacatagcccgaaggcggttgaccggcgaaggcgcggttaaactcatccagcaactgccagccgtgcagttttaacggttcagccacggtggcgacctggctttccccattgcgaatgcgctggaaggccgagatggacccatcacctgcggagatgttgtaaggcgcgtttttaccgcctttgcctgcggttttcagcgccggtgccataaagtcgaaatagagatcgttgatcgccagcgaatactgccaacggtcgccgtacttctgtaacaggctgaaggtcagcgacggcatacggttagaggtatcggccagtggggtatcaataaagtcgatgaccttacactcgctgcatttttcaatttcctgcttcatcgcattggccttatccagcgcgattttataaagcgagtcggtaaagataatgacctgggctttgccgcccgatttcaccacggcgtactgtgccgccaggcgggccacttcgtttgagtccgaggtaatgttatccgtaatgccgtactgcttaatcggccccggggcgggttccgcatgccacgccatcagcacaatcttttgctgcacggcttttttaagcggcattttggcgacgttggggttccagccgccaataatgatgccgtcaggccgttgggcgatagcctgattcagggcagcgagctgatctttcaccgatcccgcgccgtccagcgtatccagcttccatccggcgactttcgccgcctcgctcagcccctgttgcacgccctgtacgccgccgtttttcatatcagaggcaataaaaatcagtttcttattcgcctggagcttaggacctgtggtggggccgtcccaggtggtggcgctggacgtggctttggcgacggccgcggtggcttgttccagatagctgtctgcatgtgcgggcagagaggctaccaacatggcaacgagagaaagaccaaataccggatttttcataatgagttccctggtgtgatggttttttgctgtgggtcaggtgtggtcgctggcgtgccctgactgcgcacgacggctttttggttcaacatacggcgacgctgggcgtagccggcaagcgtaatcgacagcagcagcgtggcaccgttaaacaaaggctcaacccagaaggccccgccaaattgctggataccggcgataccgatagccagaatggcaatccccaccacggtgccccagacgttaacccgtcccggacgaatggtggtgctgcccagaaaggcgcccactaaggcaggcagcaggtaatccatgccgacgctggcctggccgacgccctgttcggcggcgatcagcacgccgctaaagccggtaatgacgctggaggcaataaaggagccaattacgtatttattaacggcaatcccgttgagtcgggccgctacgggattaccgcccacggcatacatgcatctgcccaacggcgtatgctcggtgaccagccataacaccagcgccaggcccagcacataaaatgcgccaatcgggatgccaacaatttccgtgctgtgcagggcactgaaggcgtccggcaagtcgcccacaatctgtcgtccgccggagtgccacagcgcaatggcatacagcaccgtgccggagccgagcgtggcgacaaagctgtcaatgtctgccagcgccaccagaataccgtttagcaggccatacagcgctgacaataccagcaccgtcagcaccgccatctgccaggaaaaaccgtattccacctgcagcgtaatggccagaatgtgccacagcacgatgccaaagccgacgttcaggtcgattttgccaacgatcatcggcaacgtggccgccagcgccagcagtgcaatttttgccttactggacagaatcgcctgcacggttaacatcgaggcaaaagtgggggacaggactgaaaacattaacgctaacagcacgcacaacagcagtaacccgtagcgggtgaggatctgcatcgaccacggcgcaaagccatgctgggcaaggctgacccgttgttcgagtgcggtagatttcaccgaggttttagacatatcgtttctcctgactgcctgttcagacggtagctaatggggcagcagaactggctgaggccagctccagtaaacctgcaaaggtaacctgttcatttctcagttcaccgaccacctggccccggttaaacaccagagcgcggttgcagatatgagcaatttcttcaaggtcattggaaatcaccagcaccgccacgccttcagcgagggctttattgagcaggtgataaatctcttcacgtgcgccgacgtccacaccggcagtgggatcttcaagaatcagcagcggcgcattcaggtgcatccagcgtgccatcaccactttctgttggttgccgccggacagggcgctgatatccaggttcacgtctttgggacgcacatcgaacagctggactttccaccaactggccccgacctcagcgcggcgaccgtaatgggacatcagccgatgaccgctggcgcaaggattaataaacaggttctcgcgcacgctcatcgacatcaccaggctttcgccggtgcgatcgcccgccacaaacgagatgcccgcggccatcgcctcacgcggggagcgcgggtggcagggttggtcgcggaagataacctccccgctggtggactgcttcagaccaaacagcatccgaccaatctcttcctgaccggcaccgcgcaggcctgccagcgccagcatctcgccgggttgcaggctgaaagagaccgggccgacttcatcgatgcacagcttgtccagcgacagtacaggcgggcgggcttcgggcagggcaagacgctgattgctttccagcgcctcgcccacaatcatttcgaccagatcgtgaagctggtaatctgccgttacgccctctgccacgcgtttaccgtcacgcatcacgcaaatacggtcggcaatctcaatcacctcatccaggcgatgtgtcacataaatcatgcctacgttgcggcttttcaggcgctcgattacgctaaacagatgacgcacgtcattggcgggcagcgaggcggtcggctcatccagcaccagcacttcggcgttgaccgccacggcacgggcgatggccagcagcgatttctcggtgcgcgacagttcaaagacgcgggcatcggggtccagctgaatgcccacttcttccagggccaaacgcgctcgttcacgcaccgcccgccagttaaccaggccaaaccggcggctgaatcccatgaccagcgccatattttcggccacggtcatccactcaatcagtccgagatcctgatgaataaacgcaatgggttgggtggtggcggtttttaacgcggcggcggatgccgtgacgttgccctgaaaggtaatttgcccttcatcactggtgtacacgccagccagcactttgatcagcgtggatttacctgcgccgttttcccccaatagcgccacgacttcgccggggaaaacgtccaggctcacatcgttaaccgcagcgttaccgccgaagcgtttagtgatatggctgagtgtaagaaccggtttatccggatgaggttgcattcctgcctcccgtgacgcctggtgagtatcagcagcaagagcggcgaccgctcgttgctaatttcaatatgtgaaatactattccaaaaaatagtattcctgccgccgtggaaaagcaaagaagcagggcggatatttattcataagaaacagtaagttaaaatattgttttgaatttgtgatgaacaacgcacttctgccaggacggaacagacctgtccggccacactaaaaaagcgaaagattcccagccgctatgccatgagttaacatcatgcgttagcgcgttcaggaagtgagaaacggagaggatcggtggatggcggtgaaagtggataaagcaaaggaaacgaagggcgataagccattagggacacagagcctgtttcgtggcctgcagttaattgaattattgagtaattatcccaacggttgtccgctggcccatcttgctgaactgtctggaatgaacaaaagcaccgtacaccgcctgctgcagggattgcacagcagtggttacgtgacacaggcaccttcgcctggtagctatcgcttaaccaccaagtttatttcggtcgggcagaaggcgctgtcgtcgctcaatattattcacgtcgccgggccacatctggaaaaactgaatctggacgtgggcgaaaccgtgaacttctccagccgtgaagatgaccacgtagtcctgatcaacaagttagaacccacgaccggcatgatgcgtacccgtgcctatatcggtcagcatatgccgctttactgttcggccatgggaaaaatctttctggcctggggcagcgaagagtacctgctgcaatactggcaaaatcatcaggacagcattgagcaactgacgaaaaataccattaccacgctgcctgagatgcagcgggaacttaacgatattcttcagcagcgcaccgcgatggatcgtgaagaaaatgaactgggcgtcacctgtattgccgcgccggtgtttgatatccagcagcgtgtcccttatgcggtatcggtctcgctgccgacggcgaagctgcaacagattggtgcgaaaaacctgatggcgaaggtggttgccacggcgcaggccatttcagaggagctgggttgcaccgcctgagaacggccttttcatgctgccgccagccgcaggttgtcaccacggcgttatgcttcgttttcgggcagcgagccgtccccggcaccgagcgcgcgctgcatcagcaccgtatccagccagcggccgtgcttgaatcccactgacgtcagcgtaccgatcacgctgaaaccggcggcgcggtgcagggcaatggaggctgcgttggcgctgtcacccacattccccaccatctggcgaaaaccacgcgtttcagcccagtcgatagcatgggccagcaggcgtttaccgatgccttttccctgaaatgccggatcgatatacagagagtcttcaagggtaaaccggtaggcataacggggccggtaaaagcccagatagcagtaaccacaaacctgtccttcactcaccgcgacgaaccagggcagcccggcggcgcgaagtttttccagtcggctggctatctctgcctcgtcgggcggaacgatttcaaaactgcctgtaccccgtaagacgtggtaggcgtaaatctggtgtattgccggaacatggctgtcttctgccaggatgattttcatttccctgtttccctgcctgttgcgttgcaaaagcgcagcggcagcagaatatgcattgccgcacgccgcgatcattaaccgaatctctccccggcttgcagcacgcaagcggtgggcgcgttacgctgcgcacctcccccggacccatggttcagtgcggcagtgaatatcaagaagaatacgcaggtcaggctgacaaattccagcctctgtaggcatcatcaatggccttttggccctgcaaaaagcattttggcagatcgaggcccgagtacagtgtctggtagcgcctgcggtttgcgggggtaatcaacgcgatgtgctttatcattgcccctttcacgctatccaccccgccctcaagcccgccctggcggggggagctggcgtagcaacgtctgaaataacgcagcaaactgacgagcgtggatacatcaagaagaatgtagccggttgcccgcgccagccttgcgttaagacagttggtgtagttgccgtccatcacccagcaatcctgatggatggcctgatgatgtaaatgcaaaaactcagcctcatctcttggctgccagtcggtatggggcaggtgataaagttgatcaagatgaatggcaggcagggcggttttacgtgcgagcgcgctcgcaagcgttgatttcccgctgttagacggccccataatacagatgcgcggccccagattctcaagcgttattaatgcgctcatggcggtgcccttctgtctgctggccctgcggcgggcggctgtggcggattgcacaccgccaggcgcgcggggcaaaactcaggaagattatactgacccttctttttcaatcaccagcactcttgcttcaccctgcggatgggcgacgtgctcggttccagtgctggcataaaaaatatcgcccgtttctaagcggattttctttgtttctcccgcttcccgataatgcatgtctacgcagccatccatgacggcaaacacttcctgaccatcattgatatgccatttatagggcttatccgtccagtgaagccgcacggtggtgccctcaaaattggcaatgtcgacggcaccccaggccttttcggcggtgaaagctttgctgataaacgttttcatctgttccctgctggtctgaacgcatgtgaggcgagttatagcgcatcagccagggcgtgacttgcaaaaaattgcggatattacgggcaaatgtggtggggaaggccgaaacgcccgcacgggcgaatctcagcaaacgcggcatgcatgaggttcatagcagggctcgcctgtcgccgaatgcagtaaaacatgcctgtcggctgacgtgaatgagccgacaggcatgaggcgcaaatcagaagttcacgttagcgctgatgccgccgacaaaggcatctttcacctcactgacggcgcccggcgcaaccacatattgcaggttaggacgcagctgcaaccatttggtcaactgggcgttatagtaaatttcatagttgtattccgcaccctcctgaaccggcaggtaggtgggactgttgaagtcggtctgaccgctggcgtcattctgttgacgcagcgcacgggaataggcgctgttaacatgaatgcgcgccgcaccgacacctatttcatcccgcggacgcgcatcaaacggccctttccaggtgaagctaatggactggtagttatcggttttagcggttttgtgatcgttcatgaccgcctgcacgctgacgcccaggccgcggctggcatcgccaccctgtgcggtaagctgctgctgtaacagcacatagccgccataagcatgatctttgtgctggtaagcgccatcttgccagctaccgtagttgtcgccattcgcggacgaatagtagtagccgatgcgataattacccggcagattctctggcccgaaagtcggtttccagcccagttcgaccggcaccagattgccttctgagttgttggtatcaaggcggaaaccgtcgccgcgatcgtagttagcgcggttctgattgtagaaaccgacctggaaaaatacctcaggggtaaagttaacttttacccgtccgccccactgggataccggccagttaaaccagcgatcgccgcgccagttaccggcctgaccgctgccgaatgccaggttctgaaacttgctgtcaaagttatcgaagtcttccccgacggtaacccggccggctttaacattgactgtgttatcgaacaggcctttgcttaaccagaactgcgtcagtcgccaggtctgaccgcggccgtaaacttcctgcgtggaggagagcatcccggtgcggcgatcggcaacctgatcggagatgttacggccattacgatcggtgatggtcacctggaactgcgtatcctgccagtcgaggagcttttgcagatcgaaattggcaccgaatgcccactgatcgctgtaacgcatcgacgtattggtatcggctccgccgccaagattcgccgcgctttccatggtgtagttaacgtcgaatttgatgccgtcttgttccagttgtgtccgcgaaccgttccagtcaccgaacatatagggggaatcatagctaaaggcatcggcggccagcgcggaggcgctcagcatcgcaaacatcaggctgcccgcggccagacgaggcataaactgcactgctttttgagtattcatgatcgttattcttgtgtgaatgacagtaattgaccgggcagaggatagtgctggtgaaatgtcagtttttgcaaatccgtgcgtatataacctcaaaacaataaacgattaacgcaattgtgacaggtctctctgaacgaatatgtttttaacagaaaaggcatttaatgcgaggaagcataaaaaaaagggatgccgtagcatcccctttgactcaggccttgctggcgcgggaaagctcttcgatttcttgcttacttaacatcagttccgtggccttgaccagttcatcgagctgttgcagtgaggtggcgctgacaatcggtgccgtaatgcctggacgcgcaatcagccaggccagagcgacctgcgtggctgaagcatcatgtgaggcggccacatcttctaacgcctcaacgatgcgcaggccgcgttcattcaggtatttatccacaattccctgaccgcgctgactcttggcggcatcctgcggtttcttgtatttaccgctcagaaagccgctggcgagggcgtagtagttgatgacgccaagatgattgtcgcgggcgacctgctccagctcactttcatagccttcacggtcataaagattgtattccggttgcagggtttcatagcgcgccagcccctgctgcttgctgatgtccagcgcctcctgtaaccgcgttgcgctgtaattggaggcaccgatggcccgcactttgccggctttaatcagcgcatcgaaggcattaagcgtatcggccagtggggtggattcgtcgtcacggtgtgcctggtacagatcgatcacatccgtttgcaggcggcgcagtgaatcctccacagcctggtggatatagtcaggtttcagcccctttttctccggtgacatttcgataccgactttggttgccaggacgatcttgtcgcgcttaccgctttttttcagccacttgccgataatggtttctgactcaccgccttggttgccgggcgcccagcgcgaatacacgtctgcggtatcgataaagaacagacctttttctaccagcgcgtcgagcagggaaaacgaggttttctcgtcaaccgtccagccaaagacgttgccgccaaaagtcagaagcggcacgttaataccactgttgccgagctggcgggttttaagctgcgtcatagcattctccttggttaaacgaatcaggtatgcctttcagcttagcaaaggaaaatccccgttatttaattctggttatcaacctgtgcggcaggctaatgcaatgcgcgcgtgaggcggttgatgacaccgccttttttgcctgtttcaggcagagatgatgacgtgtattcctgtcacttttttcttgatgggactgaagacaggtaacgcgatagcggccggttgggtgggctgcattgttatcagacgggatctcaggctcatggtttttttacagtctgaaacgcatcttaacctcaatgcaaacaatcccggcagacggcgaggtgggttaaggctataaaaagtgagggcaggacaaccgtgcccttaatgtgatgcattgggcatctggaggcgtcgtcgtgctgcgtaaaactgctttcatgtcgtcaaaccgacgtgggtttctaaaaaacagcgccgcgctcatgctgggtgccgcactgccgctacctgctttggcgtcttctgcgccctttcccgccttaaaaaccgttgccgccggccgtcatctgctgtttggctttgccgtcaggcccgacagtctgcaatccgatgcgcgatatcggcagtttgtcgcgagtcaggcgagcattatcgtcccggaaaacgcactaaaatggattgccgtccatcccgcgcgcgatcgctacgatttcaccggccctgatgctatcgccgcctttgcccgcgagcaggggatattgcttcgtgggcacacgttctgctggcatcgcgcccttcctggctgggttcaggatattgccgatccgaccgaactggaaaaggtgctgaggcagcatattttcaccgttgcgggccgctatcgtgggcagatacaaagttgggacgtggctaacgaaatcatcaatcccgccgacggacaacccggcggatggcgcaacagtttctggtatcagcggcttggtacgcgttatatggatattgcctgcgaggcgctgcatcaggccgatccccatgcggtaatctgctacaacgattacgggcttgaaagcgacgatgccaatgggcagcgaaaacgggcggcggtactggcgatgctgcgcgacttacagtccagacatattccgattggcgcgctcggcatccagtctcatctcaaagccggtccccatcccgcttttgggccggggctggcggcatttattcgcgacgtgaaatcgcttggcctgaaggtctacatcaccgaactggacgtggatgacagcagcgtgccgatggagcgcagaccgatggcggttgccggtctgtataaacgctatctttcgctggttctggaggcgggcgttgccgctattttaacgtggggcgtttgggacacgccgcaccgcacggctgcgacaccgaaggcgggggacgcgctggcgaccgggccactgctgtttggtaaagacggcagcattaaagaggccagttgggcggcgcttcatgtactgcgcgaatcacttcaacacgggtgacgcgcgtgcggctatccactggcgataacgcagcggcgtcatctccatcatcttatgagaggcttaaccgcagagcggaaccttgctctgcggttaagcaatcagaaggactgccagttttctgctgacaggccagcgctagtgctctccgctaaaggcttcttcagcgatggcttacgcagcacattctgacctgcggccggggttctgcctgtgttaaacaccgctaccgactggcgtaactgcgttgcctgatcctctagcgaggcagcggcactggccgactcttcaaccagcgcggcgttttgctgcgtgacgccatccatttcagacaccgctttactcacctgctcaatgccgcgcgtttgctcggccgaggcggaggcaatctctgccatgagctgcgtaacgctgttaacggaattcacaatactgcccatcacatcgcctgcttctgaggcgtgcgtcgaaccactgtttacgcgctgcgtggactggtcaatcagcgtgcgtatttcctgggccgcactggcgctgcgcccggccagggaccgcacttcaccggccaccacagcaaaaccacgtccctgttcgccggctcgcgcggcttccactgcggcgttaagcgccaggatattggtctggaaggcgatgctgtcaataatgccaataatgctggcgatctgttttgagctttcacttatctgttcaatgttggcaatcaccttcgcgacgatttgcccaccctgcgaggccattacggaggcatctttcgccatggtggttgcctgctgagcattttccgcgttcagttttaccgttgaggtgagctgctccatgctggctgcggtttcctcaagggctgccgcctgttgttcggtgcgcgaggagagatcggtactgccggcagaaacttctgccgcgccggtaaaaatggactgcgtggcatcatccacagagcggatggtgacaaccagcgcactgcgcatctcttcgagctggcgaagcagtctgccggtttcgttttgactctcactggcgatctcctgggtcagatcaccggcagagatagcacgcatgtaatcagtggccatgctcagcggtttcagcagcagggttctcagaccgccccaaacagtggcaacggtgacaagggcaatgatcgcgataatcagcaacgtccacagcatattgctgtagttgctatcgttttcagcggcgatctgcttcattaactggtagttggcactgcgccatgtctgataagccttatccagattatcctgagcttcctgcgcatcaagattcccgtaaccctgataattattatttttcagaaagtctactgaggcgagcattgtctcgtgcatcttgttgtaagccgcctcgacattttttgtcacctcagcatgctgacccggtaatgcgggtgcggtcttataagcctggaaatactcatcagctttatcggcggactgcttcgccacctccagcaacttggcaatagacgccagtgatgcgggatctttctggtttttaagaaagcggatcgccacgcgactgatcgtcacgcgcgtcttgatcagcgtctgaacgctgtcgctgagttgttgttgttgcagcgtaagttgttccgtgtgcgaaaaattgcgaccggcctggctgacagaggaatagaaaagaaagcccgtaatggtcaatagcgcactaaaaagaaataacacggcaacaatacccgtcgtgattttaaggtttttaagcattgcagtaatcccggtaaaaggtgatacaggtatatcggtattaaaatgattagcttaatagtgacgcggtaaataatgtgatctatgacagtaactaagaaataaaagcggcttttctgaagagagaagctgttcgcgagcccctgggggacatcgcctcaatgataaaaggcagcgcggctaaaatgtaccatcagatacattattgtgatctgaaaataataaaaaggtctgcagattgtgcccatgcgtcgttatttcgcacaacagaggcatttattttaatgcgaatataataacgctttgaaataataagaatgaaaacgtgatggccagcgcttttctctcactggcgttatccgtgcaagcgatgcagaggttagcggatgtcagactttatggcgcagtggagggcgaaaaatattctgcaaggctgccgcgcgggcgaatgcagtttatgacaggcattaaaaaacccgcacaaggcgggtttttttcacaacgacttaactgctcaggctgttgccatcatcgctatcgtaagcagtcgtgagggcgtcagttgttacagtgcaacaacattgccagctgaaggacctttagggccgttctcgattgagaactccactttctggccttcatctaaagttttaaaatcgctgctctggatagcagagaaatgtacgaatacatctttgcttccgtcctgaggagaaataaagccgaagcctttatcagcgttaaaccattttactaaaccagtcattttagtcgacataagaggtgtccttttcatttttgagccacacaaggtgacgaagatggcctgttttgcagattttacttattgggcacttaggaggaggctcatgaagaagggcatctgggaatgacgcttgaactgaggactgctttactaaaactgctttcataaggtctgtgttccaaaccgatgtcgctacactatagaggttgaacttattaagcaaggtttaattttatttaagtcataaaggccagacagccggttcgaaaccccggacagctgtttatcccggcggcggccggtcaggggtttttgccttgcggtaagtcgtcacaaccctttctccgtttccttgcgtttctccccatccagatcaagaaacaagaatagttatcatttgtataatttgcgttctgttgttactggatcgaataaggctatgcaaataaaaccacgcacgacctatcgtattgggggataccaacattccattcatcccgcctggcggcaaaagctgctaaccatgggaatgctgcccggcacgttgattgaggtggttcgcgtagcgccgttgggcgatccggtgcaaatccgtacgcgccgcgtcaaccttgcggtaaggcagcgggatctggctgccgtgatgcttgaagaaatagactgatgaaaaccttgacccttggcctgattggtaatcccaatacgggcaaaaccaccttgtttaaccagcttaccggcgcgcgtcagcgagtagggaactgggctggcgtcactgtcgaacgtaaagaagggcagttttttacggcaacggcggatgtgcggctggttgatctgcccggcacccgttcgctcaccacgctgtcggcggatggctctattgatgagagcattgcctgtcgctacctgttcgacgatcgtgccgacctgattgtgaatgtggtcgacagctcgaacctggagagccatcttttcctgacgtttcaactgctggagctgggtgttccctgcattgtggcgctgaatatgcaggatattgcggccagccggcacatccacatcgatgtcgccgcgctctcagcccggctgggctgcccggtcgttacgctgacgtccacgcgtgccgaaggactcgctcatctcaaggccgccattgatgactggcacaaagcgatagcgccactgccggtggtttatccgcccgctattgaggcagcgattttacgcctgcgcgccatgatgcctgatgatatccatgtgcaaaaacagcgctggctggcgttacagctgctggaaggtgatatcaacagccgccaggtttgtcccgcagtcgtgccacatttggccgagattgcccaggaagccggtggtgatccggcaatggtcatcgccgactgccgttatcaggctatcagcgccctctgtgccaccgtcagtaatattcagcagtcaatgccaggcgcgctgaccgaaaggctggacaacatcgtgctcaaccgatggtcaggtgtgccggttttcctgggcgtgatgtacctgatgttcgtactgtcgattaatatcggtgccgcactacaaccgatatttgacggcggctcggtggcgctgtttatccatggaacgcaatggctcggctatacctttcattttcccgactggctgaccgtgtttctggcgcagggaatcggtgctggcatcaatacggtgctgccgattctgcctcagatagggctgatgtatctgttcctgtcttttctggaggactccggttatatggcgcgtgcggcgtttgttatcgatcgcctgatgcagtcgctgggcttacccggtaaatcctttgttcccttaatcgtcggctttggctgcaatgtcccctctgtgatgggcgcccgtaccctggatacaccccgtgagcgcttactcaccgtgctgattgcgccctttatgtcctgcggcgctcgcctggcgattttcgccgtgttcgcggcgacgttctttggggcttacagcgccagcctggtcttttccctgtatgtactgggcattgttgtcgccattgtcaccgggctcatcctgaaaaacacgctgctacgcggcgaggcttctccgtttattatggagctgcccgtctaccaccggccccatctgaaaagcctgctgatccagacctggcagcggctgaaaatgtttatcatacgggccgggcgggtcattattctggtcagcatggttatcggactgctgagcagcttttcgtttaacggctcgacggtggacaatatcaacgcgtctgcgttggcttctgccagcaagatcgtgacgcctgcgctgcggccaatcggtgtcaccccagacaactggcaggctaccgtggggctggtcaccggcattatggcaaaggaagtggtggtcggaaccctgaacagtctctatgtcggtgaagatgtgcaaagcggtgacttcgacccgcagcactttgatctgctgggcgaactgggtgatgcgctgaccgcaaccggcgacagcctgaaagcggcatttagcctcaccgcgctggcaaaccccattgaagccagcaaaggagacagcgagatcagcgccagccagatgggcgtgatgagtgcgaagtttggcaatggctttgccgcttacagctacctcatctttgtgctgctctatgtcccttgcgtgtcggttatgggtgcgattgctcgcgaggcaggaagaaactggatgctcttttcgtttttctggggcttaaacgtggcgtattccgttgccacgttgttttatcagagcgtcagtttccaccatcatccggggttgagttcgctctgtcttatcagcgtggtgatggtgaacagcgtggtgtttgttctgctgcgacggtttagtgggcgcgtaaagacggtgccttttactggcacgacaacggcgcggggatgtggcggctgccacacatgcaccgggcaacggcatcgccgctagattctttatatttgataccgccggatgccctgaacccgcatcgctgtgacaggatgacgcgaggcgatgcgcgcgggcaaacgccgggtgaatatcgctgtgaactaaaaacacgccgagcgcgcttaccggccagcaaagccaggttgggtcggcaatctgcccgtattcaccatagaggtaaaatccgcattgttccctggcgtggttttgggcacacagggcactgagccagatgcgcgtggcaagaaaaatgctttcatcattgcgcggcttatgcaggaaagcgtattccttatatcaatatcaggaatcgttaacacggaaagatatccataaacttcgacgcaataaacttaaacgtaaattaaacacaatggcttcttctggtttatatatttctttttagtagactttgcgtgtttttaggtaaaggtattttgcagccatgaaatccttattataaggatattcttattaatgggcctgcactgcggcattcccgccttgtgatgatgataaatactgcctggcgttcgcgtttccacgctgtttgcagagcctgcttattgctaaagcgatccgcatctgagtagagtattccccctgttttctgtttatttttaaaggccattttagcggcaatgcaaattacagaatactcttagtttatcgattaattcattgtttttatttaatttttactcgcgataaaacagggtaaacattttgatacaaaaattgacgatgtgcatacatacgactgatttagagtagcgaaaaatttgtacaaataaaaatttttgggactaactggcactctcttttgtatttcactttaataaatatgtcacaccagaggttatatgaataacgataaacaagtccctttagtgtcatttattgtgcctgtttataacggtgcggcatttattgaacgttgtgttgagagtattcttaagcagcctcaggctgagcgctgccaggtgattctggtgaatgatgggtccagcgataattcacttgagctgatgaataaataccagaattatcctggggttttgattatcaataagcccaatggcggtgtttcttcggcgcgtaactgcggactggacgccgcacgcggtacattcatttcttttgttgacgctgacgacttcctgcctcctgcggttcttgatacctggcttacgcttatgaaggatgatgtggttctggccgtaggcgaatcacgtaccttttctcatgacggaaagccgctttctgaggtaacagaagccgattctcagcgcagtatgtctgccgataaggcgataagtgaactgttgtatcacacgccgaagcacggcatctgtgacaaatttttccgccgggaaatcgtgcaacagcagcaattgcactttcgtgaagatatctttaactttgaagacctgctgtttgtgatcggctatctgtccgccgcgaaccccgggcaggtggtgtttagtcgccgtgtggtttaccactatgtcgagtccagaaattccgccacacgttccgagcttaaagaaaaacactttacctatgtacgtgcttttgccgggataaaaatgttgctgctgcccccacaggaacgcctttactactttttattcctcaaagtgaccgcttcgcatatctacaaggcgttgcacagtgaggagttcagcgctgcgtttgtcaagcagtacatcgatctctatcgtcagaactatcgtgcttattgcgctgccggcatcattccaaatgcatggagcctgtatttcaccttcttctttctgtcgccgcggctggtatccgggttgcgccacgtcgcacagaatgtgttgaggggccggtcgtgaaacagaagctgcaaaactcgttgtggatgatcattgagaaactggttgccgtctttgggctgatgttcgtcacgtccttcgtggcgaaatacgtggggcctgtcacctttggcgtcatcgcgatttcaatgctgatctttcagtttatccagtcggttgccatgatgggctgcgatgtgattctgctgaagcgtatcgcccagaatcaccgctcgggcatccggcttatggtgcctgcagtcatattagtctttgccatttactgtgtgctgtcggcgataggcatcatcgtgatgcgcgaggagatgaatgcgcaggcctttatctttatctgtgctgctgccttagcctgcctgttttcagctatcgacctgattaacatctataacgaggcggttttaaatgcgaagctgaacgtgatcgctaacctgaccgggctgctcatcagtttaggcattcgctatgggatttcttattaccagctagccccagagttgctggcgattcccattgtgctggccacctttattcctttcctgattaagatctgcgtgtttggctggtatcaccgacgatctcaggtgcggccgccgcttcctaagctgagccatatccggcgttacagccgctatattcttcaggccggacggtcactggtgctgtcggtgattgcgattaccatctatacccgactcaaccagctcagcgtgtcatggtttttaggcctcaaagaggcgggcattttttcggtggcgatgacgctgtcggttgcctgggtatttttacccaatgcgctgttggcgtctttctatccggccctgtttgccgagcgcgatcctgaggtggctgtgatacgcgcccagaaactgcagttactggtcattgccgtatccgtaggagttatccttggcatcgcactggtggggccctggtttattgagcatttctacggtgccgcttacaccgaagcgatagccccgatggtgttgttgagtatcggtgccatgtttggtgtgttaagcagcgtgatggatcgctttatcatcaaatacaacggctaccgttatctgatcaaaaaaacgttctgcgtattggcggtttgcctggtgacgacggtgacgttggtgcccatgttcggcatcactggcggggcaataagcgtggtggtcacggagtttatggcttttaccgtccttaattactttttccgcggtcagccaatgatgaagattcataaaatcttcatccagccggggaaattatggtttctgattaaccgcaccctgttttctggccggtaagttaagtttttatgaaaggtattattatttttgagaaataatacctttcatcatattgaaatatattcattgagatttactttccccgtcgattatctgtaggcttcagataaatattattttttataatcctgcaaacctgcgggaggcggacgcatgcctttattatttcattcattattttatctacagtatttaattaaggataatgactgatcttcgttgccggaattatacctgtttacagtcagtttaatttagcgcttttatactgtgatcgtggatttataaataattaaaaagctcattttctccggggtgaaaaggaatgaaggcgactttataacgccgattttcctctgcctgataatgcgatgatgtatgctggttacgaggttttgaaatgaatgataaatatttattcagtataataataccggtttataatgccgagaagacgattatgcgtaccctgcagagccttttccttcagacatttaaaaattatgaaattattgcagttaatgatggcagtaaagataactgcgctgcgatccttgatgagttcaaacagtacaataattttaaagtaatcacgcagaataatgcaggcgtcagcgtcgcgcgtaatagcggactggaagcggcatcgggcgactatgtcatttttattgatgccgatgactgggttgacgatgattttcttgccatatttcatcagcatctttcctccggcattccacaacctcttgatttgatggtagggaacctcaagtgcgatcgcgtgggcgatctgtcgacctacggctattttgatcagcagggtattcccgacgttctgggtgaaatcgagttgagtgataatattggttatcttcataacaagtgttacagaagaaaaattatcgatgattgtggtattcgcttcacgaaaggcatttcgatgagtgaagatctcctgtttaatcttaactatttctactatatcgataacctgtttgtttttgacagtgcctcctatcactatgatgatgtagagaactcgctttcaaagaaacgcgtactttatgaggagctgctggatcgtaaacgctaccttaccgacctctatgaaaggctgctggtgaagtataaaaacggcgatatgacccgtttttctacaggagtaaccaaacgcaagctgacgctggatatgcaaatcgtaaccgcaatgtactacaccacgctgaatattaatgaggttcgtaatagcatcaagcgtatcaaagagaagcgttatcctgagaatgtcctggggctgttaaacaggagcgagaaagtgaaatatcatgtgatgaacgtgaatgccagagcggcctatctggtgctgtatatgcttttcagattgcgttttttttaagatttagactgtagcctttttattattacatgtccggcctcctggtggaggacggagcacattgtcctttaattttttcgtcacttttgagctctccggctctccagacatcgggcgctgttttccggcgtcagttttgtcaggacatgcataagaccgctagctgttgaatgctgtcagccagcgctctgtgattttcacggggccagacagtgttcttgaccgatataaaaaactgtcttgcagttcgtaacgtccggttgaaatgaatcgctacggttttaacagacacctctggatcattttaaatgacttaaagagaggtgcccatgagcggtaattgttatccagaagcgtttaaaattgaagccgtgaaacaggctgttgatcgcggccattctgtttccgtgtggcatcacgtctcgatatcatgacccacagtctttacgcctggataaagaggtaaggtcaggattcttccgctaataatgagcagtcagaatttaaattaataattctaaatttaatgcatgaagagagtgtttgacaggttggaatgaatttcggaagtataaaacaatccctttaattattattcaatgaaaaaatatcaaaaaaaacaaagaagtgcctgcactggcaatcattcagatgaaaattaatagcaggctatgtaattttttgtaagttttccgcttgcattaaccctaaaaaaagcataaaaaggttacaatttagcaacattcgataaggttttaaatttacacacgtgatcgctttcacttctgtctggagagggaaatgaaaagactttctgtgttgttaaccataaaatctctaagtggatgtgcaggatcaccccttggtaatttaattatgaatcaacgataccagataagttcggatatcgctgcatcatgggtaggggcatcggcagatgaccttgttatgtcatgggggccaccacaaaacagcggaaccctgagtaacggtagcagcatactggcttacctgtacaggtggctattaaatggcagcgactcaaccacatggaattatattcctgaatatgcaacctgcgttcagcgttttctttttgaaaatggcctaataaccagatggtgttcttctggctattgtccgaaaaaacctgaaggtgcggagttgattccaaacacatcggtgacaagatcaacgctttaaagctacctgataataaaattgatatcaaataaatttgtcatgccagatttagttgatattaactttcattgaagttttatggtaaaaatacttgaaggttaaaatgaaaaaaaacataaaaaacattcaattatgctttataaaaaagtcaccgaaaactgtttccaacaaaagcataacggtcttcctttcagcgctaatcgcttttaatttttgttttttttctggcggtagtgcttatgcccagtctgctgcaatatcttctgccacagataatcaagaagattatgaagaaaacagtgacaaagcttctaattcagatagtagtgccctggcgctccctacaatgcatgtggtacttgaatgggagtggttgccaaatggtgaaaatcttgcacgtaagaattatcaagtgaaactcgatgcctgcaagggttccggcatgcctttcaaagcgctctcgtcacaagatgaggcccgactgggtaagggagaggtagagatattcattgatggacatcgtcaggttgctaaggaagtaaactggacgatgagcgctgaaggtgaggatgctcaacatgcctgtatgattacactcgcagaacacacagaccaaaacgaagttaaagacgctgcagatgaaggaatgtatcaggctatcgacagcgacagtcgtattcaaaatcatcagaatgcccagtctgtcggctggaaaatagcgggagaaaagcaatacaaaggtgttccctgtactgcctggagtaatggtaaacaggacgtctgtatgtggtcaggtggattaaaatggggttttgatgattctccaatgaatacagaggggtgttctgtaagcactgccggtgattttctcacttctatacctatagacgcgaagcctttaaacggtgcaagcggatgtttattcaaactcaagacatttgaccttaacaaaagctaactcacctttttatcgattcattaaagcggtcagtcattcacaactcatggagaaaaaaatgaaaagcatcatggttcttttcacaataatgttcgtattgacaggatgtagcacatcgggtggagaggataaatttagccgcacttatgtttcatcccatatcatagccaaaaaaactacacaggctgaagtcaaggcgctttatggcgtacctgacgatcaaagttcatcctcagatggttcggtcagctggcgttatagaaaaggtggaaacttaagtactgcgtcaagcgtcttaggatatattccgggcgtgagtgccctctcaagcgccgttggaatggcttcgagtgcgcaaggtgcctctgagtcaatgacaaaagcatccggcaaactgactggtaatacagaacagcatggtgattacttatcgatatggtttgataaaaacaacgttgtaacggattggtatttgtaaaatttgcagttaaggagtggggggatttaatctccccctcttttttaagtttttattgccgatgcgttgttaatagctttctttttctgtgagtgattgagtcagaatggattaaatcgttagcactatggcactgcgccacttctgtcagatttaatcttctcaatatatctttaatgtctgatcctgatccccagtttatcttttatatccaagagttatcggtttctatctggccgcattaaatgtatctggcagggaataaaatacaatgctctcccgtccatctttagtaatgcgtccggaccacgttcaaatacatattagactcttttctttaaatggctgaaattacgaacgctcagagaaataacaacgctggtgaaagatacccagacgctttttgtgaaaacctggaatgactatttcagttaaaacggtaaagttcgacgacagcaccatgtgggttgagctgagcgatggaagacatatgggtgtgccactggtttgctttccaaaatttctcaacgcatcagaacacgagagaaacgacttcgagctgagtaagcgtggtattcactgggatgcactcgatgaagacattttggtggatggtttactgtcgggtcgtagagatgttaaacatgctcccatttacgttgattgaaactaaatgaactcaggtgcaagctttagctggcacttttttgtgagttgttcgataaaaacgaagcagagcgaagattcttaagctgatttggtgccgtaattgtaattttcatgtcttcagtatagttaccaacctcgaagatttaacattaatcttatttaaccttttttcaaatttatgataaaaaaatagcactaacgcataggggaagtatatgacggctgcttattattgtaaaaatatgatttttggaatattttgtctttttattgtgggcagcaactggtttttacacccagaaagtgaaaagttacaaattctgtttgctctggctctaatcagttgcattctttaccccgtggcgaaaaaaacgatggagtgcatcgcattgaaattcactaacaggagcttctggcataagggtttgttgaaagacgatataggtaaaaacggactttacgctatttattgggtattttgtttcttctttgcaatacctctcagtctcatgtcgcctttcataatacgaaaaacagcctgacctggctcaggctgtttcactttttaactagagtcccagcttcgcattgatactgttcataaggtcatcattaaccattgcgccggttaaggccattagcaaagcgaagcttacgatgcccaacggcactccagttatcaatgtaaaactgaatgcgacaaggccagtagcgactttgcccgctgtcagagcctcaattttgacaaaaactgggcgccactggtcagtttcgaaagccttaatcacttcctgtaaaaggtcataggaatctgcaaatttcccatagtatccgagacctttagagtatttagcaagctgctccgccattgcagaatactgggtcgacttaagggcattagcaattgctgctctgtcttgggcactgtatcgccccccgagagaacctttatatctctcataagcagccaaagcttcatccacatttcgtaacgtttttcccttagcctgttccgcaaaatcctgcgcaagttgagaggcattttgactaaacttttgcgttaactcttggtaaaagtcagttgtgaatttaacagcgttagctatgtcttcacgcgtatagttgataattcctagttccttttgcgcttcacgggttttttgccgtgcctgataaatccttgtgccgtattgagtactgtttgcatacaccgcgttatccgcaatgatttttttcaattctgaaatgcgcgagtccgacgtgtctcccaggtaagcacctcccacagaagtattgccacttgtgccaccatctccaccgccacttccagtactgccaggtaatgggcccaggtttacgccctgagtgttatctgcaggttgtgctgtcaaaccaataacattgccatcaacattttgcacatacataacaaattgagcggggtcgagacctgcctggcgggctaaagaatcacctcttgaggtttcaactgatgcaactatacctcctccagaagaattgccgccgccgctactgctgctgtcgtgatctccagcgttgccattgctaccacctccgggtgcagggccgctgccgctttctgaactccatccagtaccatccccttgaccaccatagttaaatccagacatatttgttgacctcatatgttaagttaattcagtaatgcttaattaatatgcaggaaattagtctgcaaaattaagtattgtcataacgtaagcgtcgtctgacatagggtattaaacgcttataaattaatgacgtaaaaccgtgcgcgtttagtgatgcatgactaaacatcctttgctaaagttttaattttaataggaggagaagtatggaaggcaaaaaggggttatcttattacattgatatatataataaatttattttatactcagctaagcatttagataaaaaattagactgcttttgccagaagcgttttacttatgtgaagctggtattaaacggacctttgatgtcgcattatcctgaaaggtgaaaaaataaggtctcaaagagcctggtaagaatggcaggtctaaaagttctgaaaatgaggaagtgtgatgacgctatatgatgacctgcccccgagattagataaaacctttagttagtaatttcggttggttttactttatatttcccgtttcgccagtccgctgcaaattcagctggagtctggtaatccagcgatgaatgaggacggcactcgttataatcctgccgccagtcattaattgttttccgggtatgataaatgtcgctgaaccagtttttattcagacacttatcgcgatagcgtctgttaaaactctcaataaatccgttatgtgttggcttgcccggctggataagtcgggcaagccatgctcaaaagcccattgatcaagcgcgcggcatataaattccggaccctgatcggttcttatcgttgccggatagccacgaaagaacgcgatactttccagaatacgcgtgacctgaacgcctgaaataccgaaagcgttggtgatcgtcagacactccttcgtgaaatcatccacgcaggtcaggcacttaatccggcggccgctggcaagtacatctacgttgcgactgacctgttgcctctcacatgacttccacggcttctcacttctggtctgtcgtcagtactttcgccccagagccacctgaagtacctcattatccagcatggcttcggcaagcagcttcctgagtctggcattctcttcctcaggtgacttaaagcgcttaacctcaggcacctccatacttcttacgccatgtgtaaaacgtggcatctgaaatggcgtgtttacggcagagctcacaggcagaaactcctgcttcggcctcacggagaatactgatgatctgttcgtcggaaaaacgcttcttcatggggatgtcctcatgtggcttatgaagacattactaacatcacggtgtgttaatctacggggagcaggtcactgcttgttggtggcgtgctggctgtagtgacggcgccctttaagaagtccctctaaacgtagatgtgtacttacggaaatgtgcccggagagtctgcgctgctgcaggccttttttaggcgttcagggggatttaaaggtttttgccgagaacatgcacagtgacatgttgcgtagcagtgttatagaaattatttctgataaaggtcatcccctgtttttcataaaaaccacgcgctctggtgttttctttaagtacttcgagccacagaaaattactccctctttcttttgccatctcagcaacgttattcaatataagttggccgtagtttttcccggtcgtgccttctaaaagatagagttttttcagaagagtaccgtgtataggtgtgtccggaatattgcatcgccatataactttaacaaatccaatcggagccgaagtctcgactacataccagccagcagaaggatcgttaaggctgctttcgatcacctgtaacgaatattcctgcttaaggaattcatccagttcatctctgtgggtccagtactgctcaaaatgttgggtgtatgttctgacacccagctcgttcaggatcgaagcatcagaatgtcttgcttcgcgcagaattaatgtcattcatttatcccagacttaactttataggtcatcgtatcgtttaggggaaaagccagcgtccggcttcagccgactcaatcagcattctgacggtaagagcggcaggttcatgatggtcggtacgcatgaatttaggcagtatggcattaggcaggaagcgtatgccctcgttaggaaagtatttcctgaactcaaaatgggtcatgtcgacgccaaacttctctgcgtactcttcaataaaatcagcggcctcttcaggcagcaccatctgattccctgtactcagtgagacatcatctgccatttcccagaagtattttttaagcaggtttctgacctgaactgaagtttccatgagcttaatccttttcacccgttatcagtcggtagcgatgtatgacgttattcgtaatgatgtagatgtcacgggcagtaataacggcacctacccagggtacccagcgaccaacgtaagcgccaacgctcgtcgtgtaggcccatctcccccgtatcatgctaccgatagtcagcgtcctgcgctttttcgcaaatcgttttctgattagtttgcgcattgatattgagagagggctggtgccagtcgtggacgtcttcgcacccagttttcctgagacaggaataaatggcaggctggcaagcattgaggccacggcgagaagatccgtgatgttgctgaaggttttagtgaactcgtcaagaataagccacatcagcaactcttctttatccacactcataccatcaaagtaatacttcccgcccagctgttcggtcgtgtccatgcgacatcagctccacctgtaagtgcattgtgtagttaatcatcgcccagccgacgcgcttttcgccagaaaaaatctgcttttattttcagaaattcatcaagattttactgctgccaggcgtgcgcggttgcgtcattctcaccctgatctgttacctgtgagagccgtacatgtgccgttggcctcctttcattacgatgcctaacaatgcatgtctcattatgtcgttctctcttacagcgatccccattaatgcatttctggaatttagtacgagtttacctaccccgaacctgcttgttgctcctggcgatcggggcattgctcatcagtgctatcaccgcccatctgctccgtgcatcctttcgtagaaatctcgacaatcaccccaaacctggaaatcaaaaaccttaccatcacctaaatcgagtttactcacccactgaggcgcagctttaaaagccccaaaacgcaaaaacccccgccgaagcgagggtttcaaatttgtggtgcccgaacccggaatcgaaccagggacacggggattttcaatcccctgctctaccgactgagctattcgggcaacggggcgcattaaaccgtaaaggccgcaggccgtcaacggctttgataaaaaaaccacgtaaaacgtgactgattgcctgaatttcagtcaaagaggcaaaaactcaggccagcgcgccgtttttacggcagagagcgatgctcaatacgtcttccgccaggcgtttagccacgtcaacgtcctgcacgttacgtttaaccagcagtttgctcaggcagccttcgaggatcagctccatctgatcggcaaccatactggggttatccaggccaagcgaggtcaagatgctatgcgtaaattgccatgaggcgcgcttctgcttttctgccagttgatggatgggctggtcgggctgaggataaaaactgcaggcggcgataaacaggcagcctggaaagcggcccttgctgacctgctcgtttaatccttcatagcgagccatcagcttctggtccgggcgcagggcgtcattctgcaaaatgtcatgacgccactgtgcaatctgctgggcgtgaaactgcaatgcatcgtagagcagcgcgtcacgatcgggccagaattgctcaagctgcgtcaggctgagctgcatatcatcggccaggattttcagcgatgacgtggccgccagaccattttgctcaagtacgtttaatgcatggtcgagtatctgttcacgttgcaaatcgttttcctctggtattcaggcctgttttgatcaacagactgggtcctggttccagttttgtttactcacgcaatttctgcaaatgcgcacgaaaatcatctgccttcaggaagccagtgatacgcgatcccggaatctcttttccttgcgcatcaaagaacagaatcgtgggtaaccctagcacgttcaggtgctgcaacagcgcattatcggtggttgtgttcgccgtgacgttagcctgcaacaactgcacattgttcagactgtcacgaaccgcgctgtcgctaaaggtgtatttctcaaactctttacaggccacgcaccagtccgcatagagatccaccatggtgatgcgcccctgtgcttgctgcagggcctggtctacctgttcaacggtttgaacagactgaaagggaaggtgtgcgatgttttgctgcggcgcgccgctgccgaaagcccagtcctgcaacgggcgggcgctgatcagcgcggcggccagcataataatttgtaccacgcgccatttaccgccgctggcgcgtaagctggcactaaatgcccacgcaaagaacgccacgcccagcaggctccacaaacgcacgccccatagatcgccgagtatccgctccagcaggaagatcggcagcgcgagaatgacaaagccaaacccttctttgatggtctgcatccaggggccgcttttggggaggaagcgattaccaaacagcgtcacggcgatcagcggtaatcccataccgacagcatacagccacagggtgccagcaccggccagtagattaccgctctgggcgatatacagcagaatggcgctgagtggcgcggtggtgcagggcgaacagattaagcctgccagcgcgcccatcaggaaaacgcccggcagtgagccgccctgctgacggttgctccacagtgtcagtcgggtttgtacgctggcggggagctgaagcgagaaaaggccaaacatcgacagggctaacagaataaacagcaccgataagctgataagcacataaggatgctgtaaggccgcctgaaaacgcaggccagccgccgccacgatcacacccagcacggtataagtgagcgccatcccctgcacatagaccatggccagtgcaaacagcctgcccagcgaatagtgacgcttaccgccaaggatgatgccagagatcagtggatacatcggcaatacgcacggcgtaaaggcaacgccgataccaatcagcagcgcccacaggggtgaaaagggcaaaggactactggcgcttacagacttaacggctggcgcactggcggtggcagctacgggcgaaaggggaatgctgcgggtttcgggtggataacagaagcctgcggcggcacagccttgataagtcacgctgagggtcgccccttgcgccgcctgctgcagcatgacgggcacgctcagatcctggggataaatctcgcttttgccaaaaaattcgtcttcatgcggctggcccgcgggcagggctaagggcgcaatgcgggcatcatgggggacgaccttgatttgctggcgataaaggtaatagccgtctttgactttccagtgcagattaagctgcgagtcgtgctgatcgaaatcaaaggcaaaagcctgatcaacgggcagaaagcggctggtggtttttggggcaaacaggtcagcctgcgcctgcaggcagataaacagcgccaggaccagggtgattaagcgagagatgcgtgcagccatgacaagtattcactgtctccatgttgaaccggcagtaccagcagctctggtacatcgtaaggatgcgcgtgcttgagcaggtcgatcagggcctgctgatgcgcagtgtcgcatttgagtaacatctgaacttcgctggtctgctccagttggccctgccagatgtaacaggaggtcgctccgggtaagagggtgacacaggcggctaacctggcctgaagcgccagggttgccaactgttgcgcacaggcctgatccggggcagtacagaggatgactacggcgttcatcatgaggaatctcctggaaataacgccgatagtagcacgttcaccgcgccgctgtgattacagcaatagcccaccaaagataaagccacacatgacggacaaagtgatagccagcacgcccggaataataaaggcatgattgaacacaaacttaccgattcgggtcgaaccggtatcatccatctcgacagcggctaacagcgtgggataggtgggtaagacaaacagcgcagaaacggcggcaaaagaggcgatagccgtcagcggtgtcacgccaagcgctaacgcggcgggcagcagggcttttgcggtggccgcctgcgaatagagcagcatggaagagaagaacagcaccagcgccagcatccatgggtaggtttttagcgtgtcgcccgccagcatttgaatatctgtcagatgggctttcacaaaggtatcgccaagccaggctacgcccatcacacagatacaggcactcatgccggacttgaaggtgctggcgctgaggatagcaccggtatcaattttgcaggtcagactgatcagcgtagcaatggtgagcataaacacgacgatcgcctcattgcgcggcagcggcgggttagcgatcaggtggacgctttcgctggtgacggtggcgtaaatcaccacggcggcaataccgaccagaaagagcaggaccgattttttggccccgggcttcgcctggtaaaccgtggcaccgcgcagcgtcacttcgcctttagccagtcgcgcctgatagacctcatcatctttcagctctttacccaggaagttggtcaccagggcggcaagaaacagcccaaccatggtggccggaatggcaatcgccagcagcatgatatagctcaccccacgcggttccagcagcgtggcaaagaacaccactgcagcggaaatgggggaggcggtaatcgcgacctgagaggcgacaaccgcaattgataaaggccgggaagggcggacgccttgttccttcgccacttcggcaatgacgggtaaggtggagaatgcagtgtgaccggtgccagccagcagcgtcatcatataggtcaccagtggcgcaagaaaagtgacataacggggatgacggcgcagtaaccgctcggcaaggctgaccagataatccatcccgcccgccacctgcatggctgcaatcgcggcgatgacggccatgataatttcgattacatcaaaggggataacccccggcttcataccaaaacccagcgtcaggatcagcacgcccatgccgccggcaaacccaatgccgataccgccaaggcgcgcgcccagccaaatcgccagcaagacgataaacagctcaaccaagaacatgtgccactcccgaaattgtgatgagtcgacgagcaaactcatccttttaacaaacaaaaaggcacatcgttttgattacgatgtgccttttacatcagtaagtgcaattaagccttattgttcgttttcatcggtataacgtttggctttgtaaaccggatacatcaggttctgcacggagaaaatatcgtccagctcgctttcggtaagcaagccgcgctccagaaccacctcgcgcacgcttttaccggtttcggcgcaaattttgccgacgatgtcgccattatggtgaccaatgtacgggttcaggtaggtgacaataccaatggagttaaacacgtaggcttcacagaccgctttgttggccgtgatgccgttgatgcatttttccagcaggttgtaacaggcgttggtcaggatgctgaccgattcaaacagcgcctggccaatcaccggctccatcacgttaagctgcagctggccggcttcggaggccatcgtgaccgttgtatcgttgccgatcaccttaaagcacacttggttcaccacctcaggcacgaccggattcactttggcaggcatgatagaggaaccggcctgcagctccgggaggttgatttcattgagtccggcgcgcgggccagaagagagcaggcgcaggtcattacagattttagagagtttcaccgccaggcgcttcagggacgagtgcaccataacgtaggcaccgcagtcggaggtggcctctatcagatcttccgctggcaccaccgccaggttactgacctcggccagtttctgcacggctaactgttggtagccatctggcgtattcaggcgtgtaccgatggcggtcgcccccaggttaacctccagaagcagttcgccggtacgcaaaatgctcttggtctcttcatttagcagcacgctaaatgcgtggaattcctggccgagcgtcataggaacggcatcctgtaactgcgttcggcccatttttaagatggtctggaattcgtcagctttacgctggaagccctcggctaactgactgatgccgtcgagcagtttcaacagggagctgtaaaccgcgatgcgaaagccggtcgggtaagcatcattggtagactgacatttattaacgtgatcgtttggattcaggtactggtattcgcctttctgatgccccatcagctccaggccaatattcgccagcacctcattggtattcatattcaccgaggtgcccgcaccgccctgatacacatcgaccggaaactggtccatgcagcgacctttgtccagcacttcatcgcaggcctgaataatgatgttggcgatatcccgcggcagggtttgtagctctttgttagccattgccgctgcttttttcaccatcaccatgccgcgaacaaactcaggaatatcgctgattttgctgttgctgatgtaaaagttctcaatcgcacgcaaagtatgaacgccataataagcatccgccggaacttcgcgcatgcctaacaggtcttcttcgatacgaatgttgttcgccatgataaccttcttgttgtcactgctaaccatcgcagatgatgtgtttgttttgtggggaagcgccagaaccgctattttatccgtattcaggcgggtgagcacgatcctattctgacccagcccaaaagcgcgaacagagatcaccttactggcatcgttacgttaacaatatgtgaaatcgctcacaaatttaaccctgaagcaaaaatttgcctgatgtggttgaaatgggcggccttaatgaccatctctgtatcttgtcatcatgaatttacacgctgccgggcgatcaaccgggcagcctgactcacaggagaatccggtgcgctggttaccgttagtgatctttttcgtactggcctggattgagatctcgcttttcattcaggttgcacacgtcctcggcgtgctgctcactatgctgctggtggttttcacctcatgcattggcgtgtctttggttaaaaaccagggcatgaaaaactttatgctgatgcaggagaagctggcgcgtaacgaaagcccggcgcaggaaatggtgaaaagcgtttcgctgatcattgccggtttcctgctgctgctgccaggtttctttaccgacctgctgggcttgctgctgttactgccgccggtgcagaaacacctgacgttaaaattgatgccgcatctgcgcgtctggcgtggacccggtgcaggccctgacagtggttacacgatggacggcgagttcgaacgcaaagacagcgatcgtcttgaacatcatgacgatcctaaagatcgttaatctctgcctctcaggcgcgacctcaggtcgcgctttttgtttgtcttttagccagttcgcctggtttgtctaaaaagtcgccagttgtgccatcagactaaaaaaatttgtgggttgcccccttgaaagtgtcaggtcgcggccctatctctctggtcacgaggccggaagccacacagcccggtattcaacccaaaaatgaatgattggacttctcaaaggagagctatcaaatgaaaattcgtccattacacgatcgtgtcatcgtgaagcgtaaagaagttgaagctaagtcagcgggtggcattgtgctgaccggttctgcagcaggcaaatccactcgtggtgaagttctggctgtgggcaaaggccgtatccttgaaagtggcgaagtgaagccgctggacgtacaagttggtgacgtagtgatcttcagcgaaggctacggtgccaaaactgaaaaaatcgacaacgaagaagtcctgatcatctctgaaagcgacattctggcgattgttgaagcgtaagttttacgcgtaattcactgaacgaaacgaatttaagggaaatttgaaatggcagctaaagacgtaaaattcggtaatgacgcacgcgtaaaaatgttgcgtggcgtgaacgtactggcagatgcagtaaaagttaccctgggcccgaaaggccgtaacgtggttctggataaatcttttggtgcaccgaccatcactaaagatggtgtctctgttgcgcgtgaaatcgagctggaagacaagttcgaaaacatgggcgcacagatggtgaaagaagtggcctctaaagcgaacgacgctgcgggcgacggtaccaccactgcaaccgttctggcgcagtccatcatcaccgaaggcctgaaagccgttgcggcgggcatgaacccgatggatctgaagcgcggtatcgaccaggcggttatcgctgcggttgaagaactgaaaaaactgtctgtgccttgctcagactctaaagccattgctcaggttggtaccatctctgcgaactccgatgaaaccgtgggtacactgattgctcaggcaatggaaaaagtgggcaaagaaggcgttatcaccgttgaagaaggcaccggtctgcaggacgagctggacgtggttgaaggtatgcagttcgatcgcggctacctgtctccttacttcatcaacaagccagagacgggcgcaattgagctggaatcaccgttcatcctgctggctgacaagaaaatttctaacatccgtgaaatgctgccagtgctggaagccgttgcgaaagccggcaaacctctgctgatcatcgcggaagacgtcgaaggcgaagcgctggcgaccctggtggttaacaccatgcgcggtatcgtgaaagtggctgcggttaaagcgcctggcttcggcgaccgtcgtaaagccatgctgcaggatatcgctatcctgaccggtggtaccgttatctctgaagagatcggtatggaactggagaaagcagccctggaagatctgggtcaggcgaagcgtgtggtgatcaacaaagacaccaccaccatcattgatggcgtaggtgaagaggctactattcagggccgcgtaacccagattcgtcagcagatcgaagaagccacgtctgactacgacaaagaaaaactgcaggagcgcgtcgcgaaactggcaggcggtgttgccgtactgaaagtgggcgcagcaactgaagttgaaatgaaagagaaaaaagcccgcgttgaagatgccctgcacgcaacccgtgctgcggtagaagaaggcgtggttgcgggtggtggcgtggcgctggttcgcgttgcagcactgctgaccgagctgcgtggtcagaacgaagaccagaacgtgggtatcaaagttgcgctgcgcgcaatggaatcaccactgcgtcaaatcgtatctaacgccggcgaagagccttctgttgtagcaaacaacgtgaaagcaggcgacggtaactacggttataacgcgcagactgaagaatacggcaacatgatcgacttcggtattctggacccaaccaaagtgactcgctctgctctgcagtacgcggcgtcggttgctggcctgatgatcaccaccgaatgtatggtcactgacctgccgaaaggcgatgcaccagacttaggtgcaggcgctggcggtatgggtggcatgggcggtatgggcggcatgatgtaattgccctgacgcttgcgtcataagaacccccgatcggaaacggtcgggggtttttcttttgctgaggaaaaggtataagtagtggcgcaacggtgacgttggcacggattagggcaatgaatgttcagaaaaaatgcgtgtttttctgctacgctgccatccgacactgatgataataaatggggattataatgcgtattaacctcttgctcggtcttacggctggtgcgttattgcttacaggctgcagcagctctaccgacctgacttctgctggtcagcgcgtcacctttaccgaccagcaacctggcaaacaatgtcagcttctgggtagcctgaccggctcgcaaagtaactggttaagcggagccggtggtgaaaccagcgcactgcgtggtgcagctaacgacctgcgtaaccgtgcagcagagatgggcggcaatgtcatttatggtgcgaccagcccgacacaaaatctgctgtcagcctttgcaccactcgacagcaaaatgactggccaggtttataagtgccctaactgattgtccgctgaataagcagagttttttgagacgaccggcctgcgagccggtcgtttttttatggctgatgtgtggtcgccgtattcacgacctgtgatgtgccagcggatgccggacgcgaccttccgcgtgcgtggtctgtccgggcggccatgagcatgcatgattgaccgcccaggcgactgcgtttttattcctgacgaagctgtaaatccagcggcgttttgctcggctcgccgccgatttctcgtgccagcttaggcaccagataaccggagactaagggcaacaggccgcgcatcagcgcgcgggcttcctcatcggaaacatagaaatgcgccgcgccctgcaccttgtccagcacatgcaggtagtagggcagaatgccggcattgaacagcgcattgctcagcgccgccagggtttgcgcctcatcattcacgccgcgcagcagcacgctctgattaagcagcgtaacgccagcacgtttcaggcgcagcatggcatcgcagagtgcctcatcaatctcacgggcgtggttgatatgggttaccatcaatacctgaagccgcgtctcagccagcatctgacacagcgttgccgtgatgcgatccggaatcaccaccggcagtcggctgtgaatacgtagccgtttcagatgcgggatagcggccagcgcgtcaatgagccaggccagctcatgatcttttgccattaagggatcgccgccggaaaagataatctcatccagttccggatgagcggcaatataatccagcgcggcctgccagttacgcttgttgccctgattatcctggtaaggaaaatgacggcgaaagcagtaacggcagttcacggcgcagccgcctttgaccaacagcaaggcacgattgttatatttgtgcagtaatcccggcaccacgctattttgttcatcgagtggatcggtgctataacctggcgcgtcgataaactcctgacggctggtcagtacctgtagcaggagcgggtcccgtgcatcgccttttttcatccgttggataaaggcgcgcggcacgcgcagcgcaaaaagtcggcgtgcgtcactgccagcagccagatccggatgatggtcgagcgctaaaagttgcagtaattcatgaggatcagtgacaacatcagcaagttgctgcaaccaatcttctctggaaggggaatttagggttacaatgtgtgccatttttttggctattaccagttaatatctacagagggcctttatggcgacttatcttagcaacgatttccgtcccggtcttaaaatcatgttcgaaggcgaaccttatgccatcgaatcaagcgagttcgttaagccgggtaaaggtcaggcgtttgcacgtgtaaaaatgcgtcgtctgctgaccggttcacgcgttgaaaaaaccttcaaatcaacggattctgccgaaggcgcagacgtgaaggatatgacgctgcagtattcttacaacgacggtgatttctactacttcatgcaccctgaaagctttgagcagtatcaggttgaagcaaaagtgctggacgaagtacagaagtggttgcaggacaacgcggagtgtatcgtaaccttatggaacgataaaccgattgcggttcagccaccaaactttgttgaggcagaagtcattgaaaccgacccaggcctgaaaggtgataccgcaggtacaggcggcaagccagcgacactgtcaacgggtgcagtcattaaagtgccattgttcgtgcagattggtgaggtggtgaaagttgacacccgctctggcgaatacgtgtcacgcgtaaaataaacatgaaaggcgcattctctgatgcgcctttttcttgagtgagttcaccatgaaaaaacgggcaaaacttatcgcgttggcgttgcttgtcacttctggactaagcgcctgtaacaccttccacggttttggcgaagatgtttctcacttgggcggcgctatctctcgcgcggctaaataacttatccacgtttcctttttccgcagctcaggctcgcggcgttgcgtaatcagtctatgctttaaaagctgtacttataatgcaatcaaaaaggatatggatatgttaaagaaaagtattgttgcgattttctctgtgatgatgttctctgcactgctttctggctgcaacaccacgcgcggcgtcggcgaagacgttgaagcgggcggccacgcgattcagcgcagtgcgcagtaaatgaaaaaaccggtacgaaccttttcgtaccggctttcttttatccctgcttaacccaaatcagctcatcaaccgggaaaccggcctggcgtgcctgctgcaccagcttttgtttcacgccttcatccaactgcggcgtccgtgacagaatccacagatagtggcggttagggccgcataccagcgcatattggtagtcggaatccagcgctatcacgttgtagccaccgtaaaatggaccaaagaacgagaccttcagcgccgcacgctgcttgtcgccagtaaagtaagctttgcctacgctttcctgccaacgctgttttttgacgttatagccgcgattaacaactttcagaccgccatcctcacgcgggctgtaatttgccgtgacctgttccaggccgcgttcaaagccatgatccagccgggcgatctcgtaccactgaccgaggtaacgctggctgtcgaagttttcaatgacggtaacgtttttcggcggggtagttgagcaggcaacagacagaaatgcacttacgctggcgaccaatgttttccatggagacataaaaagattcctttgtgatttagcctgttaattatagaacccccgccgtttcctggacaggtttgcgccacgattgtttgccacccacattgcgagtagacttccctcccttatttgtatctggagtcatcaccatgagtgaaacggcaagctggcaacctggcgcttccattgccaatttaattaaacgcgcagccatcattgctgaagtacgtcgtttcttcgccgatcgtggcgtactggaagtcgacacgccagcgatgagtcaggccacaataactgacatccatctggtgcccttccagacgcgctttgtcgggcctggcatgtccgaaggccgcgacctctggctgatgaccagcccggaataccacatgaaacgcctgctggctgccgggagtggacccatctatcaaatgggccgcagcttccgcaatgaagaggccggacggtatcacaaccctgagttcaccatgctggagtggtatcgcccccactatgatatgtaccggttgatgaatgaagttgatgatctgctgcagcaggtgctggagtgtgacagcgcagagtcgctctcttatcagcaggcctttattcgccaccttgagctggacccgctttccgctgacaaagcgcagctgcgcgaagcggcggaaaaactgggtgagggcgagctggcgagccgggaagacgatcgcgataccttgctgatgctgctgtttatgctgggcgtggaacccaaaattggccaggacaagccgtgctttatctatcactttccggccagccaggcggcattagcggagatcagcaccgaagatcatcgggtggctgaacgctttgaggtttactacaaaggtattgagctggcgaatggtttccgtgaactcaccgacagccgtgaacagcgtcagcgctttgaacaggataaccgtcggcgtgcggcgcgcggtctgccgcaacatcccattgatacctacctgctggccgcgctggaacacggtatgccggccagttctggcgtcgctctgggtgtggatcgtttgatcatgctggcactgaacgcagaatcgctgtctgaggtgatcgcgtttccggtagaccgctgctaagtcttgccgccccagccctgaaaaccggcgcagctgaaaagccgcgccgcgcaggcagaacaccaggagggccaggattgcccttcaccgcattgcgccgggcgccggcttacctgacctactgactgttatcgggaaactccagaatcgttaccggcagcgtcagcttcttgtcattgcgcagcacctggacatcaactaccgatccggggcgaatttcagcaacctggtccatggtttcctgtgccgatatagccggtttaccgtctacgctcagcagcacatcatttgcctgaataccggctttctcagcaggcccgccgggggtaaccacgctgacgataatgccctgaacccgatcaagactgttgccctgaccgtgtaacggcggcacctctcgggcggtgatcccgatatagccgcgtatcacccgaccatcgcggatcagcttatccatgattttggacgccagcggcgtgggaatagcaaaaccgatcccctctggcgtttcgccatcgctgcttttatcgaacgtcagggtgttaatgcccataagttcgcccagggagttgatcagcgcaccgcctgaattcccctgattgatggaggcatcggtttgcaggaagttctggcggcctgaagagctaagcccaacacggcctgtcgcactgataatgccttgggtaaccgtttgtcccaggttgtagggattgccgatagccatcaccacatcgccaatatgcgcgacgcgtttgggattaatggggataaccggcagattagaagcggtaattttcaacacggccaaatcggtcatggcatctgaaccgaccagagtggcttcaaaaaagcggccatcctgcagggcgacgattatctgatcggcattgttgatgacgtgcttgttggtcaggatgtagcccttggtattcataatcacgcccgaacccagcgtggtgataccgtggttgttgttcccatgtgcgctgcggttgtaaacgttcacaacggcaggcacggcacgcctcaccccttgattaaagccaaagggcgtttcgtcgttactgtcattttgactatacagggcagcactgcccaaacgcagtgcgggcagcgccacgagcaagatgcccgcaacaatcagtcccaacaccactgaacgcaagagtttaagaaacatggtgttaaatcacgtcaggggagaacgctggggagaataacatgagagcggcggacacacacgcgcttgtgtccgccgtaatgcgtggtttatctcaataacagatagatactttcttcaccgcgtaccacattcagtgccatcaccggtggtttggcttccagcaccttgcgcatttcggcaatgttctgaacccgcgtgcggttgactccaatgataacgtcatctttttgcagaccgacctgctcggcgggcgtccctttttcgatggcatcaattttcacgcctttatcgccggtcttggtctgaccgtcgctcagcgttgcgccttgcagtgccggagaaagcagctgtgcgctggctgtcgtctgggcactttgctcaagggtgacatcgacgctcaccggtttcccttcacgcaacaggccaagcttaactttctcgcccggtgccgttgtgccgattttcacccgcagttctgcgaagctggtgatcggtttgtcgttgaccgaaacgatgatatcgcccgacttgataccggctttttgggcagcagactgcggcagcacttcagagacgaatgcgccacgctgagcgtccacgttaaacgccttggcgatatctgcggtcatctcagtgcctttaatccccaactgaccccgtttcacttcgccgtacttaatcagctgctgtgccaggttcattgccatatcgctgggaatagcaaagccaataccgatattgccgccgctggaggccagaatggcggtattaatgccgatcagctcgccgttcaggttaaccagtgcgccacccgagttgccccggttaatggcggcgtcggtctgaataaagttttccagcccttcgagattcaggccactgcggcccagcgctgagataatccctgaggttgccgtctgacccaggccaaagggattaccaatggcaacggcaaagtcgccgactttgagttgatcagaatcggccacttttatctgtgtcaggtttttcgcgccctgaatctgaatcagggcaatatcggtctgctcatcgtgaccaatgagtttggcatcatattcactgccgtcgccgagctgaacgttgattttgtcagcaccattgaccacgtgattgttggtcagaacgtagcccttggcggcatcaatgatgacaccggaacccagtccctcaaagggttgaggctgggctggtccgccgccaggcaactggccgaagaagcgtttcagcggctcggggatatcctgagcctgggcctgggaatcagactgcgtgccttcaacatgcacactgaccaccgcaggtaacactttttccagcattggggccaggctcggcaggggctggctctgaatctgtgcgggcagcgtcgccatcgcgccgggcgcagcggcaagactcattccaatactcaaggctaatgcgcttaacagtcgtgcttgttttttcattgctacaacgctctcgctgcaaaaagtggggggaataaatcaatgagacagccgtttgtggccggggttcgcaaaaacagcgggcacagcgtggctgtgcccgataagcttagtcgcggacggcgcgttcaccacgcagtaaaccggaggcgccttcagaataatcacgcggcatctgcaccggtgcctgatcgttatcggcttctgcttcggtcagttgccatgcaaagggatttttatccccaggcatattgggcagcagatcgttggaacctttcgccatatgctgatagagctgacgataatcgcgcgccatgttatccagcagctctgcgctttgcgcaaagtgattggtcagctcctgacgataatctgccagctcggccttggtcttatccagttcatactgcatgctgcgctgctcacgcagcttccggttgccaaaacgcattgccactgcgccgacaataatacctaccactaaaccaattagcccgtattcccaggtcataatgactcccgtgttatttccgttgttccgtagggcgttgcaccacttaatagtagtcactatacccgttaatcttatggatgtggaactctggagcgccatgccttagtgtagagcggcctttttttcgacaaacgacgtttgaacaagacaaaattcagggacactgagagaaccatgcaaacctcatctccgcttgcccgctacgagcaggcgctatcacagggcgatttcaagcccgacgatgtacaacgtgaagcgattacccgcttagatgctatccagcaagggctgatcgcgcgtcagcataacaccgaacccgcctcatcagggttgttaggtcgtctgtcgaagctggtacgaaaagagacgtcacacgccaaagcgcccgttcgtggcttgtatatgtggggcggcgttggccgcgggaaaacctgggtaatggatctgttttttcagtctattcctggcgaccgcaaactgcgtttgcacttccaccgctttatgctgcgtgtgcatgaagaactaacagaactgcaggggcacagcgatccgctactcatcatcgccgaccgcttcaaggctgaaaccgatattctctgttttgacgagttttttgtttctgacatcactgacgccatgctgctgggtacgctgatggaagcgctgtttgcgcgcggcatcagtctggtcgcaacctcgaacatcccgcctgataacctgtataaaaacggcctgcagcgtgcacgcttcctgcctgccattgagcagattaagcaacactgcgaggtgatgaacgtcgatgcgggtattgattaccgtctgcgtacgctgacgtcagcacatttatggaagttccccctggcacctgacacgtacgctgagatggatcgcctgtttcaggcgctgtcaggcgaaaaacgcggtgaagcgccggtgctggaaatcaaccatcgtaaaatggcaacgatgggcgtagcggaaggggtgattgccattgatttcaaaacgctgtgcggagaagggcgcagccagcatgattacattgagctgtcgcgccgctttcacagcgtcctgctgtttgatgtgccggtgatgatctacaaaacggaagatcaggcgcgacgttttctggcactggtcgacgagttttatgagcgccatgtcaaactcgtcgtggcggcagaaacttcgctgtttgaaatttatcagggctcgcgcctgaaatttgaatatcagcgctgtttgtcgcgtctgcaggaaatgcagagcgaggagtacctgcggctggcgcatttaccctgagattacgcgtaataaatgaaaatagggttcgatttttgtaatcgacttctctataatcttgcgaccccacgttacagcacaggatttttttcccaaatcctctgcgttccggtaacgctatccgaaggggtggcttgctggtcaaaatggtcgtgtgagcctcattcgtttacttaagcgtttgggatttcaccaacgtgtaacttaatttgggtaagcttttcgatgaaaacttttacagctaaaccagaaaccgtccaacgtgactggtatgttgttgacgcaactggcaaaaccttgggtcgcctggcgactgaactggcgcgccgtctgcgtggtaaacataaagcggaatacactccgcacgttgatactggtgattacatcatcgttctgaacgctgaaaaagttgctgtaaccggcaacaagcgtactgacaagatctactatcaccacaccggccacatcggtggtatcaaacaggcgacctttgaagagatgattgctcgccgtcctgagcgtgtgattgagatcgcggttaaaggcatgctgccgaagggcccgctgggtcgtgctatgtatcgtaaactgaaagtttacgcaggcaacgagcacacccatgcggcacagcaaccgcaagttcttgacatttaatcgggattaaaggcaatggctgaaactcaaaactacggcactggtcgccgcaaaagctctaccgctcgcgtatttattaagccgggtagcggtaacatcgttattaaccaacgttctctggaacagtacttcggtcgcgaaactgcccgcatggtagttcgtcagccgcttgagctgctggacctggttggtaaattcgatctgttcgtcaccgttaaaggtggcggtatctctggtcaggcaggtgcgatccgtcatggtatcacccgcgctctgatggagtatgatgagtcactgcgtggcgaactgcgtaaagcaggcttcgttacccgtgatgctcgtcaggttgaacgtaagaaagtcggtctgcgtaaagcacgtcgtcgtcctcagttctccaaacgttaattgttgctgcttcggcagacacagttggcaaaaaacccgcttcggcgggttttttattttatgcatcaggtcgccctgtcgcataaaaccacaatactgttcgcattttgcccgcaaaaatgcattcccccacccacaagctgcctaaaatctggtaaactctgtgtcactttgcgcccgcaagctggcgcgttatgcgcctggcatttgtcgggggtggttagcgcgaattgcgagcgagttctatgagcaggtgagtcgccgtgtggttggctattcgcagtaactttttgtgaacaaactgggaggttttcatggctgtcgctgccaacaaacgttcggtaatgacgctgttttctggtcctactgacatttttagccatcaggtacgtattgtgcttgccgagaaaggtgtcagcgtagagatcgagcaggtcgaaatggataacctgccgcaggatctgattgacctcaatccgtaccgcaccgtgccgacgctggtagatcgcgaactgacgctgtacgaatcacgcatcatcatggaatatctggatgagcgttttccacacccaccgttgatgcctgtttaccccgtcgcgcgtggcgaaagccgtttgatgatgcaccgtatcgaacaagactggtacagcctgatgagaaaggttgagaacagcagtggtcaggaagctgaagcggcgcgtaagcagctgcgtgaagagttactggcgattgcccctctgtttggacggacgccattctttatgagcgacgagttcagcctggttgactgctatctggcaccgctgctgtggcgtttaccgtcaatgggtatcgatctgctcggttcaggctccaaagagctgaaaggctatatgaaccgcgtatttgagcgtgactccttccttgcttcactgactgaagctgaacgtgaaatgcgcctgcaagcccggggctgatttatggaaatgtcacaactcacagcccgtcggccttatttactgcgtgctttctatgactggttactggataaccagctcacaccgcatttggtcgtcgacatcaatctgcctggtgttcaggtgccactggaatatgcacgtgatggtcagattgtattgaacattgcgccgcgtgccgtcggtaatcttgacctgggtaacgatgaggtttcgtttaacgcacgttttggtggcgttccgcgtcaggtgaacgtcccgatggcggctatactcgctatctacgcgcgtgaaaacggtgcaggcacgatgtttgaacctgaaccggcctacgaaggcgggacgcaggaattcccagagaatcaggaagaaacggtgatgtcagtcattgacggcgaccgccctgatgatgccagcgatgatgatcattcacccgatgacgatccgccgccacgtggtggccgtcccgcactgcgtgtggtgaaataacacagcatgcccgtcacctcgacgggtatttttttgcctgccagatagcgcgtttttgcctgccagagagcaggcataaaaaaatccgggaacacaggttacccggatttttgctttctgcggcagggattaataaacgtcgcgcaggtagcgtttctctttcttcagctgatcgatgtagtcggccgctcgctcgctggacagcccgccaaactggcgcacgatttcatacagcgcgctatcgacatctttcgccatgcgtgatgcatcgccacagacgtagaagtagcccccttcctgtagccaggcatagagctctgcgccctgttccagcatccggttctgcacatagattttcttgtcctgatcgcgcgagaaggccagatcaagacgcgtgagcaaaccgctctcctgccaggctgtgagctcttcgcgataaatgaagtcatgctcctgatgctgatcgccaaagaacagccagttcttgccctgggcacctgtcacctgacgctcctgcaaaaacgcacggaacggcgcgatgcccgtacccggtcccaccataatcaacggggcattgccgttggcgggcacacggaaggctttattaggcgaaataaagatcgcgggtttttcaccacggcgcacgcgctctgccaggtaggttgagcacacaccgctacggttacggccaccgctgtgatagcgcacagaggcaatggtcaggtgcacctgattaggatgcgcttttgagctggatgaaatggagtaggcacggtgctgcaacgggcgcagcagggcaacaaactctgtcacgctcaggctacgcgttagctcaagctgcagcagatccagcgtatctttgccccacagccagacgcccagggcatctttatcatcatgctgaaggacatggcgcagctcctggttggtggtattttgtcctacccactcaatcagcttgcgtgatggctcagaaatttcaaactggtaggtcagcaggtcgcccagacttctgtcgaaacccggcaccggcgtctgataatcggcgtttaactgcgtaagcagcaggttaaccagcgacggttcgttgaccggaatcacgccaagcgcgtcaccggcttcatacttgagaccgctgtcgctaagatcaaactcgaagtggcgaatgtccttagctgactgttcgctcgacaggcgcttgttggtgatcagggcagccgcataggggttggatttgttgctgccaggaatgacgggtgcttccggggcgctctccagcaccgtgccgctgctgcctgcgctgctggcaaactgtggcatcgtgctgttcagccattcattcgacggctcttcgtaatcaatatcgcagtcgatacggtcgacaacgcgttttgcaccaagctgttccagacgcatatccaggaacttacctgcctggcagaatccgtcataaccggtatcgccaatggccagcacggcgaagtgcatctgctccaggcgcggcgcagtgctggctgaaatcgcgtcccaaaacagctgggcgttgtcgggcatttcaccttcgccataggttgaggtgacaatcagcacgtggcgcatggtggcgaacacgtcgagatccacatcgcctaatgcctgaacgacgggcaccagacctttggctcgggctgatttcgccgctgactgggccagcgcctcagcattgccggtctgagaaccataaaggatgtgcagttgggtggtggcggcagcactgctgcccgccgctggctgctgtttatcttccagcaccaacaaacgggagtgcaggccagccagaaagcccgccagccagtatttctggtcaccattaaaaggtgcatcttcaggaatatatggaattttcatggatacctttactcaatcccgctcttgaccgtcatacgtcgccgtgtcgatggcagtcggttcctgcgcgctcagcagcttgctgctgagcggataaggttgccgctgcgcccggtacgacgaataaatccgggtaatcatgattaaacacagttctgttcactgactctgctgtcaggccagtttacccaccgctgctgcaatttcaggtaacgctgcacgtgcaaacaactcttcaaaatcaggcaggcgaccgaggatttcacggttgcaggcatcctgatacatgatccagccataggtggccaggctgtccatcgagcggatgttacgttgcgtcagtgctgctttataatcggacatgcgttttgaaccgatcaggctggccaactcgctgtcactgtagttttcaatcgctgctcgcgcatggcgttgcagtttactgatcagagaaaagtcttctgtcatcagcaaattgcggacggctttctccacggcaggggcctcaactgaggtgcctttcggtaacttacctaatgccagctgctgcgcaaagctcagtacggtgtagttgttgagcaaaacaaacatttcctgcgtatcggtcgccccgtaggccggcaccgcaccgtcagcaatagttttgccttcacgccaggcggctttgaatttggctacctgatgggcagccagcgccgtcgacagttcttccagcaaatccttacgggatttcgccttcagaatttcaccgccgtcctgataaagcagcagagaacgtggcatcacgtaaacaaagtgctgacactcggtttcccagtgttccagcagccaggcggcacgcggagactgcgtggccgcaaggtgccagttcagcatggtccagaccgcctgcttatggatctgcgccagctcatcctggtcggcaatggagccaaacaggacagaatcgcctgccgcatggttggccagtgagccatagggatcgtactggtaagcaaaaccgccgctcatgccgttaccgaagcctttaccaaaagtgcccaggtttaacactgcgccgttggtcatatattcgcagcagaagtcaccgacgccttccaccacggcagttgcaccggagttacgtaccgcgaaacggtcgcccgcctggccctgaacgaacagacggccgccggttgcgccaaacagggcgaagttaccgatcaggacgttgccatcgctgtcctgtgcgccgccaccgggtgataacaccaccagttcgccgccgcactggcctttaccgacgccatcgttacaggtgccacgatgtttcatcaccatgccgtcattgcagaatgcaccaaaggactgacctgctgagcctgttgtggtgatgtttaccgtttcaggtgccaggtagcaacgaccgcgatcgtcctgcagcacggccggcatcgcctggatctgtgccgccgtcagggtgtgattcagcatgcgctcaatatcgatagctaactgaccgcccacgcttttattgcggttgttaagcacgacctcgtggcccaactgcagcgttgttttgccctgttccaccagctgctggctgagctcttcaacccagatgtcatccagctcaaaatctttttccaggtaaaccggcttgtcgattttcagttctggcaccacggtgagcatcgcgcgcagatccagcttgcccacttccagcgggtgatccatcaggtggagcagatcggcgcgaccacgcgcttcacgcagggagcgcaggcccatccgcgccagaatctcacgcacttcgtgtgcgacgttcaggaagtactgtgcgagctgacgtggatcgccatcaaacgcttcggcgttcgtggttaaccctgccgggcatttgacgttacagtttttcgccatcacgcatttcagcatcatcagcgcagtggtaccaaactcaaagctgtcgccgcccagcagcgcggatttcactacatcgctgccggtttgctgtgcgccggagcagcgcagcagcactttgtcgcgcagaccgtttgcacacagcgcctgatggacttcggcgatgccgatttccgctacgcgcccggtatatttcaggctggtcaccgaggccgcgcctgtgccgccggtgttaccggcaacgttaatcacgtcagcaccggcttttgccacgccgacggcaatggtgccaattccctcggaggacaccagcttcacaatgacgcgtacgcgggccgctttacagtcgtgaatcagctgcgccagatcttcaattgagtaagtatcgtggtgcggcggaggagaaaccagctcaacgcccggcgtgccgccacgcgctgctgcgatctccacggtcactttggccgctggaagctggccgccttcgccgggcttcgcaccctggccgattttgatctccagctcttccagcatcggatcggcaaggtaagccgcccagacaccgaagcggccagaggccagctgtttgatgcgtgaggcacgaatggtgccgtgacgcgagtagtgttcgccgccttcaccgcagttgctcatgccgccgaccatattggtgccgtgcgcgaccgcttcatgcgccggagccaccagcgcgccgtggctcattgcgccagaggcgaatgtgcgggtgatttcgcacgcgggttgaatatcgctcagcggcagcgacggcagcgcggtaaagatacgtgacagatagtctgccgctttgccgctggcggtcactttcaggccaccggcgaccacctcagccgtttcaatttcgtcattaaagcgggctttcagcgcacgagacaggttaagcaggcgctcgctctccggcttcagcccgacaatcgcatcggtaagacgcaacataaaggcgttctggctgccttcaatggcatcacataccagaccgcgcgtggcaaagccgttgttggtcagcgagtagcgacccagcttacgccggaattcggcttcactgtcgatgtgggtcaggtccgccgggaaggccagaatatcgcgcagtgcagcgggacggcgcttgcgctcttcatacatcaggctggagaactgacgataatcggccgtaatggcaaaattattcatcacgtcatccgggatgcgctcaaagctgctgtctttgaatgtctctggcttgatgccaaaggcattgtccagacgggccagcgtcatcagccgaataaagttatcctcttcacgcgctttgtccgcgaagcgaatcggttcttcagtcatatcaataaaggtgcgtacggcaatggtgccgtaagagtggcctgcgccttctgcacgctctttaaacagccccagcagtggcacttcggattcgccctgaattttcagtgcgctttgatgccagtccaccgccatctgcgcgatagtggcaaagcctgcgccgccgacgggcgttttgatattggggtaatactttctcaggaccggatcgtccgtattcaggaagttaggctcaaagaattccccgctactgtagctctctacggtacacaggccgactttgcccatggttttcatcagggctttttcagcggctttggcgtagcgtttaaaggctttattgccttcctcgccttcaccaaatttttcctcagcgcgcatttgcacgccaagcggataaacggccgatgcgccaaagcccagcgtggcagcaatatgatgggaagagataatctgcccactctctaccaccagtgaaacgtcaagacgtaagccttcctgcaccagacgctggttaaccgcagagataaccagcagcattggcagggccgcttgcgtggaggagatatggcgatcggtcagtaccgcgatgccgccctgtgaacgggcaaaatccaccacctgctgggccagatcgtcaatcgctttttccagcgcactggcgttggccgtgcggctgagcaggtctttgccgattaccggttcgtacagcatgtcaaagcgggcataaggcgcgacgttctgttcacgcagctgtagcatgtccagatgggtcagaatcggcgtaggcacgatgatctggcggcctttactgcgtcccagatgcggtttcgcccccaaggctacgcgcagcgtcatgccgtccgcttcacgaatggagtccagcggcgggttggttacctgggcaaagcgctgtgagaaatagtgcgccatgccaccttcatgatcggacaggccgttgatggcgttgccgtaacccatcgccgagattttctctgcgccggtgttcagcatggggtccatcatgaacttgaagctttcctggttgtagtagtaagccacgaaacgctgataggttttcagatcgccacgatagcgcaggggagagccctgttgttccgcgggaatgaccggcaactcttgcaaatcaacacgcgatttgctgaccaatgcggcatagtctttttctgcagccagtttttccagcgcctcatgcgtggtgtaactgcgcttttcgcgatgatcaaaatagagcatcccgccagcttcgatacgaccacggcgcagcacgctttcaggtgggaacgcgatctggcccgcttcagacatggcgccaatatactccgccgtttcaaccgaacgcagtggacgcagccccaggcgatcaagacgtgcaccaatcacttcgccgttaccaaagatgagcgcggcagggccatcgtttttctcttcgtacagcgaaaaatactccagcatgtcgcggacggcaggggagagcgcggtatcgttttcccaggccgggggcatcatggaaaccacggcggtgatcagatccagatcgtcttccatcaaccggctgtgaatactctggtccaggcgcgaactgtcagactgaccttttggtcgtacaatcgttttgccacgggcagaggccagcgcggattcggcgatacggtttttacggtcggtattcagctcaccattatgggccatcaaccggaaaggttgcgccatggtggtgtgcggatcggtattggttgagaagcgagtgtggaaaaacagtccgcgtacctgatgatcgggatcggtcagatccttgaagtaaggaatcacttcattcgagttcaggcgggctttaaagacttgtgtgcgggatgacagcgacagcggatataacccgccgaactcgctttgggtaaaggcctgcgcctcaatggtcaacagtgcgcgatagatctttttttcaaaatcactttggtcactgatgtcctgaggtgcggcaaaaatccactgcacaataggaagctgaaactgcacggcagccggacgtgtcacactgttatccagcggcatttcgcgtttcatgataaccggcaggttaaaacggcttaacgtctcttctaccaaacgttcggcattggcgcgcagttcaacgtctttaggaacgaaaaagttaccgacgccaaagcgaccggcttccagcgcctgaccggtaattttacggaagaaatgcagtgaaagatcgacgttaacgcctgcgccatcgccaacgccctcagcagacatgccaccgcggtgcggcaccgtgcagagcgcgctgtgcgccatacgcagaatttcatgggtctgctcgccgtccttacgggtaatgaaacctacaccacagctgtcacttcctgctgctgggttatataagccataggaatcaggttttttactggacattgagggtctccttaaactgctctagacattacctgcattgtttcaggcactgagttcaactacacaatcttcccagcgcaaattctttcatttccgcgcctgacagcctgcgcggttgggttttgcgcacttttcagcgtcaggaggagatgccccttgatgcgtagtgcgtgttttttccgttctcgaaaggagatgactcaaaccatgtggacgtcatgttgcatagatatgccgtgacgcgtgcccatcatgaaagctttcagcggaattccaacttatcgggaaagcgaatcgaggtcaaatagcgagtctgacacagtttaacctcgcttttatgtcgttaacctaatgaaattattatgtttttatgtctaaaatgtgtcagtttttcactaaggtacaagggatgaaatgtgaactgtatcactgtgctgtaggcgtgaaatcacttaagtatgctggagacgaggtgctaaacagcatcaaatgctgctgcaggcagtggaagcgcaggatgtatctgtttttcttatagcagcaaatttgaatgaataagggcggcatgattagcaaaattaattacggtaggttgcttaaaactacgatttatatgaatgagtatgcataaaaagcaggaaatcgcggcaaagggacgttgccgggcgaaaaaagacgagcagataagacgcgcctttttgacaggcggccgtacagattcattgagttagcacaattagtcaagggttttagcggtaaggtcatgaacgtcggcgaagcaaccgccttttgcaccattaaagtgcgttagcgctgcgatctcaccggatgcattgcgacgatcgcgaagtaaatacgctatcatgtgcctgttctcatccagggagtgtttatgaaacagattcgcctgctggcgcaatattatgttgatttgatggtcaagcttggcctggtacgtttctcgctgttactggcgtcggcgctggtcgtgctggccatgattgttcagatggccgtgaccatggtgctgcgtggtcatgttgaaagtatcgatatggtccgatcggtcttttttggtctgctcatcaccccttgggcggtctactttctttctgtcgtcgtggatcaactggaagagtcacgccagcgcctggcacggctggtggataagctggaagagatgcgtacgcgcgatcttgaactgaaccagcagatgaaagagaccatttcccagctcaatcaggaaatcaccgaccgtaaaaaagccgaagaggcacgtgagcaggtgatggcgaagctgcgcgaagaggtcgctcgtcgcgaacaggcgcaaatcgaactggagcaacagtcctcctttctgcgctctttcctggatgcgtcaccggacctggtcttttatcgcaacatcgacaaacagttctcaggctgtaaccgcgccatggaactgttaaccggcaaaagcgaaaaacagctgattgggcttacgccacgcgacatctatgacaatgacacggccaccaaagtccttgaaaccgatgaaaaggtcttccggcataacgtgtcactcacctatgaacagtggttgcagtatcccgatgggcgtaaagcctgttttgagatccgcaaagtaccttattacgatcgggtaggtaagcggagtgggctgatgggcttcggacgcgatataaccgagcgtaaacgctaccaggacgcgttagagagcgccagcagggagaagaccacctttatctcaacgatcagccacgagcttcgtacgccgcttaacggcattgtcggcctgagccgtattttgctggataccgatctgaatcaggagcagctcaagtaccttaaaaccattcacgtctctgcgattaccctgggcaatattttcaatgacgtgatcgaagtcgataagatcgaacgtcgtaaggtccagctggataaccagccggtcgatttcaccagtttccttgccgatctggaaaacctctcaggcttactggcccagccgaaagggctgaagtttgtgatggcaccgcagttaccgctgccgcataaaatctctaccgatggcacgcgcctgcgacagattttgtggaacctgattggcaacgccgtgaaattcacccagcagggagagattgtcgtgcgtgtggcctacgagcaggatgaaacgctgcgctttgaggtacaggattccgggcaggggattcgtcaggaagagcaggataaaatttttgctatgtactatcaggtcaccgaccagcatggcggcaagccggcgaccggaaccggtatcggcctggcggtttcacgccgtctggcgcaggccatgggcggggatatcagcgtaagcagcgcaccggggcagggctcctgctttacggtggtgataaaagctccgcgcatcgcagaggaagtggaagatgagggcgtggacgacacgctgccgctgccggccttacatgtgctgctggtggaagatatcgagctgaatgtgatcgtggcccgctcggtgctggaaaaacttgggtgcagcgtagaggtggccatgaccgggaaggcggcgctggagatgttcgatccgctggagttcgatctggtgctgttagatatccaactgccggacatgaccggaatggacgtttcacgcgccctgcgccagcaacatcctgatgcaaacctgccaccgttagtcgccttaacggccaacgtgctgaaagataaaaaagagtattttgatgcgggcatggacgatgtgctcagtaaaccgcttgccgtaccggcgttaacggccattatcaaaaagttttgggactatcagcctgaaagtgatggcctgcccgtgacggcggcgagcgccagtcaatccgatgcattactggatatcccgatgcttgagcaataccttgagctggtggggccgaatctgatcacgcaaagtctgaccatgtttgaacagatgatgccgggttacctggatgtactggattctaatctgatggcgcgcgaccaaaaaggcattgctgaagaggggcacaagatcaaaggcgcagcaggatcggtgggtctgcagcaccttcagcaggtggcaaagcaaattcaaagccctgagttaccggcttggtgggacaatgtaggcgaatgggttgaagagcttaagcgtgaatggcgacacgatgtgcaagtactgcgcgagtgggtggctgaaaaacagcggtagtacaaaaaaatgaccccagccgaggccggggtgcgctaatactgcgccaacaccagggaaaaagacgctgctgctatgcttaatgttttcaatgcaacagcggggtattggttaacacttgcaacaccttagcaaattcaaattaccttgtgacaagattcattaaaatttgtgatgttgaaccgcgtttaaatacaggaaacattaattcgacaacatagtcaagcaaggaatcaattaaacagtcacattggttattttttaatcaaaacttctgttttttgtacgggcttaacccaaatttgttaacaaaacctgtgttgcgcgctgtaaccaaaatttttcatcgctgttctggattaaaatagatataaacttatgataataaagaataatgaagaaattcgttcccgcggacccaaaacgtttcggaaaacctgatcttcccgcaccattaaaaggttttaccgatagaaaacgctttatagttcggcgaaaacatagggttaaaacaccgtcttgtaacagttaaaacacgaaacatgatgactgaaagaacattttgtctccagctaacggaaacagtttgctgctctaacagaattatacataagttatatgaaacattgaggcgaggtattgtcacaaaatggtatcatctttctgaaaaagtagagcgcacgacagagaggatggaaccgattccttctctgcggaagtaattgaactcattcaaactattgttgcattcacaatgcattttcattgtcttgttataaacattgcacattgtcaccccgtctttttcggtaaagatttttattgcgggtggtgattacgcctgaaattaattaacacaaaaaaaatttgagacgatcgtatgagtaagcataaagggaatctgtggcggcgcattaagccgctggtgatgcgcattgtattgatttgggtgggactgtggctggcgggcattttactcttttcgtttgtaccggtgccgttttctgcggtgatggcggagcgtcagataggtgcctggtttagaggcgattttagctacgtatcccattccgactgggcaggccgagaggaaatctcgccctggatgaaactggccgttattgcttcagaagatcaaaacttccccaaccattggggctttgacgtggcagccatccagtccgttctggacgacagtgacagccggatgcgcggtgcatcaaccctgtcgcagcaaacggcaaaaaacctgtttttatgggatggacgtagttggattcgtaaagggctggaagcaggattaactgttgggctggaaacggtgtggaccaaacgccggatcttaacggtctacctgaatatcgcggagtttggcaaaggcacttttggggtagaggctgcgtcacgccgcttctttaataagcccgccagccgtttaaccatgtcagaagcggcattgctggctgcggtcttacccaatccactgcgctttcgcgcagacgcgccgtcaggctatgttcgtcaacgccagcagtggattttgcgtcagatgcgtcagttaggtggagaaggctttctgcagcgcaatcacctgaactgacgttagtcttcgtcgaatccggcttcgaatagctcaatgacagcggccagcgcttcggtttcctgcgggccgctggcctctatctcaatatgaccgcctttggcggagtccagcatcagtaacgcaataacgctgctggcttccgcctcggtaccggtctcattgcgtaacagcacttctgcatcgaaactctgcaccagttcaaacagcttcatggcgggacgcgcgtgcatgcccagcttatttctgatttcaacagtttgcttaacggtcatgatttacgtttttccagcgtgcgatgacgagactgtacatttttaccgcgtgagcgaaaatagtcagccagctgctctgcgatataaaccgaacggtgcttaccgccggtacaaccgatcgccacggtgaggtagctgcggttattggtctccagcatgggcagccagagttccagatagctacgcgtctgataaatgaagttatggacttcggtgtgacgatcgaggaacgcggcgacaggccgatccaggcccgtcatcggacgtagcttggggtcccagtgtgggttaggcaaaaagcgcacgtcaaagacgtaatcggcatcgatgggaataccatgtttgaagccaaacgactcaaacaccatcgtcagctcacgctcgcgtttacccagcaagcgggtacgcagcatttcagccagctcatgtaccgacatttctgaggtatcaataatcaaatcggcacgggaacgcagaggctcaagcaggtcactttcttcatcaatcgcgctttccagcgacagattcttgctggataacggatgcaggcggcgcgtatcactgtaacgacggatcagcgtgttgcgatcggcatcaagaaacagcagctgcggtgaaaatgccgaaggcagattgttgagcgctgtttcaaaaatctcaggagattcaggcatattacgcacatcaatactgaccgccgcagagatattgcgctcgaccagtgactctgctaactgtggcaacagtaccactggcaggttatcaacgcagtaaaaacccatgtcttccagcgcgcggagcgccactgactttcctgagcctgaccgaccgctgacgatcatcagcaccatgaccttctctcccgttttaaatccggttcaaaccggtaaatcacgcgctttattgctctgttggttcttcggtaataatcgcatacagctcttcatcgctctgcgcggcacgcaggcggcggcaaaccgttttatccgccagccgttttgccactaacgacagcgtatgtagatgggttttacactggtcagccggaaccagcagcgcaaaaaggagatcgacgggctggttatccacggcatcgaaagcaatgggttgctccaggctgataaaaacgcctacggcccgtaaggtatcctcctccagcttgccatgcggaatggcaataccgttaccgataccggtgctccccatacgctcacgcgtaagaatcgcttcaaacaacgtttgatgcggcaggttgagctgcttagcggccagttcgctgataatctcaagcgcccgttttttgctttggcagtgtacgctactgcgggtgcagtctggcgaaagcactgtgctcaattccagtgttaaatcattgttcattatcgtttcacttgcgagttcacatagccatcgaatcaatacgcagacatcacgtagcgagtgaatggcgctggcatagatgacaaaacggggcggttaatccgccccatcctttcagctctgcgcgccgggcgcgcctgccagcgtgaaggttagtgtttttttagcttgtctttatatttggtcagttgacgggccaacttgtcaatcaatccgtcaatcgccgcatacatatcttccgcttcagaggtcgcgtgcagctcgccaccattgacgtgcagggtcgcatcggcgatttgcgtcaccttttccactttcaggacaacatacacctgattgatatgatcaaagtaatgttccagtttggcaaattttgtcgtcaggaacgcccgcaaggggtcggtgatttcaacgttttgcccggtaaggttcagctgcataggtcttccttctcatttctgtcaaaccagttgtttacgctgatttgaaggcggtatggacaaagactcgcgatatttagcgacggttcgacgtgccactattatcccttgatcagataacatggaggtcagtttactgtcactcaagggcttggcggggttttccgccaagattaattttttcaccagcgcacgaatagcggtagatgacgcttctccgccaccttcagtattaacatggctggagaaaaaatacttcagttcaaaaatgccacgcgggctgtgaaggtatttttgcgtggtaacgcgggaaatggtcgattcatgcatatccacagcctgggcaatatcggccagcaccatgggacgcataaattcctctccctgctcaaaaaaggcctgctgctgctcaacaatacagcgggagacttttaataatgtctcgttgcggctttcaaggcttttaatcagccagcgggcttcctgcaagttgctgcggataaactgactgtcgctgtcgttacgtccggcaccgcccatggcggcgtactgctggttaatcttcagtcgcgggagactgtcggtgttgagctcaaccgtccagcgcgtcgcgactttgcgtaccagcacatcaggaataacgtattccggttcgccggtgttaatcgactgccccggacgtggatcgagcgactgaatcagcagcatcgcctctttcagcacgtcttctttcagacgcgtcacgcgcatcaggctgcggaagtcatgattagcaagaagatcaagatggctgctgacgatcaaccgtgcttctgccagcataggcgtttcgggcgcgtactgcgacagctgcaccagcaggcagtcacgtaaatcgcgcgcgccaacgccgaccggatcaaaacgctgaatgcgcttcaacacggcttcaacctcatccatttccagctcatcgttaccgatactgtcaagaatgtcttcaagcgaaacggtaaggtaacccgtgtcatcgatggcatcgacgatggatgtggcaatggcacgatcgttatcgctaaaaggcgttaactccacctgccacatcaggtagtcctgaagagactgcgtggtttcaccctggtaaatcggcagttcatcatcctgataatcggtaccggttcctgagggcgtgcctgcggtgtaaatctcatcccaggtcgcgtcaagcggcaactcttcgggcatatccttctgttccagcgcttcacgggtgtccagtcccgcttcgccttcctgatactcttttgcgtctatttcttcgtgctgttcggtttgctcaagcaggggattactttccaacgccagctgtaactcttgctgaagttcaagcgtagaaagctgcagcagacgaatcgcctgctgcagctgtggggtcattgccagttgttggctgagcctgagttgcaaaccttgcttcatagacaggatggatattcccgggtaaacatcagtattaacgacaccttatcagagtctgaactcttcacccaaataaacccgtttaacttgctcatctgcaaggacttcgctcggcgtaccgtgcgcaatcaggttgccctgactgacgatataagcgcgttcacacaccgccagcgtttcacgcacgttatggtcggtaatcagcacgccaaggccactgtcacgcaggtgttcaatgatctttttaatgtcgataacggaaatggggtcaaccccggcaaacggctcatccagcaggataaatttcggattagccgccagcgcacgcgcgatctcaacacgacggcgttcaccgcccgacagcgattgccccatattgtcgcgcagatgcgcaatatgaaactcttccattagctcgttagcccggtcctgtcgctgctcttcggttaagtcgtcgcggatttgcagcaccgccatcaggttgtcgtacacgctcaggcgacggaagatagaggcttcctgcggcagatagccgatgccgcgacgtgcacgcgcgtggagcggcagaatactgatgtcttcgtcatcgatgatgatgcgtcccgcatcacgcggaacaatgcctaccaccatgtaaaaggtggtggttttaccggcgccgttggggcccagcagaccgacgatttcaccggattttacctgcagactcacgtcttcaaccacgcgacggcctttatatgccttcgccaggttttctgcgattaatgtggccatagtgatcagttactctttttttcgctgttggttgacgcgggcttatcctgcaactgcgaaggcaccagcacggtcgtcacgcgattgctctggccctggctgtaagcctgcattttttgttctttgaccagataggtgatgcggtcgcctttgatgttgctgtccagctgttgaatatacgcattgccggtcagctcaacaaagtcattggccagctcataatgcagcttggacgcgtgcccctgaaccggtttgccattgtcctgcatctggtaaaaggtcgcagggttaccgtaagcatcaacgatagttttcttactgtcgccgcccggacgcgtcaccacgactttatcagcggtaattttgatcgaaccctgagtgacaatgacgttaccggtgaaggtcgccacgttgccttgcagatccagagcctggtttgcagagtcgatattgacgggtttgtccgagtcaccggtcagcgccagagcaggcacgctggttgcaagcagcaggctggccagtaaaaacttaatgctgtttttgttcattttgaatttcataagaagttttgaccttttcgattaactcggcgttctttgtccgtaaattaccgcgcattctcataccggtagagttaaaactgcgaccatataacgtcacctgatcgtcagacgcgacgtcctgagtgacaagattgacctgagcattgtctgttttaatgcgctcaagctcagaatcgggagccagagcattcaactcgacatggccataaagatacagcatacggtctttggtaagctttgctttatctgcgcgtatcgtccaggtaggcattttattttcgtcataggtggtcatgacgggattatcgaaccagcttattccgctgtcttcaaaataggtcactttgtccgatatcagtttataagccaggccgccctgcgggttatagaccacagagtgcgaattggcactggtgtaggttggcgtttgattattattcgctaccggcgcgctgctgtcgctatcccggttagtgaaattccagccaataagcaccagcgcaatcaaggccagacctaacgttatccaacgcctgcttttactcatactgattgccctttggcatcctcgaatttattttgcgccattaagatgaggtcgcacagttcccgaaccgcaccgcgcccaccggctatccgcgtgacgtaacgcgcgcgcgccagcagtagcggatgtgcatccgcgactgccacgctcaacccaacttttgccatcactggccagtcaatcagatcgtcgccaatataggccacctgatcgtcagagagcgacagtgtatccagaagttcgccgtaggccaaaagcttatcggattgcccctgataaaggtggcgaatgccgagcgttttgcagcgatcttccagcagtttggccgtgcggccggtaataatagccacttcgacgtccgaggtcagcaggcaacgcacgccataaccgtcgcgcacgttaaaggttttaagctcttcgccgctgttccccatataaatcaggccatccgacatgacgccatcgacgtcgcaaatcagcaggcgaattttactggcgcgcgccatgacatcgctactgaccgggccgtaacacgtttctaaagtggcattttccgactgcattgtttcttcctgtttatacgacgccagcgcgcagcatgtcatgcatatgtaccacacccagcaaacggtcgtcatcggccaccagcagggaggtaatgtttttggtttgcatcaaattcagtgcatccaccgccagtacattgggccgtacgcggatcccgccacgggtcatcacttcagcgatggtggcgttttgaaaatcaatgcccatatcgaagatgcggcgcaggtcaccatcggtaaagatgccttctatcttcatcagatcatccacaatcactgtcaggccgagattcttacgggtgatttccagcagggcatcccgcagtgatgcatcgcgtgtgacgtgaggtaattcatccccgctgtgcataatatcgctaacgtgtagcagcagcttacggcccagtgcaccacccggatgggacagcgcaaagtcctctggcgtgaagccacgcgcctccagcagggaaacggccagggcatcgcccatcactaaggttgccgtcgtgctggtggtcggtgccaggcccagcgggcaggcttcctgtggcactttgacacacaggtgaatatccgcagcacgggccatcgcgctttcagggcggcttgtcatacagattaactttattttctggcgtttcatcaccggaatcaacgccagaatctcactggattcaccactgttcgaaatcgcgatgacaatgtcgtctttaccgaccatgccaaggtcgccatggctggcttcagcaggatgcacaaagaacgccggcgtgccggtactggcaaaggttgccgccatttttttaccgatatggcccgatttgcccatgcccatgaccacgacttttccccgacaggcataaatcagtctgcaggcgtccgtgaatgcctcgttgatatattgatcaagctgttcaaggccttcgcgctcgatgcgcaataccgttttaccggctttctggaaatcaaaatctaccgttggttgctgatatgacatggtgaatctgtcctttttagccgtctataaacgcaggctgtagccacagcagcgttacccagacgaagaaaccacagagtaaaagcgtgcctgccgtacggccaacccggcggcgacgcagcaaacaaagcatggcgaacagcacgcttacaccaagcattatccagtaatcgcgtgcaaaagcgtgatagtctacgctaccgggatgaatcagtgccggcaggcccaaaacgatggccagattataaatgttggcgccaatcaggttgccgatagcaatatcatcttcacctttcagcgcgcctgcgataaccgttgccagctccggcaaactggtacctacggcgataagcgtcagccccatcaccagctcgctgacgccaaagtaatcggcaaatacggtcgcgttatcgatcaccatgtgcgtcgacatgggcagaataatcagcgccacggccagccagagaaaagcgacggtatttccgctctcttcacgcggcagttcagctaattgttcacgcgttaacgtatcgttattatccttttctgctttccgcgcgatgcggatcgtcactatcagataaatcgcggcaatagcaatcagtgcaataccgtccagacgactaagatagttatcgaataacatgatgccgctgagtaatgagaccaacaccatcagcggcagttcacgacgtattaaattggaatggatgctcaggggatgcaacaacgctgcaccgccgagaatcaaaagaatattggtgatgttcgagccaagcgcggtgcccaccgccagatccatctgtcccaactgcgcagcagagaaggagagaatgatctccgggagcgaggtgccgatactgacgacggtcatgccgatgatcaacggcgggatgccaaaggatcgacaaagtattgcagcactaaacaccagacgatcggcaccataagccagtaaaagcagaccgataatcagcagtgcggtagcgacgaacatgaaaaatccttgcttaaaacccctgttggcttgccttcaggttctttgtgacaaaacaggcgctgattttgaccgtctgatcgacaaaagtaaattttatgaccgttttcgccaaatctttgcattaagtttctgtaaagctatcgtgcgtttaaccttaacaggctaccatcgtaccctattgtttacgcccgatccgtaatagaggtgataatgatccaacaaaaaacgaacctggttgaggttcgtggcgtgagtttttcacgtggcgatcgcaaaattttcgacgatatttcgctgacggtaccaaaaggtaaagtgacggcgattatgggaccgtcggggatcgggaaaacgacattgctacgcttaattggcgggcaactgcagcctgacagtggtgagatctggtttcgggatgagaacattccgacattgtcgcgcacaaagttgtacgaagcgcgtaaaaagatgagcatgctgtttcagtcaggtgcgctgtttaccgacctgacagtgtacgaaaatgtggcctggccgctacgcgaacatacccggttacccgcgccgatcctacacagcaccgtgctgatgaagctcgaagcggtggggctgcgtggcgcagcacagctaaaaccggcggagctgtctggcggaatggcgcgacgtgtcgcgctggcacgcgcgattgcgcttgagccagagctgatcatgtttgatgagccgtttgtcgggcaggaccctattaccatgggcgtgctggttaagctgattgatgaactgaatcatgcgctgggcctcacctgtattgtggtatcacatgatgtgcctgaagtattaagtattgccgattacgcttacatcgtggcgggacaaaaaattattgcacagggtacgacgccagacttgcgtgctgacaacgatccccgcgtgcgtcagtttatcgatggcatcgcggatggacccgtcccgtttcgttttccggcgggtgactatttggccgacttaaccggttcagggagaatctaagctgatgttgttaaaagcactggcgtcgttgggacgccggggaataggaacctgtgccagctttgggcgcgccggtttaatgctttttcatgcgctggtgggtaagcctgcgttccgcaaacattttccgctgctgatcaaacagctttacagcatcggcgtactgtctctggtaatcattgtggtctccggcctgtttattggcatggtgctggggttgcagggctatctggtgttaaccacctatggcgcagaaaccagtctgggcatgttggtggcgctgtcgctgctacgtgaactggggccggttgtgacggcgctgctgtttgcgggacgggcaggatcggcattaacggcagagattggactgatgaaagcgaccgaacagctttccagtatggaaatgatggcggtcgatccgctgcgccgtgttgtctcgccacgtttttgggcgggctttatcagtatgccgctgctggcgttaatttttaccgccgtagggattaccggcggtgcgctggttggcgtgagctggaaaggcattgatcccggcttcttctggtcggccatgcaaaacgccgtcgattttcgtagcgacgtggtcaactgcattattaaaagcgctgtgtttgccgttactgtcacctggattgcgttgtttaatggttatgatgcgatcccgacctctgaaggtattagccgcgccacgacgcgcaccgtggtgcatgcatcactggcggtgctcggattagattttgtgctgacagcactgatgtttgggaattgatgcgatgcaaagcaaaaaaagcgaaatttgggttggcgtgtttatgatcatggcactgattgccgtgctgtttctctgcctgcgcgtggcagatctcaaatctctggggacggaaccaacctggaaactgtatgccaccttcgataatatcggcggcctgaaagccagttcgccggtgaaaatcggtggtgtggtgattggtcgtgtaacggatattgatcttgaacctaaaacgttactgccgcgcgttacgatggcgatcagtgacaaatacgccaaccagatcccggataccagctcgctggcgatccgtactcagggtttactgggcgagcaattcctgtcgttaaatatcggctttgacgatcccgaactggggtcgtcaatgttgaacgatggcggcacgatacgtgataccaagtcggcgatggtgctggaggatttgattggccagttcctgtataaaagcggcgacaacaaaggcaacaagcaaaccagtgacagtaaggatgcgcagggcggcgacgtggccgcaccggcagcagcagctcaaccttaaatagagggataacatgatgtttaaacgttttctgatgattgccatgctggtggtcgcgccactggctgcgactgcggccgatcaaagtaatccttataaactgatgaatgaagcggcaaacaagacgtttacccgcctgaagaatgagcagccgaaaatcaagcaggaccctaactatctgcgtgagatcgtccgtcaggagctgctgccttatgtgcaaatcaagtatgccggcgcgttagtgctgggccgtttctaccgcgatgccacaccggcgcagcgtgaagcctactttaaggcgtttggtgactatctggcgcaggcttatggccaggcgctggcgctttatcacggccagacttatcagattgaacctgagaagccgattggcaatacgaatatcctcgctatccgcgtaaccattatcgatcctcagggccgtccgcctgtgcgtctggatttccagtggcgtaaaaacagccagaccggcaactggcaggcttttgatatgatcgcggaaggcgtgagcatgatcaccaccaaacagaatgagtggggcgatctgttacgtacgaaaggcattgatgcgctgactgcccagttggaatcttcagcgaaacagccgatcaccctggatcaaaacaaataatgcaggcatcactgcactggtcccgcgaggcaaatacgctgcggctggaaggcgagctggaccatgacacgctgctgagcctgtgggagcagcgtgaaacgctggttaaggcggtcgaattgatcgatgtctccgccctggaaagggtggattcatcggggcttgcgttgctggtgcacctgcgggagattgcctcgcagcagggaggcacgctgcgctttgttggcattggcgacaaactgcagtcattgatcaccctttacaacctgcaacaaattattgtttctgcggattaaagcgcctgaattcgcctttcgcgcaaaagccccggtcctgtacaggggcttttgcgtatttaagaatcaggcactttcctctactatgtcagccttattattattaagtgaagttaagagcgatggaaaacagtgagattcaggccgtgctgatggcagcgctgcccttagaagaagttcatgtcatcagcaatgatggcagccattttcaggtgatcgccgtgggcgagttgtttggtgagttaagccgcgttaagaagcagcaggctgtgtatgcgccgctgatggaatttattgcggacaaccgcattcacgcggtctccatcaaaacttacacgcctgctgagtgggcacgtgaccgtaaacttaacggtttttgattccctccggggccgctcgatctgagcgtgaccgtttactagccagttaattgagaaccgtgttaatggataaatttcgtgtgcaaggccccacccgcttaagtggtgaagtgaccatttccggcgcgaagaacgccgctctgcccattctgtttgctgctttactggctgaagagccggtcgagatcacgaatgtgccaaagctgcgtgacatcgacactaccatgaagctgttgacacagctgggtgccaaagttgagcgcaacggttctgtacacgtcgatgccagcggcgtagacgttttttgcgcgccttatgaactggtaagaaccatgcgcgcttcaatctgggcgctgggtccgctggtggcgcgttttggtcagggcgaagtgtcactgcctggcggctgcgccatcggcgcgcgtccggttgacctgcacattacgggcctggagcagttaggtgcagagattaagctggaagaaggttatgtcaaagcctcagtcaatggccgcctgaaaggcgcgctgatcgtgatggataaagtcagcgtgggcgcgaccgttaccattatgagcgcagcgacgctggcgaccggcaccaccgtgattgagaatgcggcacgtgaacctgaaattgtggatacggctaacttcctgaacacgctgggcgcaaaaatcagtggcgcaggtaccgataaaattaccatcgagggcgttgagcgcctgggtggcggcgtttatcgcgtgctgccagaccgtattgaaaccggcaccttcctggtcgcggcagcgatttccggtggcaaggttctgtgtcgtaacgcccagcccgatacgctggatgcggtgctcgctaagctgcgcgatgccggtgcagacattgaaaccggtgaagactggatcagcctggatatgcacggcaaacgccctaaagcggtcaacgtgcgtacggctccccatccgggtttcccgaccgatatgcaggcacagtttacgttgctgaatctggtggccgaagggacgggacttatcaccgaaaccattttcgaaaaccgctttatgcacattcctgagctgattcgtatgggcgggcacgcagaaattgagagcaataccgcaatctgtcatggtgtggaaaccttatcaggggcacaagtcatggctacggatcttcgcgcctcagccagcctggtgctggcaggttgtattgcggaaggcactacgctggtcgatcgcatttaccacattgaccgcggctatgagcacattgaagataagctgaaagcgatgggcgcgaatatcgagcgcatcagcggcgaataagaataaatttgctgcttcatgcggataaaaccagccttgaaacacggctggttttttttcatcctcagatcgcgttacgttagttattggcttcgttatctgtcgatcgcacacgttttttgcgatccagcaaacaatgggtttcaggatcgtaataacggcttggccatatctcggacggatggacattgatcgcatcggcaatcagccattcgcctttaggccaggggcgcgaaagcgcgttggccagggttgatgagcttagtcctgactgacgtgaaagcgccgcaagtgtggtaccgcgtttacgaagcgcggcaataatatcggcaggatgccagtcctcagtcctgttctgcataacctttttctccttgtccttgtcagtaagtcacacgcgagtggtgataacttatttaaatactatctggaaatttatgggtttttatatcagagaatttccataagattccagtaatatttaggcaagcagacagaactgagcggcctgacgcaaaaggcgcgtaacgcatgcaagggcggagaaagggggagagcaacggagccagggcggctccgtcagggatcagaaatcgcgttgtaccgacatgtgcgccagtgactccagggcagagcgccacggcgtttctggcagaatctgcaaggcttcaatggctttatcggcctcctgttcagcacgcttacgcgtccattccagtgagccacactgattcatggcttccagaaccggtgccagtaaatggcggccattaccctgttcaatagcatcacggatcattttcgactgctcaggcgatccattgttcatcgcatgaagcaggggcagggtgggtttaccttcgctgagatcgtcgccggtatttttccccagggtttccccgtccgcgctgtagtccagtaaatcatcaattaactggaaagccgttcccagatagcgcccataatcctgcagcgctttttcctgcgccggcgttgcctccgctaaaattgccgatgcctgagaggccgcttcaaataagcgcgcggttttactgtagatcacccgcatatagctctcttccgtgatgtcaggatcgttgacgttcatcagctggagcacttcaccttcagcgatgacgttcaccgcttcagacatcagcgccaggatgcgcagcgaacccatgctggtcatcatctggaaggcgcgagtatagataaaatcaccaaccagcacgctggctgcattgccaaatgcagcgttcgcggtggccttgccacggcgcatatcggattcatccacgacatcgtcatgcagaagcgtggcggtgtggataaattcgatcagcgccgcattggtgacgtgtagatcgccctgatagcccatggcgcgtgctgacagcacggcaatcatgggacggatgcgtttaccgccaccactgatgatgtaatagcccagctggttgatgagcgagacatctgaattcagctggtcgagtatggtctggttaacggcagccatgtcctgtgcggttaattcgttaatctgttctaagttcattcgtcttttcagctatgactcgtttctctgccatggtaagcggttttacccagccagcgttcagtaatctgttactgattgtacttgaattttcaggttgagaaacgtttgcattgagcctgtgttttttttctgcaagagtgtgcaaagtgctcttgtcttctgttggagttttgcgtagaattcgcgccctattgtgaatatttagcgcgccgcctgatgaactgaaaggcaagcgcagaagcggagttttatatgtacgcggttttccaaagtggtggtaaacaacaccgagtaagcgaaggtcagaccgttcgcctggaaaagctggacatcgcaaccggtgaaaccatcgagtttgaccaggttctgatgattgcaaatggcgaagacgtgaaaatcggcgcgccactggtttcaggcggtgtgatcaaggcagaagttgttgctcatggtcgtggcgagaaaattaagatcgttaagtttcgtcgtcgtaagcactaccgtaagcaagcaggccatcgccagtggttcactgatgtgaaaatcactggtatcacggcgtaagaggagatctgacaaatggcacataaaaaggctggtggttcgactcgaaatggtcgtgactccaatgcaaaacgtctgggtgtaaaacgtttcggtggcgaatctgtcctggcaggtagcatcatcgttcgtcagcgcggaaccaaattccacgcgggtaacaatgtaggttgtggtcgtgaccacactctgtttgctactacagacggcaaagtaaaattcgaagttaaaggtccgaacaaccgtaaatatatcagcatcgttgctgagtaaggttgtcgtgacgcagacgtttcacgtctgaacgcacgaattgaaggccccgcaactcttgcggggctttttacattctgcgacccattgcccgacaggcgacatcgcctgaaagattgctgtacactttatgtacacgctggcgtaagccagttttgatttatccgccgctggtcacgcagaagaccctggcggacccgtctgcagcgtattgcagacgattgtgtgacggagaaagaaaatgaagtttgttgatgaagcgacaattttggtcgtcgcaggtgatggcggtaatggttgtgtcagtttccgccgcgaaaaatatatcccgaggggcggcccggacggtggtgatggtggtgatggcggcgacgtatttttggttgctgacgaaaacctcaacacgctgatcgattatcgtttcgaaaaatctttccgcgctgagcgtgggcagaatggtcagagtcgtgactgtaccggtaagcgtggtaaagatatcaccgttaaagtaccggtaggcacccgcgttatcgaccagggaactggcgaaacactgggcgatatgacgcgtcaccagcagacgttgatggtagccaaaggtggctggcatggcctgggaaatacccgttttaaatcctcggttaaccgcagtccgcgtcaaaaaaccatgggcacgcccggtgagaaacgcgatctgcagctggagctgatgctgctggctgatgtgggcatgttgggtttacctaatgccggtaaatcgacctttattcgtgccgtttctgctgccaagccaaaagtggcggactatccctttaccaccctggtgccaagccttggcgtcgtgcgtatggatagcgagcagagctttgttatcgcagatattcccggcctgattgaaggcgcggccgaaggcgcaggtttaggcattcgcttcctgaagcacctcgaacgctgccgcgtgctgctgcacctgatcgatattgctcccattgacgagagcgatccggttgaaaacgcccgtattattctgggtgagctggaaaaatacagcgataagctgtttaacaaaccgcgctggctggtgtttaacaaagtcgatctgatcgacgacgaagaagcgcaggcgcgcgcaaaagccattgccgaggcgctgggctgggaagataaatactatcttatctctgccgccagccgtcagggcgtcactgacctgtgctgggatgtgatgagctttatcaacgccaacccgaaagaagctgacgttgaagaaaaacagccggagaaagtggagttcatgtgggatgattaccacaaagaagccattgaaacggcaacggttgaagaagacgaagagtgggatgacgactgggatgaggatgacgacgaaggcgtcgaaatcatctaccagcgctaaacctcttataactgccccctttccgccggaacgggggcagatttatttcagcactccgccagcaccgcccgcgtaaatcctgcgctacagcctaatctatcctgtttgttatgaatctcaatctgccacgacggactgcgtttacccacatgcaaatgacgcgcagccgaccacctgaaacggcgcgctgatggctggtattcacttcccacgcccgccacgtggctgccccttcctctgctgccagatagcctgccacagaagcccgggttgcggctaacctcatcgaggctccgccatgcagttggtcaacgggttgccgtgtccgtcagcgaaaaagcctgcctttactcacttattaacttaagtaaaaattatgctttttcgacgcgcgtctggcgcggattggcgactggacgagtgttacttccgtgaaggtaaaacagagtgaagggataatgcgaccacaacgccacctggagatagcagggctaccactagctcgaacgggtcgggatgcaccggcatgtacgtgtaaacacccagtgtcaatcgacaataaaaaacgcagcggatgaattgtccgctgcgttttatcagtatgaatcagtaattcttattaatatcgcgataaagtcggctttcaaaacgcaccagtggaatacggcgcgtgcgctgatcttcaggcggaaccgcgtatcccgacaggaactgcacgaacgccatacgcgccccgctggaggtggtgataaagcctgcaaggttgtaaacaccttgcagcgaaccggtttttgccgacactttgccatccagtcctgcttcatgcaggccgccacggtactgcagcgtgccatcgtgtccggccagcggcagcatcgaaatatagtccagtttgctgtcgttctgtgcaatatattgcaggacctgcatcatggtggcgggggagatcagatcgtggcgtgacaggcccgaaccatccacctggatgctgttacctaaatcaatattggccttttcacgcaggacgcgacgaaccgcgtctgatcccgcacggaaggtgccgggcacgttgaagtaatggtggccgatagtacgaaaaaccgtgtcggcaatcatattatcggacttcttcaacatggtgtgcagcagcgtatgcagcggggccgactgcgtagaagccagcaccgtacccggctcggtcacctgcgtctggcgcaacagatggccgctgtaatcaataccagcagaacgcaattcagctttcaggatctcgcctgcccaggctgcgccatcctgaaccgcaaaggccaaaggaagcggatcgctgcgctgacgcatacagccggttaaggtgtagcggttcaactctcccggcacgacgtccagctcgcagtattgcccttcgccactgttgcgcccaatcgtgcgtacctggctcagcatgtgcgccgggtaataggatgcaatgcggataaaggcattttcgcctgccttctcagcactgtagagcgaaaccgagaagcagtttttatccacaatggctgcggcaggtggtgcactaaagcactgggtcatgtcgttccacggccagcccggtgcggcgtcatggctggcaaacaccgaggtatcaatgaccagattacctttgatgtgcgtgatgccttgtttttttaacgccgcgaccatattacgcagatcctggcggcccagcgtcgggtcgccagcaaaccgggcaactaaatcaccattaagcgtgccatcgaccagcgcgcctttggtttcaaaggtcgtttgaaaacggtaatcaccgcccagttccagtaaagccgccagggcggtaatcactttcatggtactggcgggaagtgccatctgtttcccgtggtaatcaataattggcgttgatgcgcccactttttgcaccagcaaagccagattggcaccatctggcagatactgcatgtattcatcaactggcgctgcttgtgcctgcagcataaaagcacaggttaatccggtaacaagtcgtgaaaatcgcataatctcgcggtaactgacaggtgaaggcgacaatactacgtcccaggacggtggaaagtaaacgatgacccgcagggaactctgggttaaaatacgtatcaaattgcaaaaccttttctggcctggaacactttccgggtcagtattcttttatttgcaaaacgaggtcttgcgccgcagaacgcttttttctgcagtcaccggtcaggatgcaccgtgaaacaggaatgatgacgaggagctaaaatgaaccagattccgatgacgttaagaggcgctgaaaggctgcgcgaagagctgcatgagctgaaaacggtgaagcgcccgcgcattattgcctccatcgcggaggcccgcgagcacggcgatttgaaagagaacgccgaataccatgctgcgcgtgaagaacaggggttctgtgagggacgcattcaggagattgaagccaaactctccaatgcacaggtgattgatgtgactcagatgccgaaaaccggccgcgtgatttttggcgcaacggttagcatcctgaatgtggacaccgatgaagcctttacttatcgcatcgtgggtgatgatgaggcagactttaaacaaaatctgatttctgttaactcgccgatggcacgtggtctggtgggtaaagaagccgatgacgttgtgattatcaaaacgccaggcggtgatgttgagtacgaaatcctgaaggtggaatacatctgacagggtgcaactgtctgaaaagggttgccgtacaatgtaaagaaaggaaaaaggccgcgctgcggccttttatcccatgtaagagcatggcactttctttgcccacttaacgtggcagagaaatcttgctctctttagcggggcgatacagcaccagcattttgccaataacctgaacgttgctggcacgggtctcacgtacaatggcttcaacgatcaactgcctggtttcacgttcttcagcggcaattttcaccttgatcaattcgtgatgttccagcgcttgttcaatctcagccaggacaccttcggtcaggccattgcctccgagcatgacaactggcttgagcggatgggcgaggcctttgaggtgctgtttttgtttggtacttagattcatcgtattatttacttactcggggattgaaaacggttcattctaccgccatctcgggtatatcgccaaatcgacgcagcctatcgcgtgcagatttatcgctacgatgacgatttagttggaaattttatgaccggtaaaaagcgttcagccagctccagccgctggctacaggaacactttagcgataaatacgtgctccaggcacagaaaaaagggttgcgttcgcgcgcctggtttaaacttgatgaaatacagcagggtgacaagcttttcaaacccggtatgaccgtggtagatctgggtgctgcacccggtggctggtcacaatatgtggtacagcaaatagggaccaaaggccgcgttattgcttgtgatattctgccgatggaccctattgttggtgtcgatttccttcaaggtgattttcgtgaagaatcggtgatcaaagcgttacttgaacgtgtgggcgatcaaaaagtccaggtcgtcatgtctgatatggcaccgaatatgagtggtacacctgccgtagatattccccggtcgatgtatttggtggagctggcgttggagatgtgtcgtgacattttggctcccggcggtagttttgtagtgaaagtgttccagggagatggctttgatgaatacctgcgggaaattcgctccctgtttacgaaagtgaaaatacgtaagcctgacgcttcacgttcacgttcacgtgaagtttatattgtggcgactgggcttaaactgtaaccaacgtaatggataacccggcattcctgctgcgattccatgtgcgaaggatctatagtaccctacgctatctgttaacaccgttgtaatatgaggttaatcccttgagtgacatggcgaaaaacctgattctctggctagtcatcgcggtcgtgctgatgtcggtcttccagagctttgggcccagcgagtcgaatggccgtagggttgattattcaaccttcctgtcggaagtgaaccaggatcaggtccgcgaggcacgtattaacgggcgtgaaattaacgttatcaaaaaagacagcaataaatacaccacttacattcctgtcaatgaccccaagttactcgataacctgttgaccaagaacgtgaaagtggttggtgaaccaccggaagaacccagtctgctggcgtctatcttcatctcatggttcccaatgttactgctaattggtgtgtggattttcttcatgcgtcaaatgcagggcggcggtggcaaaggcgcaatgtcctttggtaaaagcaaagcccgcatgctgacggaagatcagattaaaaccacttttgctgacgttgcaggctgtgacgaagcgaaagaggaagtcagcgagctggttgaatacctgcgtgagccgagccgtttccagaagctgggtggtaaaatccctaaaggcgtgctgatggttggcccgccgggtaccggtaaaaccttgctggcgaaagccattgcgggtgaagcgaaagtgcccttctttaccatttcgggctctgactttgttgaaatgttcgttggtgtgggtgcatctcgtgtgcgcgacatgtttgaacaggcgaagaaagcggcaccctgcattatctttatcgatgaaatcgatgctgtcggtcgtcagcgtggcgccggtttaggtggcggtcacgatgaacgtgagcagaccctgaaccagatgctggttgagatggatggttttgaaggtaacgaaggcatcattgttattgccgcaaccaaccgtccagacgttcttgaccctgcgctgctgcgtccgggccgctttgaccgtcaggttgtggttggcttgccagacgttcgtggtcgtgagcagattttgaaagtgcacatgcgccgtgtgccgttagcaactgatatcgacgcggcaatcatcgctcgcggtacgccgggcttctcaggtgccgatctggctaacctggtcaacgaagcggcgctgttcgctgcgcgcagcaacaaacgtgtagtgtcgatggttgagtttgaaaaagccaaagacaagatcatgatgggtgcagagcgtcgttccatggtgatgacggaagcgcagaaagagtccacggcttatcacgaagccggtcacgccattattggtcgcctggtgccagaacacgatccggtacacaaagtgacgattatcccgcgtggtcgtgcattaggtgtgacattcttcctgcctgaaggcgacgcaattagcgccagccgtcagaaactggaaagccagatttcaacgctgtatggcggtcgtctggctgaagagattatctacggtgtagagcatgtctcaacgggcgcatcgaatgacatcaaagtggcgaccaatctggcacgtaacatggtgacccagtggggcttctctgaaaaactgggtccattgctgtacgcagaagaagagggtgaggttttccttggtcgctccgtggcgaaagccaagcatatgtccgatgaaaccgcccgtattatcgaccaggaagtgaaacatctgatcgatactaactatcagcgtgcgcgtcatatcctgggtgaaaatctggacatccttcatgcgatgaaagacgcgctgatgaagtatgaaaccattgatgcaccgcagatcgacgacctgatggcacgccgggaagtgcgtccgccagcgggctgggaagatcccggcagcagcaattctgacagtaatggcacgccaaaggcaccgcgtccggtcgatgaaccgcgtacgccaaacccaggcaacaccatgtcagaacagttagacaaataagacgccacgtcttttaataaaaccccggctggtccggggttttttacatctatacattgtgcgccacaaggagtttttcaccatgaaattgttcgcccgtgattcccatctcgatttgtcatttccacatgtgatgggcattctgaatgtcacgccggactctttttccgatggtggtaaacataacgcgctggtcgacgcgctcacgcataccaatgaaatggtcaatgccggcgcaaccattattgacgtcggtggcgaatccacgcgtcccggcgcggatgaggtcagtgttgacgaggagcttgagcgggtgatcccggtggtcgaagcgatcgctcaacgttttgaagtgtggatttcggtcgacacgtctaaggctgaggtcatcacggaagccgccagagtgggcgctcacattatcaatgatgttcgctctttatccgagccgggggcgctggccgccgctgccgcgacaggcttgcctgtgtgcctgatgcacatgaagggcgagccacgaaccatgcagcaggcaccggcttatcagaatatcgtcaacgacgtggatgcgttcttcgtcgagcaactggcccgctgcgaggcggccggaataaaaaaagagaatctgctgctcgacccgggcttcggattcggtaagaatctcagccacaattatgagctgttggcccgtctcagcgatttccaccattttggtcggccattgctggttggtatgtcgcgtaagtcgatgattggtcaactgctgaacgtggggccaggtcagcgtctgaccggcagcctggcctgtgcagttattgccgccatgcagggggcacacattattcgcgttcacgatgtgaaagaaacggtcgaagcgatgcgcgtggtcgaagcgacacaaagagctaaaggatgacagagcatgagtaatcgtaaatattttggtacagatgggattcgcggcaaagtgggtgagtcacctatcacccctgattttgttctgaaacttggctgggccgcagggaaagttctggcacgccacggttcgaaaaaaattattataggtaaagacacgcgtatttcgggctatatgctggaatctgcgctggaagctggcctggctgcggcaggcttatctgctgcgtttaccggcccgatgccgacgcctgccattgcctatctgacccgaacgttccgtgccgaagccggtatcgtgatttcagcctctcataatccgtttgatgataacggcattaagttcttctctgccgaaggcaccaagttgcctgacgatgtggaagaagcgattgagctggaaatggaaaagccgctgacctgtgttgaatcagccctgctgggccgcgccagtcgtatcgtggatgccgccggacgttacattgaattttgtaaaggcaccttccccagcgagctcagcctgaatggcctgaaaattgtggtggactgcgctaacggcgcaacctatcacatcgcacctaacgtactgcgtgaacttggcgcaacggtgattgcgatcggtgtgcagcctgacggcatgaacatcaataaagcgtgtggcgcgaccgatctgaaaatgctgcaacagcgtgtactggctgagaaagcagacattggtctggcttacgatggtgacggcgatcgcattatgatggttgaccatctcggcgagaaagtggatggcgatcagattctgtatatcattgcccgcgaaggtctgcgccaggggcagttgcgcggcggtgtcgtgggaacgctgatgagcaacatggggctggaactggccctgaagcagctgggcattccctttgtgcgtgccaaagtgggcgaccgctatgtgctcgaaaaacttcaggaaaaaggctggcggctgggcgctgaaaactcaggccacgtgattctgctggataaaatcgccaccggcgacggcattgtggcaagtttgcaagtgctcactgctatggtacgtaatcatatgagcctgcatgacctgtgcaccggaatgaagatgctgcctcaggtactggtcaatgtgcgctttgccggtgagcacgatcccctggaaagcgatgccgtaaaagcggtagcgcaggacgtagaaaaagcgctggctggaaaagggcgcgtgctgctgcgtaaatccggtaccgaacccttaatccgcgtgatggtcgaaggtgaggatgccgcccaggtgacggcactggctaaccagattgccgatgcggtcaaagccgtctgacgcgcgtgacaggcaggcgcagcagcctgttcctgcctgtaaaatcatcgcactggcgcttttttctgcaatcagcctgtgacagctaaattgcacttgcagaggtatgcgccattggttagtattcacacccgcttctgatgggtgatgaacacactccccgtcatattggttgaagctttaactgtgcggattacgcgcaaggaaacaggttgattatgtacgaagctctgttagttgttttccttattgtagcaattggccttgtgggtcttattatgctgcagcaaggcaaaggcgctgatatgggagcatcatttggtgcaggcgcgtctggcacgctgtttggttcaaacgggtcgggtaactttatgactcgcatgaccgcagttctggctacgctgtttttcgtcatcagcttgattctgggtaacctgaacagcaataagatctccaaaggaagcgagtgggaaaacctcactgcgccagctcagtctcaacagcagactcagccagctaaaccggctacgccgggcaatgatatcccgcactaatagcagtaaaaatagcgtcaaactaaagcggcagaacagcgtcgcagtcagtgcagtaccgaggtggtgaaattggtagacacgctaccttgaggtggtagtgctcgaaagggcttacgggttcaagtcccgtcctcggtaccaaatcttagtattacttgcattttatgcatgttcggcgtaatattcgccacgttttcggacgcggggtggagcagcctggtagctcgtcgggctcataacccgaaggtcgtcggttcaaatccggcccccgcaaccactttcccttagagttctttttcaaatatactgtgtgcatcgacgggcgcataagcagcgaattttgaaaaaaattcttttggatgggcgtccgggccgcaatgcggcatacagggtccagtgataaaaagccccgaatattcggggttttttgttattagcgaatcgtaatactgggctataggccctttttttatgtcttgggggtgggcttgtccacattagagcaaaaattgacagagttggtatctgctccggtagaagcgctcggctacgaactggtcggaattgaattcgttcgtggtcgcacatcaaccctgcgcatctatattgatagtgaagatggcatcaatgttgacgattgcgcggacgtcagccaccaggtgagtgcggtgatggatgtggaagatcccatcacggttccttaccaccttgaagtgtcctcaccggggctcgatcgtcctctgttcactgcagaacattatgcacgctttaccggcgatgaggtgagcctggtgctgcgtatggccgttcaaaaccgccgtaaatggcagggaattatcaagtctgttgagggtgagatgataacggtaaacgttgagggtaacgacgaggtgttcgcgctgagtaatattcagaaagcgaacctggtcccccacttttaaaagtccggattgaggccaaccaggatgaacaaagagatcttagctgttgtagaagccgtttctaacgaaaaagccctgccgcgtgagaaaatcttcgaagcgctggagagcgcgctggcgactgcgaccaagaaaaagtacgagcaggaaattgacgtacgcgtcagcatcgaccgtaaaagcggcgacttcgataccttccgccgttgggagatcgtcgatcaggttacgcagccaacgcgcgagatcacgctggatgcggctcgctacgaagacgagtctctcaatctgggcgaatacgtagaagaccagattgaatccgtaacgtttgaccgtatcacgacccagacggcgaagcaggttatcgtacaaaaagtacgtgaagccgagcgtgcaatggtggtggatcagttccgcgagcaggaaggcgaaatcatcaccggtgtggtgaagaaagtgaaccgtgacaacatctcgctggatctgggcaacaatgctgaagccgtgatcctgcgtgaagacatgctgccacgcgaaaactttcgcccgggcgaccgtattcgcggtgtactgtatgcagtacgtcctgaagcccgtggcgcgcagctgtttgtgacgcgttctaaacctgaaatgctgatcgaactgttccgcattgaggtgccagaaattggcgaggaagtgcttgaaattaaagccgcggcccgcgatccgggttcacgtgcaaaaattgcagtaaaaaccaacgataaacgtatcgatccggtcggtgcctgcgtcggcatgcgcggtgcgcgtgttcaggctgtgtccagtgaactgggcggcgagcgtatcgatatcgtgctgtgggacgataacccagcacagtttgttattaacgccatggccccggctgatgtggcgtcaatcgtggttgatgaagataaccacacgatggatatcgctgttgaggctggcaatctggcccaggcgatcggccgtaatggccaaaacgtgcgtctggcttcacagctgagtggctgggagctgaacgtgatgaccgtcgatgatctgcaggctaagcatcaggctgaagcccatgcagcaatcgatatgttcacgaagcatctcgacatcgacgaagagttcgccaccattctggtggaagagggcttctcaacgttggaagaaatggcctatgtgcctatcaacgagctgttggaaattgacggcctcgacgaagagaccattgaagccctacgtgaacgagcaaaaaatgcgttaaccaccctggcactggcaaaagaagagagccttggtaatcaggaacccgctgaagacctcttgaatcttgagggtctggatcgtgcactggctttccgcctggcatccaaaggcgtttgcacgctggaagatctcgcagagcaaggtgttgacgatctgacggatattgaagggctgactgatgagcaagctggcgcgctgattatggccgcacgcaatatctgctggttcggcgatgacgcgtaataacaggaaggaacagcatgacagatgtaaccgtaaaatcgctggcagcagaaattcagacctcggtcgatcgcctggtacagcagtttgctgatgcggggatcccaaagtctgaaaatgatgcggtgacccagcacgagaaagaaaccttactgtctcacctgaagcatggtcaggccggttcaggcaaactgacattgcagcgcaaaacgcgtagcaccttgaatattcctggcaccgggggtaaaagtaagtcggtgcaaatcgaagtccgcaaaaagcgtacgtacgtaaaaggcgatgcagagtctgagcaagctcaggcagaagcagaagccgaggcgcagcgtgaagcggaagagcaggcgcaacgcgaggccgctgaacaagcgcgtcgtgaagcggaacagaaagcgcaacgtgaagccgaagagaaagccaggcgcgaagccgctgaaaaggctaagcgtgcagcagcggaaaatgagaaagtgactaatcaacctaccgacgaagtgaccaaggccgcgcagtccgataaagcacgtcgtgaagccgaagccgccgaactgaagcgtaaagcggaagaagaagcgcgccgtaagctggaagaggctgcccgcctcgctgcggaagaagcccgccgtttagccgtagaaaaagcggctgaatgggaaaagcctgaagaagaggacaagggcgactatcacgtcaccacctctacgcatgcccgccaggccgaagacgagaacgatcgtcaggtggaagccggccgtgcccgcacgcgcagtgcaaaagccgcgcgtccggttaaaaaaggcaacaaacattcagaagccaaaactgaccgtgaagaagcgcgtgcgcaggttcgcggcggtaaaggcggcaagcatcgcaaaccaagcgcactgcagcagggctttaacaagccagcgcaggcggttaaccgtgatgtcatcattggcgaaaccatcaccgttgccgaactggctaacaaaatggccgtcaaaggttcactggtcatcaaagcgatgatgaagatgggcgctatggcgaccatcaatcaggttatcgaccaggaaaccgcacagctggttgccgaagaaatgggccacaaagtgacccttcgtcgtgaaaacgagctggaagaagcggtaatggacgatcgtgataccgatgccgcacaggaatctcgtgcgccggtcgtgaccatcatgggccacgttgaccacggtaaaacctcgctgctggattatatccgctccaccaaaatcgcctctggcgaagcgggcggtatcacgcagcacatcggtgcctatcacgtcgaaactgataacggcatggtgaccttcctggatacgccgggccacgccgcgtttaccgcaatgcgtgctcgtggtgcgcaggcaacggatatcgttatcctggtcgtggctgcggacgatggcgttatgccacagaccgttgaagctatccagcacgccaaagcggcgaaagtgccggtggtggttgcagtcaacaagtgcgataagccagaagccgatccagatcgtgttaaaaacgagctgactcagtacgggatcatcccggaagagtggggcggcgaaaacatgttcgttaacgtctctgcgaaagccggtaccggtattgacgacctgttgaacgctatcctgctgcaggcagaagtgcttgagctgaccgctatccgtgaaggtatggcgagcggtgtggtcattgaatcgttcctcgacaaaggtcgtggtccggttgctaccgtgctggtacgcgaaggtacgttgaacaaaggcgacatcgttctgtgcggcttcgaatacggccgtgtccgtgcgatgcgtgacgaactgggtcgtgaagtcatggaagcgggtccgtctatcccggttgagatccttggcctgtcaggtgtaccggcagcgggtgatgaagcgaccgtggttcgtgacgagaagaaagcacgtgaagtggctttgtatcgtcagggcaaattccgtgaagttaagctggctcgtcagcagaaatctaagctggaaaacatgtttgcgaacatgaccgaaggcgaagtgtccgaactgaacatcgtgcttaaagcggacgttcagggttctgtggaagcgatctccgactccctgctgaaactctccaccgacgaagtgaaggtgaagattgtgggttcaggggtaggtggaatcaccgaaaccgacgccacgctggcagcagcatccaacgccatcctgctgggcttcaacgtccgtgctgacgcctctgcgcgccgcgtagttgatgcggaaagcctggatctgcgttactactccgtcatctataacctgattgacgaagtgaaagcggcgatgagcggtatgctggcaccagagtacaaacagcagatcatcggtctggctgaagtgcgcgacgtgttcaaatcaccgaaatttggtgcagtggccggttgtatggtgacggaaggtaatatcaaacgtcacaacccaatccgtgtactgcgcgataacgtggtgatttacgaaggcgaactggaatcactgcgtcgctttaaagatgacgtcaacgaagtgcgtaacggcatggagtgtggtatcggcgtgaagaactataatgacgttcgtgtcggcgatatgatcgaagtcttcgaagtgattgaagttaaacgcaccatcgcttaagtcctggcgttgatgatgcaatttgggaggccgctggcctcccgaattatttgggagaaataaaaaatggcgaaagaatttggccgtccgcagcgtgtctcacaagagctgcaaaaagaggttgccatgatcctgcagcgtgagattaaagatccacgtcttggcatgatggtcaccgtttctggcgttgaggtatcacgtgacctcgcttacgccaaagtgtttgtcaccttcctcaatgataaagatgaagaagccgtacaaaatggcctgaaagcgttaaaagaagcctcgggttatatccgcacgctgttgggcaaagccatgcgcctgcgtatcgtgccggagctgaccttcttctacgacaactcgctggttgaaggcatgcgcatgtcaaacctcgtcaccaacgtggtgaaaaaagacgttgagcgtcgtggtcctgagtccacggacgataacgaggaggcgtaatgagtcgtcctcgtcgtcgcggtcgcgacgtccatggcgtgttattgctggataagccacaagggatgtcatccaatgatgtcctgcaaaaggtaaagcgcatttttaacgctaaccgtgcaggacataccggggcgctcgatccgctggcaaccggcatgttgcctatctgcctgggcgaagccaccaaattttctcagtatctgctggactccgataagcgttatcgcgtgattgcccgtctgggtgagcgtaccgatacctcggatgctgacggtaacctggtgcaaacccgtccggtggactttacccaggctgcgctggatacggcgctggagggttttcgcggtgatatcatgcaggtgccgtcgatgttttctgcattgaaacatcagggcagaaaactgtacgaatacgcgcgcgaaggcatcaccattgagcgtgagccgcgtccgattaccgtttatgacctgcagtttattcgctggcagggcgatgagctggaactggaaatccactgttccaaaggcacctacatccgcaccattattgacgatttgggcgagaagctgggctgcggtgcgcacgtcatcatgctgcgccgtatgcaggtggcacgctatccgtttgagagaatggtgacgctggaacagttgcaggcgctacagcacaacgctaacgagacgggtgaggatctggcgcagcatcttgatccgctgcttttgccaatggacagccccgcgtcagatttcccggcggtaaacgtgtcctctgatgtggccgcatactttaaacagggccaaccggttcacgccagtcaggcaccggctcagggcctcgtgcgcgtcaccgaaggtgaagagggcaaatttatcggcatggcagaaattgccgaggatggccgcattgctccccgacgtttagtggttgagtatcagaattaagttgtgcgctttccgcgttgggcatttgcgttgccctgaagcgaagagtagaatggcgcgactttaaagcgggatgctgaattagagatcggcgcccatacattcatttaactggagtttattatgtctctaagcgtagaagctaaagcagagatcgttgctaaatatggtcgtggtgctaacgacagcggttcaaccgaagttcaggttgccctgttgaccgcgcagatcagccatctgcagggtcacttctctgagcacaagaaagaccaccacagccgccgcggtctgctgcgcatggtatctcagcgtcgtaagctgctggactacctgaagcgtaaagacgttgcacgctacagcagcctgatcgaaagtctcggtctgcgtcgctagtcttaaaatcgggtcgtcagggatgccactcacgtgtgctaaaaacccgactggcgatcagatttgtgcgagtttcatgaaaagggggcctttatggccccttttttcgagcaatgcgcagcaatcctgagcaaactcatgtattgttgttgggtgtgatctttgtttgcagaggttcgcgcggctaatgagaggcttttaccgcaggggcggttaagggttgtcattagtcgcgaggatgcaacgaggatcggtaatcaatggcaggctcaatatagcactgccccgatgttaaggactttgattttgcttaatccgatcgtacgcaaattccaatatggtcaacataccgtcacgctggaaaccggcatgatggctcgccaggcgactgccgctgttatggtgagcatggacgataccgcagtatttgtcaccgtggttggtcagaaaaaagccaaaccaggccaggactttttcccactgaccgtgaactatcaggagcgtacttacgctgctggtcgtatcccaggcagcttcttccgtcgtgaaggtcgtccaagcgaaggcgaaaccctgatttcacgtctgatcgaccgtcctgtgcgtccactgttcccggaaggtttcgttaacgaagtgcaggttatcgccacggttgtgtcggtaaacccacaggttcatccagacatcgttgccatgatcggtgcctctgcagcgctggcgctgtcaggccttccgttcaacggcccaatcggtgcagcgcgcgttggttatatcaatgaccagtacgtactgaacccaaccgcggatgagctgaaaacctcacgcctggatctggtcgttgccggtacgcagaacgccgttctgatggtggaatctgaagcagaaatcctgtctgaagaacaaatgttgggcgcagtggtgttcggccacgatcaacagcagattgtgattgaaaacatcaattcactggtcgccgaagcgggcaaaccgcgttgggactggcagccagagcaggcgaatactgcactgatttcacgcgttgcggcgcttgccgaaacacgtatcagcgatgcgtaccgtatcactgacaagcaagaacgttatgctcaggttggcgtcattaaagatgacaccattgctgcgttgctggcggaagatgaatcactggatgcggccgaaatcggcgacatcgttcacagcctggaaaagacggttgtccgtacccgcattctgaacggcgagccacgtatcgatggtcgtgagaaagacatgatccgtggtctggacgtgcgcaccggcgtgctgccgcgtactcacggttcagccctgttcacccgtggtgaaacgcaggcgctggttactgctacgctgggtacgacccgcgatgcgcagaacctggatgagctgatgggcgaacgtaccgacagcttcctgttccactacaacttccctccgtactctgtcggtgagaccggtatggtaggttcgcctaagcgtcgtgaaattggtcacggtcgtctggcgaaacgcggcgtgctggctgtgatgccaaaagccgaagatttcccgtataccgttcgcgtggtttctgaaatcaccgaatctaacggttcttcttctatggcctcggtctgtggtgcctctctggcgctgatggatgcaggtgtgccaatcaaggcatctgttgcgggtatcgcgatgggcctggtaaaagaagacgacaagtttgttgtcctgtccgacatcctgggtgacgaagaccacctgggcgatatggactttaaagtcgccggtagccgtgaaggtatcaccgcgctgcagatggacattaaaatcgaaggcatcacccgcgaaatcatgcaggttgcgctgaaccaggccaaaggtgcacgtctgcatattctgggcgtcatggagcaggctatcagcaccccgcgtcaggaaatttctgagttcgcgccacgtatttacaccatcaagatcagctccgacaagatcaaagatgtgattggtaaaggcggttccgtgatccgtgcgctgaccgaagaaaccggtacaaccatcgaaatcgaagatgacggtaccgtgaaaatcgcagcgaccgacggtctgaaagcgaaagaagctattcgccgtatcgaagaaatcaccgcagaaatcgaagtgggccgtgtctatagcggtaaagtcacccgcatcgtagacttcggtgccttcgtcgctatcggcggcggtaaagaaggtctggtgcatatttctcaaatcgcagacaagcgtgttgagaaagtgactgactatctgcagatgggtcaggaagtgccggttaaggtgatggaagttgatcgccagggccgtgtacgtctgagcatcaaagaagcgacagaaaccaagcctgaagctgttgcagctgagagcacacctgacgctgaataagtctttcctgatttgcctctccttgcctggcagggagaggcttttgtgtcatcgcgagggcgggaatccttgtgcacagcaggcggataacaggatggttgtcccaatgtttgtattcgggagtgggaaatgaagccttttttgcgctggtgttttgttgcgacagctttgacgctggcaggatgcagcaactccaattggcgtaagaacgaagttcttgcagtacctttacagcccacactgcaacaggaagtgattctggctcgcatggaacaaattcttgccagtcgagcccttaccgatgatgaacgcgcacagctgttatatgagcgcggagtgttgtatgatagtttgggtcttagggcattagcgcggaacgatttttcgcaagcgctgtctataagaccagatatgccagaggtgtttaactatcttggtatatacttaacgcaggcgggcaactttgatgccgcctatgaagcgtttgattctgtacttgagcttgatccaacttacaactatgcgcatttaaatcgtggtatcgccctctattacggtggtcgatacaagttagcgcaagatgatctgctggcgttttatcaagacgatcctaacgatcctttccgcagcttgtggctctaccttgtcgaaagcaagatggatgcagacaaagcgaaagtggcgctcaagcagcgttacgacaaagcggtcaaggaccaatggggatggaatattgtcgagttctaccttggcgacatcagcgaagcaacactgatggaacgtctcaaggcggacgcaacggataacacctcgctcgctgaacatctcagtgaaaccaacttctatttaggtaagtattacctaagtctgggggagaaggacaacgcagaagcgttgttcaaactggcggtcgccaacaacgttaataactttgttgaacaccgatacgcattgttggaactggcgcaactcggccaggcacaagacgatttatcagaatctgaccagcaatagctgacgaacttttttgcctgtaaaacctgtcaagtcatcatcttcagggatgaaggcttttctgttcgtcaaaacttctaatttgagccggttcacactttttgatgaaaatgactgaaagttttcacgacgagttatgtagactggccgccgcaatcaacgaggcacgtgtactacatgactgatattcaaaccacttttgctgaccttggcctgaacgccgaactccttgaatcactgaatggcatgggctatgtaaagccatccccaatccaggctgagtgtattcctcacctgctggcgggccgtgacgtgttaggtatggcgcagaccgggagtggtaaaaccgcagcgttctcgctgccgctgttacataacatcgacccaactgttaaagcaccgcaaattttggtgctggcaccgacccgcgaactggcggtgcaggttgctgaagctgttaccgaattctctaaacatatgcgcggtctgaacgtggttgccctttacggcggccagcgttatgacgtgcagctgcgcgcactgcgccagggaccacaggttgtcgtgggtacgccaggccgcctgctggaccacctgaaacgtggcaccttagatttgtctaacctgcgtggtctggttctggacgaagcagatgaaatgttacgcatgggcttcatcgaagacgttgaaactatcatggcgcagatcccagaaggtcatcagaccgcactgttctctgccactatgccagaagcgattcgtcgtattaccaagcgtttcatgaaagatccgcaggaagttcgcatccagtcaagcctgacaacgcgcccggatatcagccagagctactggactgcccacggccgtaaaactgatgcgctggttcgcttccttgaagcagaagactttgatgcggcgatcattttcgtgcgtactaaaaatgcaacgctggaagtcgctgaagcgctggagcgtagcggttacaacagtgcggcactgaatggcgatatgaaccaggcactgcgtgagcagacgctggagcgcctgaaagatggccgtctggatatcctgattgctaccgacgttgcggcccgtggcctggacgttgagcgtatcagcctggttgttaactacgatattccgatggactcagaatcatacgttcaccgtatcggccgtaccggtcgtgcaggtcgtgccggtcgcgcactgctgttcgtagagaaccgcgagcgtcgtctgctgcgtaatatcgaacgcaccatgaagctgactattccagaagttgagctgccaaatgcagaactgctgggtcagcgtcgtctggctaagtttgctgcgaaagttcaacagcaactggaaagcagcgatctggagcagtaccgtgcgctgctggctaagatgcagcctgaagaagagctggatatcgaaaccctggctgcggctctgctgaaaatggcacagggtgagcgtccgctgatcgttcctgctgatgcaccacgtcctgcgcgtcgtgaattccgtgagcgcgacgatcgtcgtgagagccgtgattcacgtgaagcacgtggcccacgcgaaaaccgtgagggcggcgaccgtccacgtcgcgagcgtcgtgacgttggtgatatgcagctgtaccgtattgaagtgggccgtgatgacggtgttgaagttcgtcatatcgtgggcgctattgctaacgaaggcgatatcagcagccgctacatcggtaacatcaaactgttcggtacgcactctaccatcgagctgccgaaaggcatgcctggcgatgtgctgcagcactttacccgtacacgtattctgaacaagccgatgaatatgcagttactgggtgatgctcagccgcatgaaggtggccgtggcgaacgtcgtccgggtgccggtgctggcgagcgtcgtggcggtgctgcgcgtcctgaaggtcagggcccgcgtcgcttctcttctgagcgccgtgaaggcggtcgtgatggtgcacgccctttcaatcgtgaaggcggtcgtggtccacgtcgtgaagacggtgctgctgcaccacgtcgtcgtgacgcgtaagcgagcttattcggtgtaataaaaagggaagcctgcgggcttcccttttttttgtcttgtcgttgacccatcacaggatcaccgccgctggctacaggctgctggcagcttccatggccagcttaaacgaatgcaggcgcgcttcggtgtcgtaaatttgcccgttaaccatcacctcatttgcctgagtttcacgcagcagtgaagccagaccatgccgtaccttatccacatcgccaaccagagacatgctcagcgcctgctgcacgccatactgttcagacggcgaccacagactgtccatattctgtaccggtgcaggcagcggacccggtttaccacgacgcagattaataaattgctgctgcatggaggtaaacagaaaacgcgcttcactttcggtgtcagcggcaacaatgtttatgcacaccgtggcgtagggctcggcaaggcgcgcggaaggcttgaagttctcacgatagacgtgcagggcctggaacagctggtccggcgcaaagtgtgaggcaaaggcaaacggcagtcccattttggccgagagctgagcgctataaaggctggaacctaacagccacaccggaattttcattcctaagccgggaaccggctgcaccggcggctgcgcgcccgcttccgcatcaaaccagtcgatcagctcggcaacatcgtccggaaaggtatcggcatgaatgcccgacagatgacgacgcagtgccagcatcgtgcgctggtccgaacccggtgcacggcctaatcccagatcgatacgatcgggatacagcgaagccagggtaccaaactgctctgcaatcatcagcggtgaatgattaggcaacataatgccaccagaacccagacgcagcgtggtggtgttggcggccagatagccaatcagcacggcggtggccgcactggcaatgccagtcatattgtggtgctcggcgagccagtaacgttcaaaccccagtttttctgcctgacgcgccaacgcgagtgaattatggaaagcatcacgtggcgtcgcgccctgcggaacaggggcaagatccagaacggaaaggcgaacgttttttttatcagacatgggtactccagagtgtatagcgcaggtgtcagaccctgcaccatcaagtattgcgtaacatccgccatattaaaactttttacactctcagtatgttgcctgtatgtgcctttcagtcggtggtcagtaaaaccatccccgccagcttgcgccagtagccgttacaatcccgatttttctccagatccagcggtgcctggccttcctcgttttggcgaaaccggtcaataagacttaaggtttgcgtgtcctgaggcgacagccgcacgatatccacccagttgcgcatgccaaccagatcgtttcccaggttatagcagtaaccgctcatggtctggataccgtttaagacgaagacctgctgttgctcctgcgacaggaccttgcgtccgttagggtaatgaatgcagcaggtttcgcagtcatctttggcgcgattctccgagcgagccgtaaagcagcgagccgacagcgccagcggcaaatggccatagcccagcacttccacctcgaactgctggcgtatgcctttggtttcgcactgttgtagcagttgcaccagccagtcgcgtggcatttcaactggcaaacaccagcgcgtcattccctctttcaccagaagctgaagcgtatcagcgttatacacattcagcgtggggcccgcgacaaagggcagcttgcgttcggctgccatgttgacggtgccaacgtcgttggcctcaataataaactcgccattttcaacatagcgctgcagctctttgagctcagaaggggattgcagcaaagccagcgtactgatgaccacctgcttaccactggctgacagctcacgcgccaggctcatccaggcagcaaagggcgtcgcacgccgcttgctgcagaccgtttccccaagatagatgatatcggcgctgctgctggcggcgagttgataaaagtgttccagcgtggcggttggccagtaccacagcactggcccaagggcgtatttcatgggttttccttactgccagtcacgatgataagcgcctaacgtggtttgcgagccctcagacagcgcgcccagcgtctgcatccactgctgcgccacctcaaagttatccggctcggctttacaacgatcaatcgcctgacgccagacgcgggccacatcggaaacataggcagggctgcgctggcgcccctcgattttcaccgaggcaatgcctgcccgtagcaacgctggcaacagttcaagcgtattcagactggtgggttcttccagcacatggtagcgctggtcgtcgacctggtagcggcctttgcacagcgtgggatagcccgcgctttcctccgcgtcataacgatcgatcagcacctcattgagacgtgcctccatgccggctggcgtctgttgccagcgcacaaacttcgcgggtgagcaggcacctttactgtttggggattcacccgttagccaggaggagagatagcagcggccctccgccatgatacacaggctgccaaaggcaaagacctccagcggaacaggggtactgcgcgccagctgttttacctgatgaatcgacaaaacgcgcggcagcaccacacggtgcacatgaaaatggcgatggtaaaaacgaatggcttcaaggttagtggcggaagcctgtactgacagatggcgttcaacatgtggatagcgtgcggtggcatattccagcgtcgccatatcggccaggatcagcgcgtccgcgccgctgtctgccgccacgtcaatggcccgctgccagcgatgcatgccatcgggatgtgcaaaggtattgatcgccacgtgcagcttacgacgatgctgatggagataatgtgccgcctcaagcagcttcttatcagtaaagtttaacccggcgaagtgacgcgcattggtgtcatctttcagcccgacataaaccgcatcggcaccattctcaacggcggtgcgtattgcaggcaggttcccggccggacacagcaactccatactcaatcctctcgacatgcagatggagcacgagtctagtcatggcgcttcggggaaatgttgatttggggcagtgaaaccgtcattgatgagatagcctggcatttttttaacccttcagcggcgggttttattgatctcaccagcggcgagaaccgctgtctgtggcaatatagctaaaatttttttgacgggagtgcaaagcgtgttccagcggttatctgccagtttagtgaaaaatggccctaaaatcctcagcttacctgtaacattcgccccgttcacgttgaagcagcggctcttgcaacaactcttaaactggcaatttcgtcatgttttagccgaaggtgagttagacttccttcagggacgctttttgggtattgagattagcgatgttaatctcacgtggatcaccacgctggaaggcggtcgactgagggtgttgcagaatgccgaagcagatgtctggttccggggcaacgccaatgatttgttgctggtagcagcacgcaaagcggatccagatatgcttttctttcagcgacgactgctgattgaaggggatacggaactgggactggaggttaagaacgtaatggatgcaattgaactcgacaccatgcccaaggggttacgtaccgccattcagcagatggctgcaatcgtggagacaacaatgcaacaggacgcgaaagccgcacaggcacgcgcgggtggctcatgttaatacgcacagaaattggcgtggatgccgccggtatcgatgcattactgcgacgttgctttcccacttcagctgaagctgagctcactcaggccctgcgcgaagacggcctgttaacgttgggcgtggtcgcgactgacgatgaaggtcaggtgctgggttatgccgcgtttagcccggtcaccatgcagggcgaagatcgcaattgggtcgggctggccccgctggccgtggatgaaagcctgcgtggacagggcatcgcgaaacaactggtttatgaaggtctggatacgctgaatgagtttggctacagtgcggttgtggtgctgggcgaccctgcactgtatcaccatctgggcttcgaacctgcggcccggcatggtttgcactgccgctggccgggcagcgaagcggccttccaggtttatcgtctggcggacaacgcgtttgacggcgctgaaggacgtattgagtattccgcgccctttaatcagctgagctaagccacgcttcaagacgagtcggttgctcggcaaccagctgcagttttcgttgacgggtcagttgcttaacctgatattccagcacggaagcctgcgcgcggtcacccgccgcgcaggcataaaccagcgttaacgggcctttaccgcgcaaggctcgggcgccgcgaccctgctcatgctgcccaaggcggcgcgtgacgtcagtcgtgatgccggtatacaggctgcctgcggctgtttgtatcaggtaaagttgccagtgctgactcataatctgtcccagaaatgcctgcccggcagtgtatcgtgcttccttgcggtgcgctatccatcgcccttaccggagttgattgtgtctgatctttcccatcttgttcgttacctgaaaaagcagcatgtgctttcattatgctgctgtgccgacaacgatttgtggtgtgcaaactgctactacgtgtttgatgagtcacgcatggtattctggctgatgaccgagccagatacgcgtcacggcctgttggcgataaaacaccacagcgtagcgggcaccatcaatgggcaaccgaagacggtattgctgataaagggcgtgcagtatcgtggtcagatcaggcagctcagcgacgaagaagcaacggaagcgcgcaccgcctatcaacggcgttttccggtctcgcgcaaggtcgccgcgcccttatgggaaattacgctggatgagctgaaaatgacggacaatgcattgggatttggtaaaaaaattgtctggcaacgcgaggcgtaaataaagcgcccccttcctggcggaaaagggcgtaaggccgttacagcgcctgcagaatacgcagggattcacggttaaacgcgggcaggtccgcaggcgtgcggctggtgaccagtttgtcactgtcaaccaccacttcctcgtcgcggaagtcggcaccggcattgatcaagtcaatggcaatggcttttacgctggtcattttacgaccgcgtacaccattcgcactgatcaacagttgtggcccgtggcaaatagcaaaaatgggtttgccgctcgccacaaattctttggtaaaggcaacaaagcgatcgtcaccgcgcaatgcatccggtgagtgtccgcctggcaacagcagggcatcaaattctgccggactcacttcgtcgatactgcgatcgatagtgacttcagcctcaccctgtttgcctttcacggttttgcccgcttgctcctcaatcgttaccacttcatagcctgcgcgtttgtagatctcggctggcgaggtaaactcagagtcttcaaattcatcggtgatcagaaccgcaattttggtgctcatctttaccctcctttaggcatgttaggcgcatactgcgctatcctgattacctgttaagtctggttgtcgattctgagaacgcaagccaggcggctcacattggccagattttgcacggctggcggctaaacagggaatattccgagatgaatcgtatattactgacgggcgcaaccgggttagtgggatcgcacctgctgcgtttactgatcgctgacccgcgcgttgatgaaattattgcgccgactcgccgtgcgctgccggcgatgaataaagtgatcaatccggttgaagccgatctaaccgatgtcctgcgcccgctggacacacccttgacgacggtattttgctgtctgggcacgacccgcaaacaggcgggcagtaaacaggcatttattcacgtagattacacgctggtggtggatactgcgttgaacggtttacgtctgggcgccagacagatgctggtggtcagcgcgcacggcgcaaatcgtcattccccttttttatacaatcgcgttaagggtgagatggaaaatgcgttgcgccatcaggactggccgcacctgacggtggtccggccttcactgttgctgggtgagcgaaaagataaacgccgtggggaaagtctgatggccccgctgttcgcctggctgcctggcaactggcgcgccgtctcggcccaggatgtagcgcgctgcctgcatcaccaggcgtttgctgaggaaaaatccgggttcacgctgatcgcgtcgggtgatatcccgcgtgcgtcagcgtaagtaccagatttgctgattgcggctgccacgccacagaagcgtggcatctttctctgccgcttcaaaccgcccgtcaatcatgacgtctatccagggcaggattgcccgctgcaccgggctgagcgtctgcatctcatagccggtccacaaccagatgtctttgcctgcacactcctgtttgacccgtttcaccaggcgacggatatgcggcacattgtggggatgcagcggatcgccgccgctcagcgataaaccctgacgcgggatgcgcgtatctttcaagtcagccagtagctgctcttccatcgccagtgtaaaaggcacgccagaatccagccgccaggtgctctgattgtaacagccacggcactggtgctcgcagcccgaaacaaacagcgtacagcgtgtgccggggccgttaacaatatcgacatcgtagtagcgatggatgcgcatcatcccagctgtccgctatcaaggtgtttcacccgacgctgaacctcctgctgtttaccggcgttgaacggacgggcatccgggcttcccaggtaaccacacacgcgccgcgtaaccgaaacccgcgcaggatcgtgattgccacagttgggacaggtaaagccacggctggtgcaggtaaactcaccgttaaaaccgcagtcgtagcactcgtcaataggcgtattagtgccgtagtaaggcacccggtcatagctgtaatcccaaacgtcttccagcgctttcaggttgtgctgcacattgggatattcgccgtaacagataaacccgccgttagccaacgaaggatagggcgcttcaaaatcgatcttatcgtaaggattcaccttcttctcgacgtccagatgaaagctgttggtgtagtagcctttatcggtaacgccgtttaccaccccgaactgtgcggcatccagacggcagaaacggtcacacaggttttcactgggcgtactgtaaaggctgaagccatagccggtttcgtctttccaggcgtcggtcgcggcgcgcatccgtgccacgatggcgacacctttggcacgcagtgtcgcatcatcgaaaggatgctgttttgcgccactcagggcgttcagggtttcatgtaaaccgatgtagcccagcgacagcgaggcgcgaccgttacgaaaaatcgggccaatctcatcatcggcattgagccggacgccgcaggccccttccatatagaggataggggcaacgcgggctttggttttttccaaccgggcgacgcgcgtcatgagtgcccgctttgccagcgccagccgctcatccagcaacgcccagaaacgggtttcgtcgccagcggcttccagtgcaatgcgcggtaaattcaggctgatgacaccgatgttgttgcggccttcatgaatctgcttgccgttttcttcataaacgcccaggaagctgcggcagcccatcggggttttaaaggaaccggtgaccttaacgacctgatcgtaattaagaatatcgggatacatgcgcttgctggcacagatcagtgccagttgcttgatatcgtagttaatatcgtccgtacggcggttgatgccttcacgaatcgtaaacaccagtttaggaaacacagcggttttgtggtttttacccagcccggccaggcggttacgcagaatggcggtctgaaccagccgtgctgcccaactggtgcccaggccaaaaccaaaggttacaaacggcgtttggccattcgccgtatgtaacgtgttcacctcgtattccagcgactgaaaggcgtcatagcactctttttcagtgcgctcgcgggcataggcttccgcctgaggaatgtgccagttctgagccacggcaaggtgcttagcgaagctcttttccacatagggcgccaacacttcatcgatgcgattcagggtggtaccgccataaatatggctggcgacctgagcaataatctgcgccgtaacggccgttgcggtggcaatggatttcggcggctcgatctcggcattccccattttaaagccgttggtcagcatgccttgcagatcgatcagcatgcagttaaacatgggaaagaagggcgaatagtcgagatcgtgatagtggatctcgccgcgctcatgcgcctgcacgacatctcgcggcaggatctgctgctgggcgtagtgttttgccacgatcccggccagcagatcgcgctgtgtcgggatcactttgctgtctttattggcattttcatgcagcagggcggcgttggtctgatccaccagaccgcgaatggcgtgatgcagctggctgcggcgttcgcgctctacgtcgcgatcgtgacgatactcaatataggcgcgtgccagctgaggataaggccccgccatcaacgtttcttccaccgcatactggatatcaccaatatccacttcctcgcgatcggccagttgggtactgacccgatcggctactgtggcgcaccagggtgcatcttccacatttgctgcccgtgccgccgccgcgaccgctgcagcgatacgctgtgcgtcaaagcctacgcggcatccgtcgcgcttcaccaccaccgttgccattttctctccattaactacatataggtgtgtttttggattctaggctcaacatgtagtaattgcagcgaattaattggcttgtttttgacctgaagcaaagaagccgtgaacaaggagataaaaccagcgccggaaaaaaaacgacccaggatcgcctttctctgcgcgctaatttgcttacgccacaaactggcttaactctgtttatcgttcttttttgccattgactcgcagggaaccgtgccagtgtcgtcacgccgaaagatgctgtgcattgaccttttccgctgccgcctagcggcaacaccaatgccctggctgagtccacagaacgcaacggctgaaggagggtgacgggaaaaacactctgagcacgggggtggcgcgctccgtgtgggttgaatgccgcgctgagcgcgcggcatgctaaaggtgaaatcaggatgaggtaatcgggccaccaaccgaatggcgacgtaccagcgtagggctgaacatattggtcacttcgggcagcggctgttgatgcgcgagagccagagccagttcggcggcctgctgggccatcgtgacaatcgggtaacgcacggtggttaaacgcgggcgaacgtagcgggaaaccagcacgtcatcaaagccgatcagtgacatctcttccggcacctgcacgccgttatcgctcagcaccgccagcgcaccggctgccatggagtcgttgtagcaggccacagcggtgaagtttttaccccgtcccagcagttcggtcatggcctgttcaccgccaacttcatccggttcgccccaggcgaccagcctgtcattgcagggcagaccatgctcctgcagcgcatcgtaataaccctgcaggcgatcttcggcatcggaaatggtgtgggtggagcagataaaggcaatattctggtggcccagttgaatcagatggcgcgtggcgagccaggcaccgtagcggtcatcgagcgcgatacagcgcttttcaaaccctttcagcagccggttcagtaacaccatgcccggcatttgcttcatcaacacttccagctcgctgtcggggatttttttggcgtgaaccaccagcgccgcgcagcgatgccgcatcagttgttcaatcgcctggcgctctttttgctcattatggtaaccgttaccaatcagcaaaaagttgcccgtctggcctgccacctcatcaacggctttaaccatcgcgccgaaaaaaggatcggaaacatcgccaaccaccagccccagggtttcggttgactgctgggccagcgcccgtgcattggcgtttggatgatactgcagcgattccatggcctgactgacagcctgacgtgaactgtcactggctttaggtgaattattgatcacgcgggaaaccgtggcgacagaaacacccgccaaccgggcaacatccttaatggtagccatgcgtttacctgattttggggaaacgtttacacatcgcaccagtgttacggaaaagcgggcgcacatcaagacaacagaatgccagcgctgtcgcaaacaaggtaaaatcagacggttggtgatgccttctgccagggacctggcccatgctatgctgcttatcccaacacctgccaaagcgatgaccatgaaaataaaagtgccacatctggcgcactggggcgccttcactgcggtaagcgaaaatgaccgtcttatcggctgtgaacctttttttgctgacgccgatccctcgccgatgctcaacaccattcctgaactggtttattcagacaagcgcattcgccagccgatggtgcgccgctcatggctgaaatcccgcgaaaacagcgaccgtacgctgcgcggacgcgaagattttgttgccgttgactgggataccgcactggatctggtggcagaggaaaatcgccgcattcgcgaacgctacggtgcgtcgggcatttttaacggctcttacggctggtcatcggcaggacgggttaaccatgcgcgtacgctggtgcgccgcttctacttccagggcggcggcggggtcgatcagcaaggcaactacagctggggcgccgcgcagtttttcctgccctacgtgatgggcacctacatgccgctgaccgggcgcgtcaccgactggccgcaggtggtggaacatgcggaagtgtttgtcgccttcggtggactggcgctgaaaaacgcgcaaatcgcatccggcggcgcaggccagcacagcctgaaaccggcgctggagcagctggcggcgaaaggcacgccggtgattaacatcagcccgatgcgcgatgactgtcctgcgttcgttaacgcagagtggataccgatccggcccaataccgatgtggcgttgatgcttgctctgggctatgaaatttatcagcgtggcgcgaccgacgaggcgtttctttcccgtcactgcaccggctggccgcaactgcgtgcctacctgctgggtgaaagcgacggcatcgccaaaactgccggctgggcaagtaagatcaccgatatcccggcggatcgcattgtgcaactggcccagcagctgatcggcaaacgcagttttatcacctgctcctattccgtccagcgcgcccaccgtggcgaacagccttactggatgatgatcgcgctctcttccatgctcgggcagccgggcttgccgggcgcgggcttctcgtttgggcacggctcaatgaacagcgtaggcaatccgcgtcaggaaggccccgcgccgatgatgagtaccgggccgaatccatcgggtctgtccattccggtggcgcgcatcagcgacatgctgcttaaccccggccagccttacggtttccagggcgacactctgcactatccggacattcatatggtgcactgggcgggcggcaatccgttccatcatcatcaacagcttaaccggctggtggaaggctggcagaagcccgataccgtggtggttcaggatattgtctggacggctgctgcacagatggccgatatcgtactgcccgcgaccaccacgctggagcgcaatgatatcggcggttcatcgcgtgaccgttttgtgctggcgatgcatcaggcgattaagccgcagcatcaggcgcgcaatgactttgatatttttgccgatctggcagagcgcttaggctatcgcgacaccttcaccgaagggcgcaacgagatgcagtggatagaacatctctaccagcaatgtgcggtggcgcatggccgtcgtggcattcctttccctgagttcgctgagttctggcagcgtggctttgtggagattcccgaaggcggcaagccctacatctttatggaagatttccgcgccgatcccgaggccaacccaatccagaccgccagcggtaaaattgagctgttctgtcagaccatcgcggattaccagctggaagatatggccgggcatccggaatggcgtgagcctcaggaatggttgggcgcggcagccagccgtgattatccgcttcacatgatctccattcagccatcggaccggctacacagccagttagatgcgacggccagcgttcagggcaacaaaaccgccgggcatgaaaccctgtatatgcatccggcggatgcggcggcgcgtgatatcgaggacggcgatgcgatcgaggtcagtaatgcgcgcggtaaaatactggctggcgtgcggttaacagaagggctgaagcagggcgtggtgatcattgccaccggcgcctggtttgatcccggctttggcaaagcgtggcagccctatgaccgtgcaggtaacccgaacgtgttaaccctggatatcggcacatcatccctgacgcaggggcccaatgccatgagttgcctggttgacattaaaaaacatgccgtttgcacaaaagcgtaaggatctcatggctggttacattttgcaggcatctgttgcgtttcagtcgtggcaaaaaagccgcaccgcttgctacagtcagggtcccagaggtattgatgggtgaacatcaattgattttttcttgattacaccgacctgcgtagatacgcaggttttttttgccctgaacaaaatgaacgataacgaactgatacacagttttcctgtgtttttgccagcgctttgattataactgctggattgacctcttttttttaagcgcagcggattgccatgccccggattaaaaaattactgggtaaagaccagataaaagccccgtttaaccctttccgttttcgtctgatctgcctcggcgtatttacctgcctggcggttctgctggcgcgcgtggccgatttgcagtttcttaaccagccgatgcttgagcatgaggccgatcagcgctcgctgcgcaccgtcacgttgcccaccagccgcggcacgttgctggatcgcaatggcgaagcgctggcgctcagcgtgccgtcgcgggacgtgatcgccgacccgcagcgcgtgctggagagcaatcctgattttaccagcgccaaatgggcctatctggcggcggcgctgagtatgcgacccgaagaggtggcggcgcaaatcaccgcgaacccaaaacgtcgtttcctctaccttggtcgtaaagtcgagctggggatcgccaaagacatcaaagatctgaagcttaagggcatcagtgaagtttacgatgacagccgtttttatccgatgagtgaagcctccgcaccgctgatagggattgtcggggccgataacacgggcctgaacgggctggaaaaaggcttcgataaagtcctgcagggccagccgggtaaagaagtttatcgccaggatgcggcgggcaatatcatctcgatgatcagctatcagccgcccacgcagccgcccacggtccagctcagcatcgataaattcagccagtacacgctgtacagtaagctgcgcgatggcgtgctgttaaacaaggccgattcgggcgcggcggtgttggtcaaaattgataccggcgagattctggcaatggcctcttatccgtcgttcaatcccaacaactatcagggggcaaccccggcgcagatgcgcaataccgccattaacgacagctacgagccgggttcgacggtaaaaccgctggtagtgatggaagggctggagcgccacctggtgcgaccggattctgtgctggataccacgccttaccgggttaacggccacctgattcgcgacgtcggccactggccacgtctgaccatgaccggtatcttgcaaaaatcgagcgacatcggcgtgtcgcatattgccctggcgatgccggcagaggcgctggtaaacaccttctatgcgtttggtcttggcaaaccgaccgggttaggcttaaccggtgaaagcgtgggctacttcccgttgcaccgcacgcgctgggcggatatcgaacgcgcgaccttctcctttggctatggtttgcgcgtcacgccgctgcaaattgcccgggaatacgccacgctgggttcctatggcgtttatcgtccgctgtcgatcaccaaagtcacgccgccggtgctgggcaagcaggtcgcgaacccggaaacggtgaaggaagtcgtgcacatgctggaaagtgacgtcttaccgggcgggaccggcgtcaaggcggcggtgccgggctaccgtctggccaccaaaaccggtacggcggaaaaaatgggcaccagcgggaagtatgacggtggctatgtcaactacaccgcaggtattgccccggccagtcatcccgaggtggcgctggtggtcatgattaaccatccgaccgcaggcgatcacttcggcggctccgttgctgcgccggtgttcggtaacatcatggggccggtgctcaagcacatgaatattgccccggatgctatctacagcaagcctgtggatagcggttcagataaatcctaaccaaatcaaactgtaagcgaggtgtggatgtttttacacctcgtttcatttcgccgaattcattttcctttttcatctgtccctgtccctcacagagtgagaggatggaaatcccagaggtattgatgggtgtgaaaacgggcactgctccggcaaggccaatcgttattacaccaacccacgcagatgcgtgggttttttttgcctgaagcacaggcctgccttcgtcgccggcatggtcagccatcgtatccacgcggcctttctctgcgcgctcgccttgctgacagcagactggtaaggtttcttaacgcaaaccttacggtttggcgatggaaagtcgtaacacaagtagctgataatctttgctgatgccgtttcgatgaatcctcctcctgatgaggattccctttttcctcaatatctgaagagttcgatgactacttacgtctcccgttcccgtggttcccgctggctgaaatggctgcttctgctcattgtgctgctcattgtcgccggcgtggcctggcgtctgctgggccatagaggcgcagggggcaatatgcccgctggtggtcatgcgcgccacgcgggtcccggtatgctgaagggcggtacgacgctggtgcacagcggcaccgccagcacggccgatgtgccggtctatctcaacgcgcccggcacggttattcctaacgccagcgtgacagtcaccagccgggtggacggtcaactggaaaaggtttacttcaccgaagggcagaaagttgaagcgggccagctgctggcgcagatcgatccccgcagctacgaggcaacgctgaaccagtatcagggcgagctcagcgaaaacgcggcattgctgaaaagcgccgaactgacgctggcgcgctaccgcaaactggcggctcaggactccctgtcccgacaggatttggatacgcaaatcgcgaccgtgggacagtatcgtggtgcggttgccgccgatcaggcccagatcgccagcgccaggcttaacatcggctacgcgcgcatcaccgcgcccgtcagcggtcgggtagggctacgtcaggtcgatccgggcaatatgattcagagcagctcaaccaccgggctggtaaccattacccagatgcagcctgccgccgtcactttcagcgtgccacaaagccatatcccgacgctggtgaaagcccttcatcacgatcagacgctgcccgccaccgccttcgatcaggataaccagcatgtgctgagtcagggacaggtgaaatttatcagcaatgagatcgacacggcgaccggcaccattgcactgaaagcgatgtttgctaacgacgacgaggcgctgtacgccaaccagtttgtgaacgttcgcctgcaaaccagcgtgctgaaaaacgccaccatcattccggcgcaggcgttgcagctgagcagcgacggcagctttgtctttatcatcaataaagacaacaccgtcacccggcagccggtcaccgcaggcccggcgtatggcgaagcgtggcaggctgttctgcagggcgtgaagcccggcgaccgcctggttacagaagggatcgatcgcctgaccaacggcagtaaagtcgcggtcgcagacagcactcaaccgaccgcacctgccgaggcccaatgaatccgtcacgcctctttatcctgcgaccggtcgccaccatcctgctgatggccggcgtgctgatcgccggtatttttgcctaccggtttctctccacctcggcgctgccgcaggtcgattacccgaccatccaggtgacaacgctctatcccggcgcgagtccggatgtcatggcctcgacggtgacttcgccgctggagcgccaactggggcagatgtcgggactcagccagatgacctcgaccagctccagcggatcgtccatcatcacgctgaagttcagcctggatctgtcgctggacgtggccgaacaggaggtgcaggccgccattaacgcagccagtaatctgctaccgaccgatctgccgaatccgcccacctataagaaagtcaatccggccgacagcgcggtgatcaccttagctgccagctcggacacgctgccactgacgcaggttcaggatctggtgaatacgcgcgtggcactgaagctgtcacaaatttccggcgtgggcatggtgacgctcgcgggcggccaccaaccggcgattcgtgtgcagatgaacccacaggcgctggcggcccacggcctgacgctggaagacgtgaatacgttaatcagcaacagcaatgtcaaaggttccaaaggtggatttgacggtcgctatcactcggtgacgatcgatgccaatgaccaactgcgcaccgctgccgaatacggcaacctgatcctgacctaccagaacggggcggcgctgaggctgaaggatatcgcgcatatagaacaggggccggagaacagctttcagtctgcctgggccaacggcagcccggctatcgtaatcggcgtgcagcgtcagcccggggccaatgttatccaggtggtcgacagcatcaaggcgcagttgccgacgctgcaggccgcgctgcccgacggcgtgaaaatgacggtcctgtccgatcgtacccagaccattcgtgcttccatcagcgacgtgcagtttgagctgatgctctcgattgcgctggtggtgatggtgacgtttctgttcctgcgcaacgtggcagcgacgctgattcccagcgtggcggtgccgctctcgctggtgggaacctttggcgtcatgtatctcgcgggcttcagcctcaataacctgtcgctgatggcgctgaccatcgccaccggctttgtgatcgacgacgcgattgtggtggtcgagaacatttcccgacggctggaagcgggcgagccaccgatggaagcggcgttaaaaggatcgcagcagattggctttaccattatctcgctgaccttttccctgattgcggtgctgattccgctgctgtttatgggcgatgtcgtaggacgcctgtttcgcgagtttgccatcacgctggcggtgtccattctggtctcgatgctggtctcgctgaccttaacgccaatgctctgtgcctacctgctgcgccatattccgccagagaaacagtcccgctttgcgcgcaaaggtggcgagattttcgatcggctcattcgcggctatgatcgcctgctgaccctggtgctggatcatcagaaactgacgctgctggtggcgctggcgacctttgccctgaccgcgctgctgtatatgattgtcccgaagggcttttttccgatccaggataccgggttgattcagggcgtaacggtggcttctcaggacgtttcctttacggagatggcgaagcgtcagcaggcgctgtctgcggtgatcatgcagaacccggcggtcgagagcgtctcttcgacaattggtattgatggcaataacaccagcctgaacagtggtcggttacagatcaacctgaagccctttggtcagcgcgatgacaaagccgctgcgatcatcaaacagctccagcaggcagcaacaggcgtggtcggcattcagctctacctgcaaccggcacaggatctgaccgtcaacgatcaggtcacgccgagccagtatcagttcacccttgatgatgccaacagcgaagacctggtgacctggtcgccgaaactggtggcggccttgcagaaacggcctgagttcaacggcgtggtcagcaacctgcaggatcagggccgggtcgcttatgtcgaactgaaccgggacaaagccgcgcgcgttggcgtcaccgccgcggacgtggataccgcgctctacaacgcgtttgggcagcgtctggtctcgacgatctttacccagtcgaatcagtatcgcgtggtactggaagttgcaccgcagtaccagcaaagcccggcctcatttgatgatgtgtttctgaaaccctctgccagcacgagcagcagcgcatcaggcagtacgtccaccagcaccagcagcacggaaaccacgtcaacttcgaccgccagcagtcccacggcaacaacgaccagcagcagcggcatggtcaaactcacctccatcgccacgatccaccagcggaccggttcgctgatgcatatgcggctgaatcagttcccggcggtgatgatctccttcaacctgagtgacggctattcgctggaagatgcgcagaacgccattagcgaggtgactgcacagctgcatctgccgtcggcagtgacgctgcgttatcaaggggaaacctcggcgtttcagagtgccaccagtaacacgttgtggctgatcctggcggcgctgctcacgatgtatgtggtgctgggcattctgtacgaaagttttattcatccggtgaccattctctcgacgctgccctcggcggcggtcggcgcgctgttaaccctgctgctggccaatacggcgttcagcctgattgcgctgattggggtcattctgctgatcggcatcgtcaagaagaacgccattatgatgatcgactttgcgctggaggccgaaaataagcagcatctttcgccccgggacgcgattcaccaggcctgtttgttgcgtttccggcccatcctgatgaccaccatggcggcgctgctgggcgcgctgccgctgatgctggcctccggatcgggcgcagaactgcgccaaccgttggggctggtgattgtcggcggattgatcgtcagccaggtgctgaccctgttttctaccccggtcatctatctgtggtttgacggcatcgcccagcgcggcaatgcctgggtgaaacgccgacagcaacaggcgcggagcgggcaatgaacctgacccggctgtttatcttccgcccggtcaccacgctgctgctgacgatggcgatcctgctgctcggcgtgctgggctaccgcctgttgccggtggccccgctgccgcaggtggatttccccaccattatggttaacgccagcctggccggtgccagcccggaaacgatggcggcaaccgttgccaccccgctggaacggtcgctgggacagattgccggcattaccgagatgacctcgaacagttcacagggcaccagcaccatcattttgcagtttgaacttaatcgcgatatcaacggcgcggcacgtgacgtacaggcggcgatcaacgccgcacgcagcctgctgccgagcgcgatggcgtcgctgccgacctaccacaaagccaacccgtcggatgcgccgattgtgatgctggcgctgacctccgccacccgcacgccgggggaactctacgatctggccgaaagcaaaatcgaacaggcgatggggcaggtcaaaggcgtgggtgatgtgtcgctgatggggagcgcactgcccgcggtgcgcatcgatctgcagccgcgtaaactcatccatgcgggtatttcgcttgatacggtgcgcagcgcagtggccaacagcaccagtaatctgcccaaaggctcgctacagggcagcagccagtcgtggatggtggacggcaatggacagctggacaaggcagccagctatcgcaacctgattatcagcaacaaagacggcaatgtcgtgcgcctgggcgacgtcgccagcgtgtacgattcggtggaggaccgctatcaggcgggcttcctcaatgctcaaccggcggtcatggtgggcatcaagcgccaggcgggcgccaatatgctggacaccattgacgccatcaaagcccaactgccagccctggaaaaagatctgcctgccgatacccagctgaaggtggtggtggaccgttcgccgggcgtgcgcgcctcgctttacgataccgaagaaacgctgctgattgccgtgctgttggttattgcggtggtgtttgtctttttacgcaacctgcaggccgtcatgattccggccctggcgttgccggtctcgctgatcggaacctgtgcggtgatgtacctgctgggctacagcctggataacctctccctgatggcgctcatcatctcgaccggctttgtggtcgatgacgccatcgtggtgctggaaaacatcacccgccatattgaagccggacatcgcccgttgcgagcggcactgcgcggtgcgcgcgaggtcagctttaccgtactgtcgatgacggtatcgctgatcgccgtgtttattcccatcctgctgatgggcagcctgctgggtaggctgtttcgggagtttgccatcaccttgaccgtgtctctgctgatttcgatgtttgtttcgctgagcctgacgccaatgctctgcgcacggctgctgaagccgaaacccagcgtatataagcgcccgcatccgttctatcagttgattgaaaatcagttaaaccaagcacttgcggcttactctcgtggcctggactgggtgatgcgccatcagaaactgaccctgttcagcctgctgctcaccgtactgcttaacctgtttctttatacggtggtgcaaaagggtttcttcccggaacaggataccggcctgctgatgggagccttacgggcggatcagaatatttcgtttcaggcgatgaagcccaaaatgctgcagttcaccaacattattcggtccgatccggcggttgaaagcgtgatgtcgtccatgggcagcgggatgtttggctcgcgcaacaacgccgacttttttgtccggctaaaagattttgatcagcgtgatgccacggccagcgaagtggccaaccggttaagtcagaaaaccagtaagatccccggtgcgcagctgtttctgatggcggcgcaggacctgcacatcggcggacgcagcgccaatgccagctaccagtacagcctgcaggcggacgaccttgcgctgctgcgcgaatggacgcccaaagtccaggcggcgctggcggcgattccgcagctcaacagcgtcgattccgatgcgcaaaccggcggtcaggaagtgatgctgactatcgaccgcgaccgggcgacccaactgggcgtgaatgtgaagatgctggacaccatgctgaataacgccttcagccagcgccagattgccacgctgtaccacacgctgaatcagtatcatgtggtgatgtcgctgcaggacagcgatacccgcgatccggcgattctgcagcagctttacgtgattaacgataacggcgatcgcattccgctgtcggcctttgtcagcttcgcgggcggcaatgccccgctgacggtgacacatcagggacagtctgcgaccagcaccatcgcctttaacctgaatgacggcgtgtcgctggagcaggcggaggcgctgatcaagcaggcgatggcccggcttggcttgccctcaacgattcaggcgggctatgccgggacggcggccgagtttaaccagttaaccgccacaatgccgtggctgattgtggcggcactggtggcggtctatatcgtcctcggcgtgctgtatgagagctacattcacccgctgaccattctgtcgaccttgccctcggcgggcgtgggcgcgctgctgttactgttactgacgaacacccagctcacgataatcgcgcttatcggcattatcctgttgatcggtattgtgaaaaagaacgcgattatgatgatcgactttgccatcgatgccgagcggcggctgggcatgtcgccacagcaggcgattacccaggcctgcctgatgcgcttccgtcccataatgatgaccacgctggccgccttcttcggggcgctgccgctggcgttgggcagcggcggcgatgccgacctacgcagcccgctcggcattgccatcgccgggggattagcgctgagccagctgctgacgctgtttaccacgccggtcatttatctgtggctcgatcgcctgagccgtgccactcaacgtcaatggcgtcgtctgcgccatgcggaatcctgaatcatgaaatcacttattcccgccgtgctggtggtgctgttgagcggttgtactgtcggccctgattatcaacgcccgacgatggctatgccggttcactacaaagaagcgaaaggctggcagcaggccacgccgcaggacgaccagcacaaaggcgcatggtggacggtgtatcaggatgccacgctaagcagcctgctcagccaggtcagcatctctaatcagaatgtggcggaatatgcggcgcagtatcgtcaggcccaggcgctggcggcacagtctcgtgcagcgctgtttcccaccttaggctatgacgccagcacgacgcggagcggcagccacggcgctaccgacagtacgcgcaccaccagcagcagccatcaggctgcactgaatgccagctgggagctggatttatggggcaaactgcgtcgaacgcgggaagaaaatcaggccagcgcgcaggccagcgccgccgagctggccaatattacgctgagcgcccaggccgagctggcggaggactacttccagttgcgcatcatggacgaaaaaattgcgctgtatcagcagagcattgccgcctatcaacgctatctgagggtgatacagaaccagtatcaggcggggacagaatcgcgcgccacggtggctcaggcgcagcaacagttggagagcgccagcgcttcggcacaggattatcagtggcagcgcgctcaaatggaacatgctatcgccctgctggtgggcaaagcgcctgcggatttcagcctgcctgtggcaacgctgatggcgacgctgcccgcggttcccggcggcttaccgtccgaactgctgcagcgtcgcccggatatcgcctacgccgagcgtaaaatggcggcatccaacgcggcggtcggtgtggcggttgcgggttattatcccgatctcactctgagcgccagcggcggcgtgagtgcctctgcgctgcataacctgttcgccttacctaaccgcgtctggtcgttggggccagagctaagcggcacgctgctggacttcggcgcgacctcggccagtgttgagcaggcccgcgccgcctatgatgccagcgtggcgaactatcggcagacggtgctgacggcgatgcaggacgttgaagaccggctggtggagctgaataccctgcagggcgaaatcgccgcgcagcagcgcgccaccgccgccgcgcagacctcggcccaggtcacgcgcaatcagtatgaggccgggatgattgactatctggatgtggcgacaacggaaaacagcagcctgagcgcacaacaaagtttactgacgctaaaaagcacccagtgggtgagcagcgtggcacttatcgcagcgctgggcggcggctggcataccgcaccctgaaggcggacatcgcgctgaattctgccaataatcagttgtcgattccgcctaaatcctgcatcgtgagtggctgtttttcatgatgctaaggagccggcatgttattcacttttttccgcctggtatttcgcctgctgtggcgggtggaattacggggcgataccgctgaactgcataagcagaaggtgctgattacgcccaatcacacctcgtttctggatggggcgctgctggcgctgtttctgcccatcaaaccggtttttgcgatctattcgtcgatcagcgatcactggtttttacgtctgatcaaaccctatgcggatttcgtcccgcttgaccccatgaagccgatggcgctgaagcagctggtgcggctcatcgacagcggtcgcccggtggtgattttccccgagggccgcattaccgtcaccggatcgctgatgaagatctacagcggggcaggctttgtggcggcaaaatctggtgcaaccgtggtgccgatgcgcattgaaggcgcagaatttaccccctttggtcgcctggcgggcgtctttaagcgccgtttgttcccccgcattaccctgaacattttacccggcacccatattccaatgcctgaggcgaagcgcgcccgtgatcgtcgcgtgctggccggtgagcacctgcaccatattatgatggaagcgcgcatggccgtgcgcccgcgggaaaccctgttcgaggcctttctcaatgcccgccagcgctacggcgcctttaaacgctgcattgaagacgtaaatttcaaacccgacagctacaccggcttactgaaaaaagccctgggcgttggccgtattctggaacgttacagccagcccaaagaatatgtcggactgctgctgcccaacgcgacggtcacggcggcggcaatcctgggcgcgtccctgcgcgggcgcgtgcccgcgatgctgaattacaccgcaggcgtcagcggtatgcgcgcggcgctcaccgcctcccaggtgaaaacggtgtttacctcccgccagtttctggacaaaggtaacctgtggcacctgccgcagggtctgacagaggtgcagtggatttacctggaagatctgaaagagaccgtgacgctcaaggacaagctctggatactggcgcacctgattgtgccgcgccaggcccaggtggcgcagcagcctgaagaggcggcgatggtgctgtttacctcaggatcggaaggtcatcccaaaggtgtggtgcactcccacaaaagcctgctggccaacgttgagcagatccgtaccgtggcggactttacgccgcgcgaccgctttatgtcggccttgccgctgtttcatgctttcggcctgaccgtagggctgttcacgccactgatgaccggcgcgcaggtgtttctttatcccagcccgctgcactaccggattgtgccggagctggtttatgaccgtaactgcactgtgctgtttggcacctcgacgtttctgggcaactatgcccgctttgctcagccctatgactttgcgcgcctgcgctacgtggtggccggggcggagaagctgcaggagaacacgcgccagctgtatatggacaagtacggtatccgtattctggaaggttatggcgtgaccgaatgcgcaccggtggtggcgatcaacgtacccatggccgccaaagcgcataccgttggccgcatcctgcccgggatggattctcgtctgatgtcggtgccgggcattgaaaacggcggtcgcctgcaactgcgtggccccaacatcatgaagggctatctgcgggtcgaaaaccccggcgtgctggaaaccccggcggccgataacggcgaagggcagatggaagcaggctggtacgataccggcgatatcgtcagctttgatgatggcggcttctgccagattcaggggcgcgccaaacgctttgcgaaaatagctggcgagatggtgtcgctggaggtggtggagcaaatcgccctgaaagcctcaccggataaacagcatgctgcctcgctacgccctgacggtaatcgtggtgaagcattagtgctgtttactaccgacagcgcactggcgcgtgacggcctgcaaaaagccgcccgcgagctgggagccgccgatctggccgtgccgcgcgatatccgcgtcgtaaaaacgttgcccttactcggcagtggtaaacctgactatgtcaccctgaaaaaaatggcggaagaggaacaggcatgatggtagaacgtgatgcgccgttattgtcgcgcggcatgatagcggtaatggtggcgcagtttttctcggcgtttggcgataatgccctgctttttgccactctggcgctgttgaaaaaccagttctatcccgactggagccaaccggtcctgcagatgctgtttgtcgcgacctatatcctgctggccccctttgtggggcagatggctgacagttttgccaaaggccgggtgatgatgtttgccaacagcctgaagctgctgggcgcgatgatcatctgctttggttttaatcctttcctgggttacaccctggtggggatcggcgcggcggcgtattcgcccgccaaatacggcatcctcgtggaaattgcccatgacgagaagctggttaaagccaacggactgatggaagcctcgaccattgcggccatcctgctcggttctgtcgcgggcggcattctggcggactggaatctggttgccgcgctggcggtctgcgccctgacctatgccgtggcggtaacggcaaacctgtttattcccaaactgcaggctgcacgtcccggccagagctggaactttgccgcgatgctgcgcagttttagccgcgcgacgcgcgtgctgtggcataaccccgaaacgcgcttttccctgctcggcaccagcatgttctggggcgctggcgtcacgctgcgttttctgctggtgctttgggtgccggtggcgctgggtatccaggataacaaaaccccaaccacgctgaatgccatggtggcgatagggatcgtggtcggcgcggcgctggcggccaggctggtgacgctggaaaccgtgcgccgctgtatgcctgccggtgtgctgattggggtgatggtagtgattttctcgctgcaacataccatgctgaatgcttacctgctgctgctggtgattggcgtactgggtggtttctttgtggtgccgcttaacgcgctgttgcaggagcgaggcaaacagagcgtcggcgctggcaatgcgattgcggtgcagaacctggttgaaaacaccgccatgttggtgatgcttgggctgtataccttagccattcgggccggtgcgcctgcagtggcaactggcatcggcttcggcgcgctgtttgcgctggcgattaccgtactgtggctgtggcgtccgtcctcccgcacctgatgtaacaacggcagggcgcgctggccctgccgttatctccctttcttcttcctcttcctgacgctgtcgccagtgaaacggtgtctcttttttggcgacgttttatatttactattcaaaataatatagtttatttggttattgtttttttctgttattttattttaattaccataactttttgcaatgaataattaatttaaacttgaaatcgaattcaaggttaaaaaatttgaaataaatatttatttattattgccgattaatttctggcttcctttgagaattcactcggggaaagaaaggagcttggtttaatgaatatgacgcaaagactctctctggctttttcacttctggcaggttcgttaattattctagggatcgtaaccatttcacttctctcaggttttcaggcgagatttgaatatgtgcaggtaaacacaattgattcgctcaaagtgctgaatcggttggtagatgaaagtaatcgcctctctgtggcgttatatcgacatcagaccgaagatgagagcggtaaactggccagccttgaaacggtgattcaaaaacgtattgaggatatttcgacattaacgaaatattatttcgataatgatattaccaatgacgaagatcgggcgatgacggataagtcactccggctgatcgatgccgttaaacaaagtctgccagcgtttctcacggcctcccggtcgcatcagaatgcactcagcctgtcgttgttaagtgatggtgaaggcattggtggcgccatcactcagctcaaaagcagttatcgcaatcagttcgagttcaacagcaaaattggtgaagcgttacgtcagcaaaaccaacatatttatcagttgaccaaatggggcatggtggccggtatcgcactggcgattatcggcctgggcatgttgacgattttaaccatcatgcgcgtccggcacagcctgaacgccattggcgagctgatggagcgtgccagcacccatcttgatctttccctgaaggccgatgacagccgacgtgatgaagttggcatcatggcgcggtcttataatcgtctgatggaaagcatctccgccgccttgcatgcggtcagcagcgcttcacagtcggtcagcagtgcgtcgggccagattgcggcgggcaatgaggacttgtctgcccgtacggaagagcaggctgcctcgctggagcaaaccgcggccagcatgacccaaatcagcgaaaccgtcaggcagaccgcagacaacacgcgccaggcaagccaccttgcagaaaacacgcgcaatctctccgacaccagttcagccgcgctcaatacgatgctggagacaatgcaggcgattcgtgacagctcgggtaaggtgggggaaattattaccctgattgaaggcattgcgtttcagaccaatattctggcgctgaacgcggcggtcgaagcggcacgcgcaggggaacatgggcgcggctttgcggttgtggcgggcgaagtacgcaatctgtcgcagcggtccaccaccgccgcccgtgaaatcaaagcgctgattcagacgtccaatgggttgatcgcatcgggaacgtcccaggcggataacgtgaatcacaatatggagacgatgcgcggtgcggtcagtcaggtcaccgatctggttaacgaaatcgccgctgcggccaccgagcagagtcagggcatttcgcaggttcatcaggcggttaatcagatggacgatgtgactcagcagaatgcggccctggtcgaagaagcctcagccgcgtcgctctctttacaggagcaggctgatacgcttgctgcgctggtgcggaagtttacgctcgcaggtccgcaggcggcggtagtcatgcctcgggctaaacccgcagccgttgtggcatccagaccggcgctggccctggcggcaggcgggcaggataactggcaaagcttttaagaggacaggtctgaaagcagagtaacaggtcggcggtgagaagggcgaatccgtatttacgccaggccgaaagccgcgtgcgcactcagcagtgcgcacgctttttttatcaacgacgcagcgcgatcgcttcaatctcaatcttcacgtcttttggcagacgggccacttccacgcaggaacgcgccgggaagggcgcattatgctcggtaaaaaaggcttcgtaggtggcgtttacggtggcaaagtcattcagatctttcacgaataccgtggtcttcacgatatcggcaaccttcaggcccgccgcttccacgatcgccttcacgttttccagcgactggcgcgcctgtgctgagacgtcttcggcgacgtcgcccgtggccgggttcaccggaatctgacccgaggtgatgatcatgctgccgagatcaacgccctgcacgtatgggccgatagccgctggggctttttccgtactgatttcacgagacatcatttctccttagataaaggccgtggcagcaaaggcgctgcccgccataaaacgcggttcattataagcgcggcagggccgattaaaagtgacccaataccacatgacgggcgaactctttctcacagtatttacatttcaggtgcacctcatcggcgcgatgcttcacggcaaagctggagcacaccggttcgctgcggctgatgcagttgctgttcggacaggtcagtacccggtctatccggtccggcaacgtgggcgcgatcttggcgaccacttcataatcatcaatgcggttgacggtggcgtgcggcgcataaaacgccagctgattgatctgatcttccgtaaggtaagtgttttcgatcttaatcagatctttgcggcccatctcaccggagggcaggttcaggccgatggtgatgcgctggtcggtttcggtcagacgaaacagcgacaggagcttaaagcccacctgcgcagggatatggtcgataaccgtgccatttttgatggcttcaacctgcagtttgttatcctggctcatactgtcactccttacagggcggtgtcgcggtttaagaccagtgccagcaaagcctggcgtgcgtagatgccgttaccggcctgctggaagtaccaggcgtacggcgtgctgtccacgtcggtggtgatttcatcaatgcgcggcagcggatgcagcaccttcatgttatcgcgggcaccgttcaggtctgccgcgcgtaaaataaactgcgctttgacgttggcatattcggacggatcgagccgctctttctgcacccgcgtcatgtagagaatatccagctccggcatcacctcttcgaaactgtcgtggcgtgaccaggcaatattctgctcatccagcatatccgtaatataggccggcatcgccagcgcatccggggcgataaagaagaagcggttgccgtcaaacttggccagcgcctgggtcagcgagtgcacggtgcgaccatatttcagatcaccaaccatcgccacgttcaggttgctgagtcggccctgggtttcatggatggtaaacaggtccagcagggtttgcgtgggatgctggtttgccccgtctccggcattcagaatcggaatgccattggaaaactccgtagccagtcgcgcagcgccctcctgcgggtgacgcattacaatggcatccacgtaggtgctgatcacggaaatggtatcggccagggtttccccttttttgcccaacgaggtattgctgccgtcggcaaagcccactgcggacgcgcccaggcgatgtatcgcggtttcaaatgacagtcgggtgcgggtcgaggcttcgaagaagcaactggctatcacgttatgcttcagcagttccggctgagggtggttttttagctgcgcagcggtgtgcagcaccagctccagctcgtcgcggctgagatcgttaattgaaatgatatgcttgcgatatagcgggttagccatagctctctcctctgcgcggccggataacggacaaaaaaaagccccttatacaggggcttttttaagatcggttcgatgacggaaagaaacagcggtgccgcctgcattgaggcgaggtagcgcgtcacattgtccacgatgctgttgcatgtttcctccggcaaattgtggcgcattatacgccatcaggaatgggcatcaaggaaaaatcgcgcagcaggtaaacgtttgcggttgcccgatcagcgctgtcccagggtggctaccatcaccgctttaatggtgtgcatacggttttccgcctggtcaaagacgatgctgtgtgccgattcgaagacgtcattgctgacttccattccatcctgcaggccatactgttccgccatctgacggcccagcgtggtctgatcgtcatgaaatgccggtaagcagtgcagaaatttcacctgcgggttgccggtcagcgccagcattgcactgttcacctggtagttgcgcagcagggcaatgcgttcttcccacactgctttcgcttcacccatggaaacccagacatctgtatagatgaaatcggcacctttaacgccttcggcgatatcgtctgtcagcgtgattttgccgccggtcttctctgcgacctgacggcattgtgccaccagtccggcttccggccagcagctttgtggcgcgaccatacgcagatctaagccaacctgcgcggcggcttccagcatgctgttgcccatgttgttacgcgcatcacccacgtacactagcgtcatctcgctgagcggcttgcctggcaggtgttcctgcatggtcagcagatcggccagcagctgcgttgggtggaactcggtggtcaggccgttccagaccggtacaccggcatgttcagccagggtttcgaccagcgcctggccgtaaccacggtactgaatgccgtcatacatgcggcccagcacgcgcgcggtatctttcatcgactctttatggccgatctggctaccgcttgggccgaggtaagtcacgtttgcaccctgatcgtatgcggcaacttcgaaagagcatcgggtacgggtcgagtctttttcgaagatgagcgcgatgtttttgcctttcaggtattgggtttcactggcggttttttttgcgcgttttaattcggcggacaggctcagcaaatagtcaatttccgccggggtaaaatccagcagcctgaggaaatgacgttgatacaactgactcatacagcactccggtacgggtttcataatgaattaaaattcaatctaaccgtatgaatatgcattttcaaccctgacgagaataatcttttatgttttgtgtagtggcgcgacaggcagtatgggaaaataatcacttattgccgaactcagagaggatatcgccatggcatttgaagcattgttggaagagcagcgtgaagagacgcggctgatcatcgaagaactgttagaggatggcagcgatcccgatgcgctctataccattgagcaccatctctcctgtaacaacttcgactcactcgaaaaagcggcggtggatgcctttaaactgggctatgaagtcaccgagccagaagagctggagctggaagacggcacgaccgtgatgtgcgtggacattctcagcgaaggcgcgctgaaagcggaaatcatcgatgcccaggtagagcaactggtaaacctggtggcgaaatacaacgttgactacgacggctggggcacctatttcgaagatcccaatgccccggatgacgatgaagacgacggcgaggctatcgacgaagacgacaacggtattcgtcattaattaacgccgggcggagcctgctccgccttttctgttcccctgtgttgtctgaccgtcatgaattacgcacccttacttgaacccatacatcagtttttacgctgccgcacacctcaggcctggattgatgaggcgcgcaaaccggaaaacctgactctgctgctcaccgatcatctggtgtgcgaactcaaagcggcccaaaccgcggtgtggctgatccgcaaatacgttgccgacaagcccagcggtgaccagattctggcctggctgaagccttacgagaattttatctttcgtgaggacggcgacagcgattttatcaatgcgcataaaacgctgaccaaagccattatcgtacgtaacgaactgccgtgggctgacgatctggttgagaagatggtgctgctgatcaaagaagagctgcaccacttttatcaggtgtgggaaattatgcagtcgcgtgggctggtttatcagaaaatcacctcaagccgttatgcgaaaggtctgctgcgtgaagtgaccacccacgaacccgatacgctggtggataagctgatttgcggtgcctatattgaggcgcgctcctgcgagcgtttcgccagcctggcaccttacctggacagcgaattagagaagttctatatctcgttgctgcgctcagaagcccgtcattatcaggactatctgacgctggcggcgcagatttcgccaaaagatattacggcgcgcgtgcgggcgattggtgaggcagaggcgaagctcattgctgagccggacacggcgctgcgctttcacagcggtgtgccggcgttctgatgagagtaaacggtctctatctatgaccgtttactgtttgtaaatgtaatcagatagaatttatttataataaaaagataaatattaagtgttagtttaatgcgaatgcgttacctcagataaatataatttgcgtcactcatcacagaatgttttttctgctctgatttttatttgcggaataagtatattgctcttgccgaattagggttgttatttttcaagcaaaacctgattcataattcttctctgccagagaggattatgaatcgggttttttttcgtcgggtataacccggaaacagaattagcgactttctttgaagccacttttcctgaaaagcgtttaatggaaggattcataaaatgaggagaaagacctgtatttcgctatttatcttgccctttttgcagccacctgttgcatgggctgagtcttcgcaagcgttagcgctctctgactccgctttcctgcgcgattctcagttcaatctcaggctgcgtaatcactggaagtatctcaaggaaaatgaagcacagcctgtcactgttcataatgcctggggacaggcggccagtctgaattttcgttccggctatctgtgggactggctgggatttgatgcaacctatacccgagcgatcaggctggcagccagcgacaactttgctacgcgcggcctgctttacgacagcggcggtaatcagcgaaaagctgatgcgcatggctttagcaagtttggtcagcgctatctgaaagtgaagctgggcgacgggcacgcaggattggaagggaaagcgggctggcaggcattaaaaaataccggcgtgctgaccaccactgaccgcttatcacgcaatagttacttaggctatagcggcatgctcagcggacagaaggtgcggctggatttggcttacgtgacgaaaacgatccgacacgactcgccagacagtcttgccctacaaacgcaggacaaacggaaaattgctgcgatctatacgggcggcctgagctataacggtgaacgcggacggttcacttatgcatttggcgaagcggacgcctaccagcgtcgccatgttatcgaagcgagttactccctttctccgcactggcgtttgtcctctcaagtttatggcagtcaggggctggaaaattataaaaggatgtccgccagcacaagatcgttcgatgataacgcgtggcattatgttggtgaagctgaatggattaacactggatggacacataaattcgctgccgcctggagcgccgcgcccaaacataatgcggtgggatattatgcgcgcccgctgaccaaaaatacccgtggtcgttttaactcgctgacttctgccggaaaagattacacccgcgataaagaacttgcgctggtgtcgcagacgatgtttgaaatctcaaaaggcgtgtttagtggcattcagattaattatggacagtttacttatcgtcatcagcgtatacgttcgggggaatttgcgctcatcaatcgtttcactgaacctcatcccgccctgaagaatttatcgatttttacattgttcggctatggctggtcctacaaaaataataaagaaacacccgtttttaatgcgcaaggaaggtatatgcgttctcccaacctgtctgcggagattgcggttgagtataaattaaacctgtttaaataaggaaaatacgatgaaaagaatagttaaagcattgctggtttttatgatggtggggactctcgcaggcgaagccatcgccgccgatgtgaccctgtttgttacgcggcatggcaaaacaatgtttaacacggtgcagcgcgcacagggctggtccgatacgccgctaaccgcttctggggcggcggtagcggagcagttagggcgaggacttcagcctcttactttcatcgcagcctggtccagtgatgctggcagggccagagaaaccgcgcaacgtgctatgaagtcatggaagcggattcccacgcttaatgaacataaaggattgcgcgaagtctgttttggactttatgaaggtgatctggataagaatatgattactgctgcggcgcttcaggctggctatacctctgatgcggcgatgatgaacgcattcagcgcaggtaagattcacattgacgggattattgatgctattcatcgggccgaagcgtcgggtacagcctcactgccgggcatcaactccaccggacaggctgaaagctatcagcaggtggcaaaacgcatgctcgaaagcatgacagaaattgcacagcaggctcagcagcagggcggtggtaatgtgctggtcgtcagccatggcatggcgattaccgcgctattgcaagcccttggcgatacgtcgttaaagcagtcgctcgaaaatgcgagcgttacacggctgcgctacacagatagcggagagttcgtcattgagtccgttaacgacatgcgctacgtcgagcgcggcttatagtgcctttagcatccgcacttcgcagtcgacatggccggtgcagcccatcgcgctgtcgatatgctcaaagcccagtgactcatagagtttaatcgcccgtgtcaggctggcggtggtttcgagatagcagcggcgaaagccgtggcggcgtgcatgatccatcgcccgcagcgccagctcgcgcgccagaccctgaccgcgcaccgtcggcagaaaatacatcttctgcagttcacaaatgtcaggtgcgctacaggcgagaggcgcaacaccgccgccgccagccaccttgccctgatattcaataatccagtaggcgctctgttcggcactgtacaactcaaacaggtggtcaagctggggatcggatacggtatagcccttgtctgccgtaaggccgaactcggccgatacgttgcgaatcacctgggcgatgtgcggattgtcggccgccgtaatcggccgcaccaggaggtcaaaacgcgggttggcactggtcgtcatcatctcttccggatttgtacgaggtcaaaaaaaagccgggcaagcccggctttatgaataagctgtcagctacgatgcttacaatgccgcaatgaccgcctgctgttcaatcagttttgcttttgactgttccatctcagcaacgcgctcgcgctctttggcgacgaccgcttctggtgcgcgcgagacaaagccttcattcgccagcttggtctggattttttcgatttccacatccagcttcagcagctctttggccaggcgctccagctcggcggttttatccaccagatccgccatcgggatcagcagctctgcgccttcgacgattttggtcaccgaaaccggacctttctcgcccgcaggcagaatggtcaggctttccagccgcgccaggcgtgacaggaagttacggttcgcctcaacgcggcgctgggcagcaggggagcagtcacgcagcagcacatccagcagcttgctgggcgcgatgttcatctctgcacgaatgttacggacggcgatgattgcctgcttcatccactcgatatcggccttagcttcagcatcttctttcgccgcgtcgtactgcgggaacggctgcagcatgatggtgtcatcgctgatgtttttcaggcccttcacgcgctgccagatggtttccgtgataaacggaataatcgggtgcgccaggcgcagcagcgcttccagcacatggaccagcgtatggcgggtgccacgcagttctgcttcgctgccgctgttcatcaccggcttggtcagctccagataccagtcacagaactggttccaggtgaagtcatacaggatgttcgccgcaatatcgaagcgatagctgtccagcgcctcacggtaggcttttaccgtgtggttgaattccgtcagaatccaacgatccgccagcgacagcgtcatgtcgccgccgttctgaccgcagtcctggtcttcggtattcatcagcacaaaacggctggcattccagagcttgttacagaagttgcgataaccttccaggcgcttcatgtcccagttgatatcacgcccggtcgaggccagcgccgccagcgtaaagcgcagggcatccgtacccgatggctcgatgccgttcgggaactgcttctcggtgcgcttgcggattttttccgccagctgaggctgcatcatgttaccggtgcgtttttccagcagcgcttccagtgaaataccgtcaaccatatccagcgggtcaatcacgttgcccttggatttcgacattttctggccttcttcgtcgcggatcaaaccggtcatatagacggttttaaacggcacctgcggcttgccgttttcatctttgatgaagtgcatggtcagcatgatcatgcgggcaatccagaagaagatgatgtcgaagccactcaccagcacgctggtcgggtggaaggtgcgcagggcttcggtgttttccggccagcccagcgttgagaaagtccacaggcccgatgagaaccaggtgtccagcacgtcatcgtcctgacgcagtgcgacatcggctgccaggttgttttcgctgcgcacctcgtcttctgtgcggcccacatagacgttgccgttattgtcgtaccaggccggaatacggtggccccaccacagctgacgggaaatacaccagtcctgaatatcacgcatccaggagaagtacatgttctcgtactgcttcggcacgaactgaatgtcgccgttctccacggcttccaccgccactttggccagcggtgccgtgcgcacgtaccactggtcggtcagcatcggctcgataacaacgccaccacggtcaccgtaaggcacggttaaatcgtgaggtttgatctcttccagcaggccaagcgcgtctaccgccgcgacgatggctttacgcgcggcaaagcgctccatgttctggaacgcggcaggaatcgcgtcgctgtaagcggtgctggcttcgccgttggtatcgtaaacctgcgcgctgtcgcggatatcgccgtcgaaggtcaggatgttgatcatcggcagcttatgacgacggcccacttcgtagtcattgaagtcgtgcgccggggtgattttcacacagccggtgcctttttccatgtccgcgtgctcgtcaccgacgatcgggatcagacgatcaaccagcggcagcatcacaaacttgccgatcagatctttataacgtggatcttccgggttaacggccacgccggtatcgcccagcagggtttccggacgggtggtcgcaacaaccagataatctttaccgtcggcggttttcgcgccctctgccagcggatagcggatatgccacatagagcctttgctctcgcggttttccacttccaggtcagagatggcggtacgcagtttcgggtcccagttcaccaggcgcttgccacggtaaatcaggttctctttatacaggcgcacaaagacttctttcaccgcattggacagaccgtcgtccatggtgaaacgctcgcgctcccagtcaaccgagttgcccagacggcgcatctgacgggtaatcgttccgccggattcggctttccactgccagattttgtcgatgaacgcatcacgaccgtaatcctgacgggttttgccttcttctgccgcgatcttgcgctctaccaccatttgggtggcgatgcctgcgtggtcagtaccggcctgccacagggtatttttgccctgcatgcgctggtagcgaatcatggtgtccatgatcgtttgctggaaggcgtgacccatgtgcaagctaccggtgacgttcggcggcgggatcatgatgcaaaagctttcctggctggtgtcgccattcggtttgaagtagccctgcttttcccaatgctcgtaaagcggctgctcaatatcttgcgggttatatgtcttatccatttctgctatgtcgtttgcggctgtggcggcgttgccgtattcaattggaagccaacgctgcgataggctttatagcgatcgcgcgccagctgtttgagagcgtcttcgtaaggaacgaagtctatcacttcatggaaagcagtagcaaaatctgcgaactgcggcagcaggctaatcagcaggtcgcgtggcgaattcccccgacgctgcggccatgccagctctaccggtgcgccgtagcgcggaccttccccggcgagattgtggggcacaaaggcgttggcggggcgctgccacagcgcctcatcaaggcgaatggcttgctgctcatcttcacaggcgatgagcacccgcttaccggcccgccagcgtgtttccgccagatcgcacaccagcgcttcaacggcggttaagccctcgctggatgcatcggtttccaacacgtagaaggttgcgtttttcatcgaattgcctgtttaacgaaaagaagggcggagtaaactccgccccgatggggtcggttatccgtacgattaatcgtcgccgttcagaccggcacgatttaacaggaactgagacagcatcggtacaggacgaccggtggcacctttggccttacctgaccgccaggcagtaccggcgatgtccagatgtgcccagttatatttgcgcgcaaaacgggccaggaagcaagcggcggtaatggcaccacccggacggccgccaatgttcgccatatcggcaaaattggattccagctgttcctgatactcatcggccatcggtaaacgccaggcgcgatcgccggactgctcggaggccccaatcagctcatgcgccagcgggttgtggttcgacagcagtccgctgacgtgatgacccagcgcaataacgcaggccccggtcagggtcgctacatcgatgacgacttccggatcgaagcgttccacgtaggtcagcgcatcgcacagcaccaggcggccttcagcatcggtgtttaacacttcaaccgtttggcctgacatggtggtcagcacgtcgcccggccgcatggacttaccgtccggcatgttttcacagcccaccagcacgcccaccacgttcagcggcagattcagctcggcgaccatgcgcatcacgccatagaccgaggccgcgccgcacatgtcgtacttcatctcatccatgctgtccgcaggcttgatggatataccgccggagtcaaacgtcagccctttgccgaccagcacaatcggacgcgcgtcggtatccgggttgcctttgtactcaatcaccgacatcagggattcattgtgcgatccggcacccacggcgagataggcgttcatgcccagctctttcatctgctgctcgccaatcacgcgcgtcgtgatgtttttgctgtaggcatcagccagctgacgtgcctgagaagccaggtaagccggattgcaaatattgggcggcatattgccaagatctttggctgctttcaccccggcggcgaccgccagtccgtgttgaatcgcacgctcaccgctggttaactcacggcgcgtgggcacgttaaacaccagcttacgcagtggacgacgcggctccgctttgttgctcttcaactggtcgaagttatacagcgcctctttcgaggtctcgacggcctggcgcactttccagtaggtattgcgccctttgacgtgcagttcggtcaggaagcacacggcttccatcgagccggtgtcattcagcgtattgatggttttctgaatcacctgcttgtactggcgctcatcaagctcacgctctttaccgcagccaatcagcaaaatacgctctgacaggatattcggcacatgatgcagcagcagcgtctgacccactttgccttccagttcaccgcggcgcagcagggcgctgatatagccgtcgctgattttatccagttgctcggcaatcggtgacagacgacgcggttcgaaaacaccaactacaatgcatgcactgcgctgtttttccggactaccgctttttacactgaactccatgcactctcctgaatcttaaagacaacggccgcggctgccgctagaatgtagcgcgttcgtgacccatttattaagctaagcaacatgacagcgtgctgctggaggtcataatgaatcagggtgacaagatgttgttttttcatcacccaaacgcgattaccatacatttctagcgtcgacgacggccatttatgaagaaaaatggctaataagcgttgaaattagcgattttcctgcaaaaagacaagttttcacaggcgtattaagcgtgatcattattagatatctggttcgggaaacgctcaaaagccagctggctatcctgtttatcctgttgttgatcttcttctgtcagaagttggtaaggattttaggggccgcggtggatggcgaagtgccgacaaaccttgttctgacgctgttaggacttggcgtgcctgaaatggcgcaacttattttacccctaagcctgtttctggcgattttgatgacgctcgggcggctgtatacggaaagtgaaattaccgtaatgcacgcctgcggcctgagcaaggcggtgctggtcaaggcggcgatggtgctgatgctgttcacctcggtggtggcagcggtgaacgtcatctggctgggcccctggtcgtcgcgctatcaggagcaggtcacacaaaatgccaaggccaaccctggtactgcggcactggctgcgggacagttccagacgtccagcgatggcagcgccgtgctgttccttgagaacgtcaagggcaatcagtttggtcacgtcttcctggcgcagctacggccgaaaggcaatgcccgaccttctgtggtgctggcggacagcgggcacatggaacaaaagaaagacggttcacaggttgtgaccctggacaaagggacgcgctttgagggaacggcgctgctgcgcgatttccgtatcaccgatttcaccaactaccaggcctacgtgggctataagcaggcaatactcgatcctaacgatgtggatcaggccacgttcggcacgctgttagccaacaaaacgccagagtttaaagccgagctcaactggcgcctcacgttggtcttttccgtgctggtgatggcgttgatggtggtgccgctcagcgtggtcaacccgcgtcagggccgcgtgctctcaatgttgcctgcgatgctgttgtatctgattttcttcctgctgcagagttcgctgcgctcaagcggtgccaaaggccgccttgatccggccatctggatgtgggtagtgaatctcagttatctgacgctggcgatcttgcttaacctgtgggataccgtgccaatgcgtcgaattcgtgcgcgctttacacgcggaggatcggtctgatgtttcgcgttctcgatcgctatatcggtaaaacgatatttaataccatcctgatgacgctgtttatgctggtttcgctgtccggcattatcaaatttgtcgatcagctgcgtaaaaccggacagggtgcctacagcgctctggatgcgggctattacaccttgctgagcgtgccgaaagatattgaaatcttctttccgatggcggccttactgggggcgctgttaggtctgggtacgctggcgcagcggagtgaactggtcgtcatgcaggcagcgggctttacccgtatgcaggtcgccctgtcggtcatgaagacggcaattccgctggtgctgctgaccatggctatcggtgagtttgttgccccacagggcgagcagatggcgcgtaacttccgcgctcagcagctctacggtggtgcgctggtgtcaacccagagcggcctgtgggccaaagacggcaacaactttatctatattgagcgcgtgaaaggcgacaatgaaatcgacggcgtcagcatttacagcttcaatgacgatcgccgtttacagagcgtccgctatgctgcgacagctaaatgggataaagacaagaagctgtgggttctgtcccaggtagatgagtcgaatctgaccgatccgaaacaaattaccggctcacagagtctgggcggggaatggaaaacgaatctgacgccagacaaactgggcgtggtggcgctggacccggatgcgctgtcgattaccggcctctatgattacagtaaatacctgaagcaaagtgggcaggaagctggccgttatcagctcaatatgtggagcaaaatcttccagccgctgtccgtggcggtcatgatgctgatggcgctgtcgtttatctttggtccgctgcgtagcgtctcgatgggcgtccgcgtggtcaccgggatcagcttcggctttctgttttacgtattggatcagatttttggtccactcagcctggtctacggcctgccgcccatttttggcgcgatcctgccaagctttgccttctttgccatcagtctgtttatgctgataaaacggcgctaaatgctgacagtcagaaaggccgcgcgatgcggccttttttaatgggcgggcagacaataaaacgttatttcaggctaaggatgcctgtcacagacataaggtgcgatgccctgtcgccctgaacctgtttcagcgacgggaagtgcctgccagcgcggccttcagttgagcgcgtgtcatgcgtacgcaatatactggcgtcccgcgttcgaaacgccagccttcagctaacggccccacatcgaccggatcgaagccaaacgtgtcgtataacgtagcgacacgctttttagcctgctcatcatcccctgccaacggcagtgcacgtcggttcgcatcgcctgcaggcagcccctgaacctccaggtcggtcatctgaatggcattaaacgcttttacgacggtcgcgtcagggaactgctgggccagtctttcgctagtggttagcgtaccgttatccagttctgcaatctgtccatcgcgctcgggatagtagtttaccgcatcaattattagcttattttttagtcgtgatgatggaagatgtgccacagcgttaagtggcacggcaatcaccaccatgtcgctaaagtccgccgcttcctctacggtgccagcttcgcagccaatcataggtttcaggctaaatagtgtctgcggtccgcgagagttacttaacatcacctgatggcctgcctgggttgccagtctggcgatcgctcgtccaacaaaccctgcaccaataatgccgattttcattatgtcgtcctccagtattgtcgatagcactcacgttaattaaaaatatttggttgataaatacgcagttaagagcaagataaacaacaaaaaagagggaatgatggacaggcttaccagcatgaatgtttttgtcaaagccgcagaggccggctcctttgctgcggcagccgagcagcttcgactctcacctcaaatggtggcaaaacatatcgccagcctggaaacgcgactgggcacggtgctgctgaaccgcacgacgcggcggcaaagtctgacggatgttggccgtaattattatgaacgctgcaaggttgttctggcagaggcggaagaggccgacgcgattgccatggagatgaaaagcacaccttcaggcacactaaaggtgagcgcgcccctgactttcggggcgttcactctggcaccttttattacccgttatctggcacgctatacggaaattcaggttgacctggaacttagcgaccgcttagttgagccgttcgaagaagggtacgaagtagtgattcgtattggtgaattaacggacagttcattagttgcgtatccgcttaagccttatcggttgattgcctgcgcttcgtccacctatctggcacgaatgggcatgcccgcaacgcccgcagacctgatggatcacgtgtgtttggtgtatggcatctggtcaccgtccatgccttgtcgttggcattttcaacgcgctggcagggttgaggaagtaaaaccacagggtcgcttccgttctaatgactggaaggcgctgttgcacgcagcactggaaggacatggtgtgacgctcggcccggccgatgtgctgaatgaagagatcgaaaaaggccgacttatacagattttgcctgaatacgatggacctacgcggccaatgaatatgttaatccccgcaggtcgacgtcagacggtgaaaattcgcagttttgttgatgccattaatcagacatttggtctgcaccgcagcacaacggactgattcccgaggctacttttggcacgccagcagcgcctccacatctcccgacacaatctgctcaaggtgcgcagtaatccatgccggtgattggtcccaccacgccagcgactccagttgggccacgacctctggggcaaagcgggcacggacgggcttcgcgggattaccgccgacgaccgtgtaggctggcacgtccgaggtgacgacggaacgggaagcgataatcgcgccgttacctaccttaacgccgggcatgatcagcgcctcatagcctatccacacatcgttaccgatcaccgtgtcgcctttgtagggcagatcgccttcgcccggcatcaccttttcccagccgttgccaaagatctgaaacgggtacgtcgagatgccggacactttgtgattggccccattcattatgaattgcgcacctttggcaatggcgcaaaacttgccaataatcagcttgtcgccgatgaaggggtaatggtaaagcacgttacgctcgaagttttccgcgtccagcggatcgtcataataggtgtaatcacccacgatgatattgggattgcgaagggtgttcttgataaaacacacttgtggaaagcctggcaatggatgaggatttgcggggttgggtccgttcataaaggctccttttagctgacctcagggtagcgctagcgcgcgacgttaaggtgatgcgctcacgtctgcggcggcgacttcatcagcataacaccctttcagaagagtacctggtggtcagcttatcccgtcacaaatcaacgcaccatacagcgtctccgcctcgtctaacctgctcagcaggcaatattcatcggtctgatgcgccatcgacggctcgccggggccaagaataatgcagggcggattgcccagcgcgggcaacagcagtgaagcatcggtaaagtagggcacaatccgcggcaccagcggtgcatcatgcagtggctggcatcgttgataaaccgcctgaatccatgcctgatcgccttcactcagcacggcaggcagatccaccagcgtggaaaccgtcacactttcacccagtaaggtggtgagctgctggcgaatggtggcgtgctcaagattgggggcgctacgaatatccacgtcgaactgcgtgcggtcaggcacggagttgatgttgaggccaccagagatgcgcccgacgttgatcgtcggctgcttcatcagtggatgcggcgcgccgggtgagaaatgttgaattttacccagcgcatcagccgccaggtaaatggcattaatgcccagctccggcatcgcgccgtgggcggttttcccccgggtttcacagcgcagccacagtgcgcctttgtggccgataaccggataattcgcggtaggttcgcccacgataagcgccccgacctcgggcagcgtgacgttttcgatgagcgcccgcgcgccgtcgcagccggtttcttcaccgccggtgatcagcaggacaacgcccgtaccctgccgaatcgcctgctggtgcgtaacgcaggccacagcaaaggcggcgacggccgccttcatatcgctcgatccccgaccgtagagccgatcgcccgcgatctcaccaaaagcatcgtgttgccagtcggcattgccaagcggcaccgtatccagatgcccggtaaacgccagcgcaggtccgtcttgatcgccggacatccgggctatcaggttacggcggccttcaccgaaggtggacagcgtgacctcaaagccgttttcccccagccagtcggcaaaaaactgcatacaggcggcttcgttacccggcggattgatggtatcaaagcggatcaactgtaacgccagatccgccgtgcgggtgatcgtcatcagtggcgtaccgttaaccagtcgaggcagttgatccacagctgacgatagccctgccactgggaaaactcctgcggcagccagtgggccgacatatcgctggtccacaccagtgagcggccctgctgatattcgcgcaccgccagcagtggatgatccgtgccggcgacggtggccagcagcttgccttcgggatgcatttccacctcgttatagccaagcagccacggccactcgcccggcaaatcggcaaacaccgcgtgggattccgtcacgttgggatagcagccttcgggcgtttcaatccggtcgtcccaggccaggcaacgcaccggcagcactttttccaccgccgtgttgcgatagcgcgcgccgccattgatgccctgaaaactgaagtagccgccaatcatcatcagggcaccgcccgccgccacataatcgtggatcagcgtcaggcgattcgccgtgcgttggctcttcagccaggtatccgggtgcaggagcaacgtgtttgcaccgatatccgacagaatgatggcgtcccactgttgcagccccgccagggtcagcggaaacgccgtcgccgctgcatgggcgggcatataggtgatggcataatcactgtctgccagcgctgccataaagtcggttgcgccgttgtgccaggtggcggtcgcaaactgatcgaagcctttaacgtgtacggatgtgctggtccaggattcgccgaccagtaaaatgttcttctgcattacgcttctcccttacccaccaaatacgcgctgtgggttagcaatcattaaggtttcaagttgttcgccgctgacgccgtggcgtttcaggcgcggaacaaaatgtttaaggatgtagccatagccgtggccgccgtagcgggtgagcatggttttcaggaatacgtcctgggacagcaaaatctgctcgataaagccgtcatcaatcagttcgcggatagcgcgggcgttctcttcgtcggacggtgactgagcggactcatcggcgtagtaatagctcatgccgatcatgtcgtattccagaaacgcgccgcgctgggccagttcacgctgatagcgcttgtcggcaaagctggggttcatatggcacagcaccacatgacgcagatcggctccttcgtgttccaggatatccagcaccttgtggcccagccgttcccagccgggcaggtgaacttcaatcggcacccgggttgctgcactggcgcggcccgccgcccgcagggatttctcctcgctggcggtaaagcggctggacacgccgatctcgccgatcaacccggcgagtacgtcgggtttgtcttcccggccaccaaggtcgtaaatcagcttgtcagccagctcttcaatgctgagggttttcacccactccgggtgcgaaggttccaggtacaggccggtactcatgatgatgttcagcccggtcagacgcgcgatgcgctgcagggctttcgggtcgcgtccgatgccgatattggtcggatcgaccaccgtttcaccgccgagcgcacggaacttcatcagctcctcaatcgccaaatccacatcaaacagctgacagttgtcgcggctgattaacgggttgagtgagagctcgcccaggttttccatgctcaccggcatgtccgctaaatggcgatcgccacagcagcagggcggcacccacttgccggacgcatccagcagaatgtgttcatgcatcagtgtgacgcccatctcgctgagcggcagcggccccagcaccgtcatgacataaccgctgtggatgccaagcggcagagggtccggatgccgaaaaatggagtgtttcatcggctatcctttcgccgccgcgcgggtcggattgagaatgcgggtgttcagccagatcgccagcagaatgatggtgccggtggcaatctgggtatagaacggcgagatatgagacaggatcagaccgttctggataatggcgatcgacagcgcgcccagcagcgtaccaatcacggtgccgaagccgccgaacaggctggtactgcccagcaccacggccgcgatcacctgcaactcgaatccttcgccctgattagatgaaccgctgcccagacgggcggtaataatcatgcccgccagcgcggcggccatcccgctgatgatatacaccttcatggtcacggctttggtgttaatcccactgcggcgcgcgccttcggcattcgccccaatcgccgtcacataacgaccaaaacgcatatggttcagcacgatatggccgacaatcagcaccacgatgccaatcagtgccggcatcggcacgcccagcaccttagcgcggcccatcaaggcaaacaggctgtcggcagggatgggaatggagtaaccctgggtaatcagcagcgccacgccgcgtaccacggctaaggtcgccagcgtcacaataaaggcgggaatgccttcataggcgataaagaacccgttgatggcaccgaccagcgcgcccagcagcaggccacccagcaacacgaccggccagggcagtccccagctattcagtgcgatagccgacagtgcaccgaccagcgccagcgtcgatcccacggaaagatcgatcccgccggtggtgatcaccagcgtcatggccgtggccacgatcaacaagggcgcactctggcgaataatattgagccagttggcactgctgagaaagttgccggtgatcagggaaaacaccacgcaacagaacacaaaaaacagcgcgatgctgaccacgccagagtggttgtgcagcaggcgacgcggcaacgagtgttgggccatacgggaaccgctcagattcatgatagtcatcctgttacctcgctcagtgcgtcgccgcagagcgggcgacaaatttttcgcccacgatcagattgacgatctcgctcaggtcggtgtccgccacccggcgatctgccacgttcgtaccttcgtacatcaccatgatccggtcgcagaccaggaacagatcctgtaagcgatgggtaatcaggatcacgctgacgccgcgcgccgacacccgacgaatcagttccagcaccgcttcgacttcggccacggcaagcgccgcagtgggttcatccatgatcaggactttgggatcaaaggcggccgcgcgggcgatggcgatagcctggcgttgtccgccagacagattgcgcaccagcaaacgcgtgtcgggaatggagatgcccagacctttcagcatttcccgcgcatcggtatgcattttttcctgatcgagaaagggaatgccgaggatcgatttcatcggctcgcgtcccataaacaggttgcctgccacatcgaccgtgtcgcacagcgacagatcctgataaaccatttcgatatggcagcggcgtgaatccgcaggattactgaaatgctgcggttctccatcaatacgaatcgtgccgctggtgggcaccaccgcgccagacagcaccttggtcagcgtggacttgcccgcgccgttatcgcccaccaggcccagcacttcgccaggcgccagctgtaaattgacgccgcgcagggaacgtatcgcgccgtaggttttggtgatattcaccatctctacccgtgccggggcagtatgtaattgctgcattcgataactcccatcaccactcacgggaaaagctgaacggaggtaaaaaagcgttatcctgcacggtttacgcccttgtaaaccggtttacctgccagataaagcctttatgcataacctctgaacaaccgctgtaacgatatttgcttgccagatacgctattgcagcatccgtgccagcctgcagcacaggcattacacacgcggcctaaccagttgtttttgaacacgtttaaatgttaatttctggtaaaccggtttactaactataacgctgagaaatcaaaaagctcgttatttgcgctaaaattgtgcgcttttgcgccattttgggacgcagttagcaaatttgtatggaatcacgcgccacccattccaccgcaagacgggtttcggcggggatatcggcttcgtcattcaggatgcgcagcatgatgttaaccgcggtctggcccagttcccgggcgggctggcgaatggtggaaatgcggggttgggtaaaatctgcataggtggcgtcgtcgaatcccaccagcgacagcgcctcgggagcccgcagcccgcgcgcgcgcaggccatccagcaagcccagcaccagataatcactggcggcaaacacggcggtcgggcggtgcgtccggctgaacagatgctgaagcgcctgttctccaaaggtgcgctggtattcgccgtacatcacccactcggggggaacgtccaggcctgcctgcttcatggcggtgcagaaaccctgatagcgttcgcgcacgctcatcagttcatccggcccgcccacaaacgcgatgtgacgatgaccggcagcgatcagtttttcggtagcaatacgaccgccctgcacgttatcggcaaagacttttggcaccaggctgccgggaatatcttcatccagcagcacaatgcgctgatggcggttaatttccttacgcagcagtccgttatccgggtggttggtggtaaacagcaggccatccacctggcaggtatccagccagcgaataaactggctttctttgccgggatggttacgggtgatgcacagcaccaggctgtagccgtgggccgaagcggcttcttccgccgcgtccgccagttcggcgaagaaggggttggtgatatcgggcagcaccaggcctaaggtttcactgccgcctttgctcagacggcgtgccaggctgttgccgcgataatccagttggcgaatggcggcttcgatacggtcgatggtgtcctgcggcagcataatgctttgattcatatagcgggatacggtcgcttttgacagcccggccagcgtcgctacgtcggataacagcacccgttttttgatcatatccacagccatgttgcccagaatcggctatctgtaacacagttacgcgcaacggatacagtatttttgcgtcaggcctggcgataaaatattcgcttgacaaaaactgagcggaagagaatggtagagacagtttaccgcattacccgggagtcactcccaaaccggcttaacccgtttcaggtgttcaccataatggacagtgaacagaaacgacgttattcaggttcaggctgaataagcccttcctacgatatttgcccgccaacaataatccctctgcatttcgatgcggagatcgactggttatcgcgtattcccgacgaggaattttatgatgatgtcatttaacaccagaaaattgcgttctgttgcgctggcaacgggcttactggcagcgggttctgttttttctttggctcacgcagcaccgacttatgcgctggtacagattaaccagcaggccctgttttttaatcagatgaataagggcgcacaggaggcggcgaaagccagcggtaaagaagtagtgatttttaacgccaacgataatcccgtatcgcaaaacgacgccattgaaaattatattcagcagggcgtaaagggcattatggtggacgcgattgatgtgaacggcatcatgcctgccattaaagaagcggctgccgcaaaaattccggtaatcgcgattgatgcggtattaccggctggtccacaggcggcgcaggtgggcgtggataatctggaaggcggtaagattatcggtaaatattttgtcgactatgtggcaaaaaatatgggtggcaaagcgcggctggggattgtgggggcactgaattctgcggtccaaaaccaacgtcaaaaaggctttgaagacaccatcaagagcaatcctggcatcaccgtagccgatgtggttgacggtcagaacgtgcaggataacgcgatgacggcggctgagaacctgatcaccgggaacccggacttaacggccatttatgccaccggcgaaccggccttactgggggcgattgcggccgtggagaaccagggacgccagaaagacatcaaggtgttcggctgggatctgacctcaaaagctatcaccggcattgataacggttacgtcacggcggtgttgcagcaggacccgaaaaaaatgggggaagaagccgtgaaggcgctgaaccagattaccgcaggcaaaagtgtacctaaaaccattctggtaccggccacggtcgtgaccaaagccaacgtggacagctatcgcgcgatgtttaagtaactgcttactcgccgcctgcacgcagcagcgcggcgagttcgtggacggaggggaaggcgcttagcgtgccacggcgactcaccgttatggcggcggcctggctggcatgagtaagcgctaacttatctgtctgaacctgacggatgagcgccgacgccagcatcaccgcaagaaaggtatcgcctgcgccggtggtatccagcgcctgaacgggctgggcagggcaaaacgtacgctgggagccctgaatcagccaggcaccggcgctaccgtgagtaaccactaacgttttgaccgcttcgggctgcaactgccgggcttcgtgctgattcaccacggcaatatccaccagcggccagcaggcactaaatccggcatggactggcgagggattaaacacggtgatcaggccgcgcgatttcgccagctggaacagcgcatgggttttctctggcgagaaattgccctgttgtagcagcatatcgcctgggcgagccgccgccagatggctgacgatcgtgtcgaggctcagcgcctcggcggccccggtactggtaataatggcgttgtcaccgtccgcgctgtttaaaataagcgaggtatcgctaaaggggtgaacaggttcagccggcagcaaataaagcggctcctgcgtgagctgctggcgaatccatattccattactgtcttgtcccgttgcggcaattaaatgggtttcaatgccgcagcgggataacagaatggcctgattcgcgcctttgccgccgatatcctgcgacattttatttccatgaatggatgcgccctttagcggaatatcggcaatggaccaggtttcatcgacagtgatatttccggccacatacacacgcatagtgtttccctgaacaggatgaagaaaagatggttgctatatcagcaggaaaaaatgatgcaatacaagcgatattttcccgccctaaagcggtgattggcgttattcactgtgacccgtttcccggtgcgccacaatatcgggggaaaccggtcaaggcgataattgagcgcgccctgcgcgatgcggaaaattatatttgcggcggcgttcatggcctgatcattgaaaaccacggcgatattccgttttcaaaacccgaggatattggcccggaaacgtccgccctgatggcggtcatcacggaaaaagtacgtgaacgtttcggtgtgccattggggattaacgtattagccaatgcggcactgccggcctttgccaccgcgctggcgggcggagccgattttatccgggttaatcagtgggccaacgcctacatcgccaacgaaggctttatagaaggcgctgccgccaaagccctgcgctatcgcagccagctgcgcgccgagcatatccgggtgtttgcggacagccacgtcaaacacggcagccatgcgattgtggccgaccgctctatccaggagctgacgcgcgatgtcgacttctttgacgcggacgcggtgatcgccaccggacagcgcaccggcgacagcgccaccctggacgagatcgacgacattcgtgccgccaccgccttgccgctgctggtgggctcgggcgtgacgccagccaatgtctgccagattctgggccgcacccagggcgtgattgtggccagcgcgctcaaggtggatggtgtgtggtggaacgatgtggatctggaaagggtgaaacactttatggccgtggcgcaggcggcgctggataaggcgtagccgccgtttagcgccagccacagacaacaaaaaaccccgctggtgaggcgaggttttttgtttacatcagcacggttaagtgcggtgcacaccatgcagtatcaacgttttgaaatatacgaacaaatccgctatagcgcaagtgggtgaggttttattgttcgttcttccttagccgttatgcggcagcgctcgtaataacgggtcttaacgctttgtctataaagttattttgttatgcttttccacgttgatagtgatgtgctctgaggccgcaccgggttgtgaaagcggcattccatgacagacaagtcctggctgaaacgggtggtgccgtcagtgccttaacctcctggggcacatcatgcagtatcaacctgatcagcctgtcacaggcagcggaaaggtacgcaggctgaaagtgctcctgaccacaggagtcagcgtatgagatggatagaaatcgcacgcgtatttctgaagctcatggttgcgctactgcaactgcttgaaattatcgtgaagaccttcaggtaaatcacgttcaggccgcacctaagggaggtgatattcacctccctttaacaatgcggttgaaaagaggaacagcgccgttgtaactcaggccagccagacttttaccaccggcagtaccgccggaatctgcgacagcaggtagagaatcaggccgatggtgccgcccaccagcgtcccgttgatgcggatgaactgcaggtctttaccgatgttgagttcgatctgccgggacatatcacgggcatcccagcttttcacggtgtcgctgatatggcgcgtcagaaagccggcaaactcaggcgcgacgctgcgggcggcgtcttccagatgctgattcatggagctgcgcagcccttcatcggcggccagggtttcacccagccacagcgccgccagacggactttgtcctgcactttcgaatcatcgctgctcagatcggctttcagccagttacgcagatcgccccagagttcaccgatatagcggttgagcgtgggatcgtcttttaaccagcctttgatcacctctgcgcgctcggccatttcgggatcgtttttcagcttctcaatcaaacgatccaccgcacggttaaaacccagacgcagctcatggccctgatccagcgccacatcgtccagcagggaatccaccgcattcgccaccagctctgcgctgtgctcgcccagccattcagttggcaacattttggctttgataggatgctcacgcttcagccagcgcaccagctggctggcgataaactcccgggtactgggcttgtgtagcaggcgcagcagctgatccaccgccgcatccagcagttcctgatgacggttgtttttggtcaggctttccagcatcagcgcgccgctctgactgagatcgactttatcgatcgccttgtgcactgcccgacggataaagtgctgaatccgggcgtcatccgtcagatcaagaaagccacgcatcacctgtaacagatggcggccgatccgatccgcattgccgggggcgctcagccaggaagctaacatctgagaaggatcgtgacggcggatcaggttcagcagcgaatcggtatccagaaacttttcctgcacgaagcgaccaagattttccccgatacgatctttattccgcgggatgatcgccgtatgacgggcgataaagggcaccggcacgcgccgaaacagcgcgaccaccgcaaaccagtcggccagcgcaccgaccatcgcggcttcggcaatggctttgatgccgctaacgtaaaagttgggcggcagaaacagggtgaccacaaaggtggcggcggcaagcagcagcagcgacagcgccagacgtttcgtccgttttagttcgagttgtttatccatatcctgatcttagcagtttgcctgataagtaagtgaaaaatgcccgactgcgccccgtgcgccacaggtcagaatggtactgaatcctaccctgttattcggcgaacgctccccgaatcggactgttcctaaaactaatcaccgtgaaaattaccactctgataaacagttacgccagggtacatttcgggtgcagtctcaatacgttgacgcatcttatccatggaaccagaccaggagaatcacgtgaaagcaatcgcaacggcaaccgcaagtctgttgatgttaatgagcggcgtgaccgcgcaggcagaagggctcaccacctcgccggatggtaaaaacctgaccgtcagcttcggccagccgaccatcaagcaggtgctgcactaccgtaaaatgtacgacaaaaaacccttccccgatgccgagatttattactacgacaacggcacctataaaatcatctcgcagggcgaaaaccactacggcgtttacgtgatgcagggtaagtttgatgatgagaccttcaccgtgcgctttatctcgctgccgtccactgactggggcaataaaaccgccttccaccagttaacctttgtgcgcggcgacaagcagaacgtgtttattcagaacgcgattgtggataccggcgaggcgattgcccagcagaacggcacttacacgcaggaaaagaacaccgtgaccaatccggtgtccaccagctggaaacacaagtaatcgcaaggtggcggcctggctgccaccgacttttaccgatggcgaccgcctgagaagggcaccgcacagggcgcggccagcgtccgtaacaggcgctgggccatccttacccaggcgcacaacgaatgccgctggcagggttgccaacagactggcctggggcgtgcggatatttaaaagcccgccgccgtcagctctgagaatgggcaaggcgtcaggcaggattgcccgccgccctcagatttacttctccacctcttcaaaattcagcagcgtgacgccaatgccctgttgcgcgtgcgtcacgtttttgcgcagtgccacctgcaccttgccctgcaacatcaccacgtaaggcgagttctgctgtaactgctgttgcagggacacataatcggcccgacgctgtgcggcatcgctttctccggcggctttgcgggtcagggcgctcagttgcggaatatcccagcccacgcgccaggccagggttttgctgccgttgggtacgttataggcgaaggtgctggcattggtgttcgggtcgatgtagtccgcgccccagtaggtaaagatggattcgaagttgcggctgcgcattttgctccacagctccgattccgccaccggctggatatccagattcacatcggctttggcaaagctcgactgcagcgcctgggcgatatcgatataaggcggctgattcaccaccgacagcgcgatatgcgcgccgggcttaatgccgcctttggctaagatcgctttggctttttcgacatcgtagtggaacggtgtggtctccagcgcgccgtcaaaaccctgcggcaggaagctctggtgcacgcgatattgccctttcagcaactgattcgccaggctgtcgtagtccaccagccagcgcgctgcctgccataaggccggattacccagcgcaggctgctgcgggcttttggtattaaaacccaggtagtagatcaggctggagggaaaggccgcgatgtgcacgttgggatcgcttttcagcgaagcaagctgatccggccccaactggtacgccgcatccacatcgccctgctggatcaacagccgacgggtgcccggatcggccacgcctttcagcagtacccgtttcaggtgcgatttctgcgtgctgttgggattggcctccagcaccagggcctgcaggggcacaaactgtttgatcgcataggccgcgctgcccgccgagtgggttttcagccagccattgccgaagtcgttgttggcggcatgcgactgcgccagcttgctgtcaacgatggaggagacggacgcggtcagcagatgcagagccagatcctgcccaatctctgccggccagcgcagctccacctgatggtcgttaataatggtgaattgctggtcgatattctccggcgtccagccaaattcccccaggataaacgagggcgctttgttcagcttcaccgcgcgggttaaagagaacaccacatcctgcgccgttaacggattgccgctggcaaagcgtgcctgcgggttcaggtcaaacaccaggctgtgcggcgttttacccggctgccagcgcagcgccgccagcggggacagtttttgcgggtcctgattgtccggctggagtaaggtctgatagatattgcgcaggctgccggtgctgacggtttcaaagctttccgccggatcgaaactgataatgccgtccagcggcacggcgaccacgaaggtatctttcggcgtcgccgcgtgggcggcagaggagagagcaagggcggtaagcaggagcagcggtttgcgcatagcggttatccttaatgattgataaccctactttaacccgcggcagagcaggtcaaaatgccggtttgttctgagctatgccagtttcgtcttagccgatttgtcttaggtggcaggccgcccaaccgcgggcggctcaggccgtcagtggaaggtgtgaatgacttccagcacgccgttgatgatgaactgcacgcccatgcacaccagcaggaagcccatcagacgcgagatcgcctcaatgccgcctttgcccaccaggcgcatgatcgcccccgaactgcgcagggaaatccataaaatcacgctcaccaccaggaaggtcagcaccggggccacgttgagtacccaggcgggaaaatccaccccgctgcgcaccgtggaggccgatgagatgatcatcgcgatcgtccccggcccggcggtgctgggcatcgccagcggcacaaaggcgatgttcaccggttcctgcgcggtttccagctcatcgtgcttgtgtttggcttcaactgagtggcccaccggcttcgccggaaacagcatccgaaaaccaataaaggccacgatcagcccgcccgcgatgcgcagccccggaatggagatgccgaaggtgtgcaacaccgcgctgcccgcgtaccaggctaccatcatgatggcgaacacatagatgctcgcctgcagcgcctgacggttgcgctcctgaaaactcatctcaccggccaggcccaaaaacagcgccacggtggtaagcgggttggcgagcggcaatatcaccactaagcccaacccgatcgctttgattaactccagcataccttaacccgcttaatgtttcggacgttccagcgcttccagcagttccgggaagaagtcttgcaggatctccggcgtcatcagctccgggtactgcatcaggtgctcgcggatacgttcattcacgtccgggatcaggcgctgtgcggcatcgctggcgctgatcttgtgctttttcatgctgcgaagcaggtcggcgggcaggttgtcttcgtcttcgttgtcttccaccatctccagcgcatccagctcgtcgaacatctccatcagggcttcggtctgcggcgtgcgggattcatattcgcgcggatgttcctgctccagataacgcagcatggcgcgcatcggcgtgccgtcgggcgaggaaggcggttcggttgcgaaccaggtcagcatttggtggctggtaatctggtggacgtgatagccctgatccaccagttcgtcggccagcagttcggcgctttcgttttcgatcaaacagatatgcgtgcggttaggatcgtactgttcgagccactggtagatctcttcgatcacgccgtcgtcgtactcgaactttttattaacgaagctcccttctgacgcattaacgcaggctgtgatcaggtctggatcgaagtaaatggcgatgttgatacctttcatgcgtgctgtcctgttcaaatcaaaacatcactataacgctcaacgcattaagaagggaaacttatggctaaaggtgttgggattcagggtgatgcatgcggtaaacagggcggtaatgcgcggggagaatgccgtgccggaagaggcgatcgacctgccagcacggggctggcaggtagctgtcaggagataaagtttttaccctgtttcagcaccacgtcacaggctttggttttcagcttctcgcccatcggggagttgctgaggctttgcaggtttagctgctggccattgccggtgttcagcagcccggccacgccctgggtgtaatccggtttctgctgctgtgcggcggtggtatccaggccaagcttgctcagcacctggtccttcaccgactgcacgttatttttcaccacgttgtgctccacgcagtactgcatgacgccggcggcgttggtcatgctgttggcgctcatggctttgtcgttgctgttgagcaggctggtaatggaggacatcgacagcccgccgttctgctgaccggatgcaccgttattttgctggctcagctggttggcggcgctgctgagttgatcctgccagcttgccgctgacgcattgcccgccagcagcagggctgccagggcgcagaggatatggcgctttttcatttcgacctcggtttggttttatgcttcatgctgttaagaggcggtgcggatgagaaagttccgacggtatgatgaggggaaggcggtttgggaggattctggcagcgtgaaagggcgggtttgccgggttccgtgtgttttttcgccgcttagcgcacaacacagcggaatagggttgcgtgctgggcacgtaacggtataatccccaacgttttccgcatcctcttcagtgccgaagtggcgaaatcggtagacgcagttgattcaaaatcaaccatcgaaagatgtgccggttcgagtccggccttcggcaccattagtacctccaagaccatccgagaaagtccaattatcccttaaaaatcaatgatttcagcgatttttacgtcctgagccgtccgaggttgtccgttgaaatccggatgccgttgggggcataattgggggcatcttaacttcgattagaaatgtgcccccaaatgaagctcaacgccagacaggtcgagaccgcaaagccaaaagacaaaacctataaaatggccgacggtggcggtttgtatctcgaggtttcggccaagggttctaaatactggcgcatgaaatacagacgcccctctgacaaaaaagaggatcgcctcgcttttggtgtttggcctactgtgacgcttgctcaggccagaacaaagcgcgacgaagctaaaaagctattagtacagggcattgatccaaaagctgaacagaaagaatctcaggccgagaattcgggggcatatactttcgaaactatcgcccgcgaatggcatgccagtaacaagcgctggagtgaagaccatagagcgcgcgttcttcgctatcttgagctatatatattcccctatatcggctcgtccgacattcgccagctcaaaaccagtcacctattggtcccgattaaaaaagttgatgccagtggtaagcatgacgttgcgcagcgacttcagcagcgtgtcacggctattatgcgttatgcagtacagaacgattacatcgactcaaatccagccagtgatatggctggtgcgctatcgacaaccaaagcgcgacattatcccgctttaccctccagccggttccctgagtttcttgctcgtcttgctgcatatcgtggccgtgtaatgacacggatcgcggtcgagctttctttactcacttttgtacgttccagtgaattacgtttcgctcgttgggatgagttcgacttcgataaatccctttggcgtatacctgcaaagcgagaagaaattaaaggcgtgcgttactcgtatcgtggcatgaaaatgaaagaggagcatattgttcctctcagtcggcaggcgatggttttgttaggtcagttaaagcagattagtggtgataaagatctgctttttccgggggatcactatgcaaccagggttatgagtgaaaacacagtaaatagtgcgttgcgaacgatgggatatgatacaaaaaccgaggtctgcgggcatgggtttcggacgatggcgcgtggcgcattgggtgagtcaggcttatggagcgatgacgcgatagaacgtcagttgagccatacagagcgtaataatgtacgtgcggcttatattcatacttctgagcatttagatgaacgaagattaatggtgcagtggtgggctgattatttggatatgaaccgtaatcaatatattacgccttatgaatattcaaagtgctaaggtttttaaatagtaggtattggttggttttttaatttgttttgaatgatattgtttgggttttttattgtttattgctataattaaattaattttgaagtgagtgttaatattatggctgaattattgcgagagcaggacgtaaaaatagccttaattgattggctatataaaaaaggaatgcttagtgatgcaactataattaatgaaatggtagttgctaactggagtagacgagctgatttggctattgctaatgggagcttgcaagcctatgaaataaaaagtgattttgactctcttaaacgtttggatggtcagttggcaattttcaattctagcttcgaaaaagttacaattgtgtgcgcaccaaaattcacctgtgaagtatctaagcgggtttcatcgaatgttggagttgtggaattccagtctaataatagtggtgtacgttttaaagtaattcagaaaggacgagtttgctctcgattaaataagtttgtttatttgggttttttgctaaaatctgaacttaaagatctacttaatcagtatggagttaaatcttctaataaacatcatagggatcaccttgaggttttggcatctaaattaactttgaataaaattaggaaatttgtaattacctctattaaaaatcggtatcatgctacttctaatgaatttttatctagacttcatgataataaagaaatatctataaacgatctttatttattgagtaaggccaaaagaaagaatgatgctttggttaagttcgagtttaaggcttgttcgaatgaatccttaaatgaataccataaagttgatattgactctatagttaggaaatatggagaagatatttcctatattccagaaaaagtacttaaaagagttgtgagctagggaagattaatcttccctagcttttattagataagatcatcctcatcatgatcaaaacctaattgtagagcctcagatagatcaatttgcttgttcaagtgtagattcactcgaacagcaatccacttagctgggcttcccatgcctgctatatcgcctattgcagcattttttatcattgctgccccccaagagtcttccttttgataatgaggatatttagccaaaattgattgcgcagcttcaatgaatccttctttattcattcctgggcggcgctcaaaataccatgaatcatctaacgctatatcgattctaggaacatatcgcccaattacattatcatacactactgaatgaattgaaccatgatcgccataaatagcgacatcacttccaccaatattctgatgaaattctctctcaataacatcaatatatccagattgtccattttcaaggcaaaaatttgcaactgaactggggaaacttgttgctaacacactaattatggcttcaggaatctcagttctaatctgattaatcgaatttactgctgctgctgttatagcagaaatattacctctaatgtaacctaggtcaataaaaattatggcattttctggtgacttcatcgacacaagagatgtcagagttttactgatgtctgtatttaaatttctaattctaaatgcaattgagcctttaatttcttctaaggttcttgcctggatagatatgtctctaagttttgctgagtctggcatctgaacgactggaataacattatcatttctggagcaaaattttatccaatttttaaagctattttcaggagagagtagttcgaagcttgaagcgcaatgatgagaattctcctttgtaacatccaaaatgaatgggaggttactcataacttctaagcatttatctaacgatacttgtatttcttctgagcgaggccatttccccagagaaattaaaggcaatattttttgctttttttcatgtgataaattactcaagccggtcatttctgctgaccgggttctcaaagctggatagtaagagtaattttcaaagtatattttcatatttaattagcctccgagtcggtattttctgatcggcttgctgttcttggcatagcgttaatttgagggttctgagtggcaaggtaagcggctataccttccatcttttctttctgttctgaagttcttgcaagttcttgaatcaagcctttgttttctgctatcaaatttttattaaactcattatgactcttgattgcctccatattactttctattacctccttgtggttgttactaattgctttaatcgttctgtgcgtaaaccatccaataagaagagcagctaaccatccagaacaaacgagtaaccattgtgaaatatcttggttgcgaatgaagctagtagcaatggtgattatggtaccaacaacaccaattaatccatatacatgattcagcatcctttaactctctcatgccacgaattcttaaggatcttgcgacactgacaagaaccgcctcacatcaagctattcattacatatttttaagaatagtgccataaaaaagacaatatcagagcagggtcataaattttcttcatcatgtttcaatggataacaggggggctggaagcaccttaactgaaaaaataattaactaactcggagctttgcgcgcactcgtagccccgccacgcctgcgcacttaatatagtggttttcatgcacccgcatgagtggctccggggcgcaccgcttctggcctttgctgccgttttcaggtgccggaaattcatgcgatttcatgcagcacagacatgcactcacgcaacagacataaaaagagcccggcatatgccgggcattaggtgtttttgaccgtattttttctttcagggttgttcgtgccggtctttgcgggaacaggctgaaccgtagcggcccagcgtctgcggctggcgcaccggcgaatcattttctggctccggctctgccgccacaagcctgttgggcttcatgatgattttctcgacgctctccagcgcagtgaacgtgcaggagcagttgaggttctggcactgataccaggtgcgcttgacggacggagcctcataggcgctggtgcgggtatgggccacctgaccgcattcgggacatttcagggccatctcattttcctgtgtggtcgttttcagtcagtcaattgtgccggggctggcacaggcggtgccaccggatgacattgtgtgacgactcagacaaaaagcccttcttctggccagccagggaaaggtctcacgaaacccactactcagcttttagttttatataaatccttcactattcttcaccagaaagaaaaagataagtaatacagtgaattagagggtgaacagtttaaaaagcattcttcacccactgttcaccatccttcacccccggtgacggttaaaaccctgcaccacttataataaatatccatataaagccccttatctatcccttttcgttactggaaaaaatcaaaatgtcactatatgtcaatatatggcaaacagaggcaaacactggcaaaccgcacaaaagttgcgcccggtgtatgagccgccagacaaatttcacttgttgattccgtaagaaatttactcagaataaagagctgcccgaggccggacgtacccgtccggctctgtatggaatcaacgagaggtagcccatgcacaccgctttaaccgcaccatcttccgccccggcggccccgtcagccccttatgcgccaccggttcaggagcgcttcatgcgcctgccggaggtcattcacgtctgcggtctgtcccgctcgaccatttacgacctcatcagccgcgacgcctttcccgcgcagatttcactgggcggcaagaacgtcgcgtgggcggccagtgaggtgaacgcctggatgaacgaacgaatcgccgcccgtggtcaggggcgtgtggcatgaccttcacccaccgctgagactgtccgtcatgctgcattttcctgctttccccggcttgcacgccgggggccttccctggtacagtatttctgctgtcgcaaaatcggcagccgggcgtaggaacccgagttacttcaaggcgacaccagacgcgccatgcgtctttttttgtgtctcagcctcagtgcacccgttatccgggcaacggttctgtatccgttgcgccgtactcgtaatggtggcccgggcggggcagccttcgggctggccggtttccttgaaggccggtattcctacccccgtccgggtcaccaccagtgagcgtaggaactccggtggtggcgataaccgctacttcagggagactgcccttatggctaccgtccttaattccccgcattcagaatttgtctttgtgtttgccgccgtgcgccgctgtgagcgctacgcccgcgtgcagatgcttcttactaccgccgccaccgaacgcgccgcccgccagccgctggcccgcgactgtgttctggtctttgccgcccgcctgccggtcacggaggtgcgcgcatgaaccacgccaccattacccttgacgaccttgcccgcctggagcacctgcgcaacgccgggcgtctggcctgcgacgcggcggccctgcgcgactgctgcaccccgccggagcctgccgacagcgaacagctggcctcgctgctgtttctcatcaccggccagctggacgacgtggtgacccgctgccgcgacggctggatgaacggggaggtgagcgcatgaacgcccgcaccctgtcccctgagctgcgcgccgcactgtcacgccgcgccgtggcctgcgcctggctcaccctgtgccgcgaacaaaagcgacattccggcctgacgctggcccgcctggagcgcgccattgagaccgagctggagggcttctacctgcgccagcacggccgggcgcgcgggctggagattgcctgcgcgctgttcgacgacctgctgaccgccgggccgctgaaggccgccccatgcctgagctttttaggccaggtggtgatggacgaactctgcgggcgcatccacgacgcgccgccgctgcactgagggaaaacacaatgaaaatgaccgtatccgacgcggccagcgccgcgcggggccagtggccccgcatcctgcccgcgctgggcgtgaaggtggtgaagaaccggcacacggcgtgcccggtgtgcggcggcaaagaccgcttccgctttgacgataaagaggggcgcgggacgtggttctgcaaccagtgcggggccggtgacggcatggacctggtacagaaggcgctgggcgtcagcctgaccggggccgccgcgcgcgtgaacgacctgaccggcaacctgccgccggtgactgaggccgcaccggcggagccggacgacgaggccgcccgcacggcggcagccgcgctggcgcagcagctggtgagcagcgcaaaagcggtcacgggcaacgcctacctgtcccgtaaggggctgccggagcagacctgcctgacgctcacgaagccgcataaggtggccctgacgtcctaccgccccggcgaccttgtggtgccgctgcacgacgcggacggcgcgctggtcaacgtccagctgattaacgccgccggtgacaagcgcacgcttaagggcggccaggtgaaaggcgcctgccacgtcctgagcggtaagggcacgccgaaacgcatctggctcaccgagggctacgccaccgggctgacggtgcacgcgcttacgggggatgcggtgtggattgccctgtcgtccgtgaacctcctttccctggccggcctcgtccgtgaaaagcacccgtcgctgccgctggtgattgccgccgaccgcgacctgaacggcgacggccagcgtaaggcgaaatacgccgccgcagcctgcaacgcaacggtggccctgccgccggtgttcggcgactggaacgacgcctttaccgcgcacggggaggacgccacccggcaggcgctgcgggaagcctccgcctcgcccgccgccagcccgttcgacaccatgagcgaggccgagtttacggccatgagcgccagcgagaaggcggagcgcgtcgccgagcactacgggcgcaatctggccgtggacgccagcggcgaaatcctctgccgctatgaggccggggcgtggaaggtgatttccggcaatcagttcgggcgcgacgtggcgaagctgtttcagcgcctgcgcgcgccgttctcggcgggcaaggtggcgggcgtggtggacacgctgaagctgatgctgccccagcaggccgcgccgcagcgacagctcatcggctttcgcaacggcgtgctggacacccgcagcggcaccttcagcccgcaccggcgcgagaactggctgcgcacggtcagcgacgtggactacacccgccccgtgcccggcgaaacgctggagcgccacgcgccgcacttctggcagtggcttgaccgcgccgccgggcggagtgcagagaagcgggacgtgattctggccgcgctgttcatggtgctggcgaaccgctatgactggcagctgtttctggaggtcaccggccccggcggcagcggcaagagcatcatggcggaaatcgccaccatgctggcgggaaccgacaacgccgtgtcggccaccatcgagacgctggaatcctcgcgcgagcgcgcctcggtcatcggcttttcgcttatccgcctgcccgaccaggagaagtggagcggcgacggcgcgggcatcaaggcgattaccggcggcgatgcggtgtccgttgaccccaagtaccgcgatgcctactccacgcacatcccggcggtgattctggccgtgaacaacaaccccatgcgcttcaccgaccgcagcgggggcgtgtcgcgccgccgcgtcatcctgcacttcgcggaaatcattccggcaaacgagcgcgacccgcagctgaaggagaagatacaggcggagctggccgtcatcgtgcgccagctgatgcagcgcttcagcaacccgcaggacgcccgcgcgctgcttcagcagcagcagaactccggcgaggccatgcgcatcaagcgcgacgccgacccgatggtggacttctgcggctacctgttcgcgaccgccgagccgaacggcctgcacatgggcaacgccagcattcggcccctgcagccgaagcgctacctctaccacgcctatctggcgtacatggaggccaacggctaccgcaacccgctcagcatgaagaccttcagccaggccctggagagcatcctgcgcgaatacggcaggacctacctgaagcggcgcacgaaaaccggcgtgcagaccaacctcggcctgacggacgaaagcagcgccgactggctgccgaagtgcgacgatccgaatgcgacatgacaaacgttgatctcatcgcttattcgtttatagttaagcaccagctctgataagagctggtttcattgccggcgctcatcatgcgttcaagctggcttatttcagtcctgaaggtacctgttgccgtaaaggagaattttaaaaatcatgcgtcttacgccaccctgagtcgtaaccctccccgtcgcactgagtaatctcagtcgcgcatccttaaacatcccgtctgcggatgtgacttttcgcacctgaaatttttgcccttacgggctgactctattcaaaatctgagaaattattatgctgctgtcctcgacgcgtaaggactggctgggtaacgtccgtggtgacgtccttgccggtattgttgtcgcgctcgcgcttattcctgaagcgatcgctttttccatcattgccggcgtagacccgcaggtcggcctctattcggcgttctgcattcccgtggtcatggccattttcggtggacgcccggccatgatttcctcggcaaccggtgccatggcgctgctgatgataaccctggtcaaagaccacggcctgcagtacctgctggcggcaaccgtgcttaccggcctgctgcaacttatcgccggttacctgaagctgggcgctctcatgcgcttcgtttcgcgctcggttgtgacgggcttcgttaacgcgctcgccatcctgatattcatggcgcagttgcctgaactgaccaacgtcacctggcatgtctatgcgttaaccgccgcgggcctggccatcatctacctttttccgtatctcaataaaaccctgccctcgccgctggtctgcattgtggtgctgacggccgtctccgtgtatctgcatctggacgttcgcaccgtgggtgatatgggcaaactgcccgacagcctgccggtgttcctgattccggacattccgctgaacctgaatgcgctgctgattatcctgccttactctgccggcctcgccgtggtggggctgctggagtcaatgatgaccgcgaccatcgtggatgacatgacggatacacccagcgacaaaaaccgtgagtgcaaagcgcagggtatcgctaacgtctgcacggcgttcatcggtggcatggcgggctgcgccatgattggtcagtccgtgattaacgtgaaatccggcggccgcgggcgactttccaccctcactgccggtgtggtgctgctgtgtctgatcatctttctgcgaagctgggtgtcacagattcccatggcggccctggttgcggtgatgattatggtgtcgattggcaccttctcctggcgctccattacggatctgcgtcgccatccgctttcgaccagcgtggtgatgctggcaacggtggtcgtggtggtggcgaccgacaacctggcgttcggcgtgctgaccggcgtgctgattgcctcattgaattttgccaccaaagtggcgaggtttatgacggtcaaatcagcccttgaggacggcgtccggacttataccgtaaccgggcaggtttttttcgcctcagcgaatcgtttcatgaactgttttgacttccgcgaagccactgagcgcgtggttattgacgtcacccacgctcacttctgggacataacctccgtcagcgcgctggataaagccgttatcaaattccggcgcgagggctcagaggtggaaatacgcggcatgaatgatgccacccgcacgatcgtcgaccggtttggcgtacatgacaagccggaagaagtggaaaaactcatgggcggacactaaccgaaaggagcgacagtgatgaaaaataacgttattggatgcgtggatggctcaccatcaaccggggcggtctgtgattatgcagcctgggctgctgccggcctctcagcccccctgactctgctgcacgttgtggaaaaagacggccatccggccgtctccgacctgagcggcatcatcggcattgacagcaaagagctgctgaccgaagagctggtccgggtcgagggcgaacgtaaccggctcctcagggcgcagggaaatatcatcctttcggggtgcgccgggcggctggaggttgcagggcattcagcggtgcgccagctgcagctgcacggtgttctggatgaaatcctgacggagctggacgacgtccggctgatggtgatgggccgtcgtggcacggaacaccgggtgggcagtcaccttgaaaacgtcatccgtctgcagaagcaacccgttctggtcgtgccggaaacgttcactgcgccctcacgcgtgctctttgcctgggacggcagtgaggcaggtcgtaaaaacctgaccagactgaccctgagtccgcttctgcgcgacctggcctgccatgtcgtgatggttaacggcaacgaggcgtcacttcttgatgcccggttgattcttgagacggcaggtatctctgcagaagcccggttactcaaagacgattctgtcccgcatgctttgcgcctttatgcggaagagaatgccattgatttaatcgtgatgggggcatgggcacacacgcggcttcgtcagttcttcatcggaagcaacacctcagccatgctggctgagagtcgtcagcccttactgatgctgcgttaaaccacaggggcctgcgaccgcgggccgttttcatcattatgttacggtacccggacaggggctccgtagcaacggctttgcacgctaccttcgtaagccgtgctcagggaatatcatgcgtcagttatttcgctttatacatcagcacggcagccatctcggctttggcgccatactgatggccatgtcgagtttcggacagacttactttgtgtcgctttacggacaggactggcggcaggctttcggactcagcgacggcgggcttggcggcctttatgcagccggcacggtgatgagtgccctcaccctgacgtgggctggacggctgattgattacaccaccacacggaagtttacgctggccgtcacctttctgctgacggtggcctgccttctggtttcaggtgcgcagactgcatggatgctctgcgtcggcttttacctgctcaggctgggtgggcaggggctgatggtccacaccgccctgaccgcaactgcccgacagtttccactggacgcgggcaaagcgctgggcgccatcgcactgggcctgtcgctggcgcaggcgttttttcctgtggcggccgtgcaggtcggtcacctgacgggatggcgtacggcctggctcatcaacgcggtgatactcatcgcgggcgttgcgctggcgatatcctgtctgccacgccgcgccgaaaagccactccgcacgttcagaaaacggggggacaggaaagtccgtgccccctccatatggaaaaaccgtaatctgttgctggccctgccggtggtgcttgcatcgccctttattaccaccggcttcttctttcaccaggcgcgcctcgcagaagaaaaggggtgggcactgtcatgggtcgccgcatggtttatcgcctatgccctgactcaggcagtttcgctgctgtcattcggcccgttgattgacaggctgacgccacgcaggctgctgccctggtttctgatgccgcagggggctggaatgtttgcactgtggttcagcaacggcctgtgggtgacgccgttctacctcatcatgaccggtatctcgtcggccattgcctccacgctggccaccgcgctgtgggtccagctctttgggccggccctgctggcaaaggtgcgttcggccgttgaggccggtacggttatcgccagcggtgcctcaccggtcatcatgggcgtcctgattgaccatcatgtttctgtgcggtcgcaggcgttgatgtgtctgatattcatcattgcagccagtctgacagcaagccggattaaaacggctaaacagagcctcatcagccatgagaacgggacggctgactgattcagaaagcgccccgcatgaaagtactgttgagcgagacggcctgcaattatggcccgggatgtcgtctcgttgaaagggtaaactttaaacacatcgttttgtggaggtttcatgggttccgttgaggacaccagcgaaaacgcgcttgagttgattggcagtatcacccgccagattttacttaactcacccagagtcagtaaagaagacctgataaatgcactgaataagctcagcagtgataacgatgactggtatgtaaaagatgcctgccagagggcattgcagatgttgaaacaccggttacactgacccggagcagggtactgtgtatgtcagcccggttgttttaataccggagctctcttttgagacgacgttttttgtgatgaaggcccggaaggttgtcctggcataactgagccatccgtaaaatatacagccctccccaaaagccggtcaaactgtttgattgcctgtctgattgttctgcgacgggactcgtcagtctcagcttccagcatcagattcagttgtttagatatcatttcattactgacgtcagtgtcattacgaatcagcgtcatgattgcttcggcaatcacaattttcactttttctggttcgctcctgaacatgtaaaccttcttttttcctggggaggggtaaaagtccgttgtcacggacagaagtgctgtcttgttgcgttggtgtctttttattcacgctttcagtgtagtctcgccttaaaggaaaagtacagttaaaacatgctctgtaactatttgaattataattaatttagactaacttgatttaactgcacgcttttgtgtatatccccctgcagtgtccttatgtttcagctgctgccttaatcgcgcaatgcgcgccgctgaaccactgtgttttttatcctgatacgcatatcctgtttgtgtcttaagcggatatgaaacgatgtgctttgccgtgcaactcatccgtatgagatcgaaacgacttccgggattaatccggataaaggaaatatttatttcctttattcattgcagaattaacctcagttgccgatagtaattattgaagaagcaggggagccggacacgccgacaccagggcagaatgctccggtttccctgcggtgcattaataccgccagcaaccacgttgagggggccgtcgcccgcctggtctgattaagccagttcccgcgattcgctgaaacgcccatattcctgagatgcatcatacagcgggccgcacacaacaattgtgcttgttacgctgaaattgatattgtgtgcagcgccgggcgggacgttacaccttccctcagagcgttgttctgcacccgcgccgtccggcccgttcggtaaacgatgttaagcgccggctttaccagatgagattttgcgccagcagcgtttttaaccctgctttttgaaaagttcatcagggcaaattttattgatatcagggaaatgtctgctccttgcccgaaacgatcattgcggcacagacatatccgcgcgtaataaactgcctgtcttatcttctgtcacctgaggtatatccgttcagtaaaagccggaagggccaggggcggatgaggttaagtcagatgcgtttatccgggacacgttaacgcgataagctatgacgggcctgaggggaattccgggttttatcattgtgccgagaaggcgtagaggcgatgatgctgcaggctggacaaaagccacataaaaattgctgtcagcccggtaaagccgccagcataaagtaaccagtacaactttttctcagaggttagttcgcgttacagagacagttatcgtctcgcttatccgaaactttaaatgttccggatctcaatacagggctccgaatcagtcccatcttttcctgcaaactccatgaatcttcagccagagccagaagcggacgttgcttgcatcatggtatgttagtttccagggagcaggtcaggtcaaaaaagttaatgttacaaaagctggtaaagaacagtttgagcctttttttaaactacataacaggtcttagcctcaaggcaggccgcgctacagcgcaatacttttaacgtcctgcaattcagtgcgaaatcggctgcagagctgtaagcgtttagcattttaatagcgctcacgtagcctccacgtaagccattcttcgagttcagggtcggcaagaggtcgcgagtaaaagaacccctgagcctgatcgcaaccatactgcgtaagagccgcaacggtttcctcattttccaccccttcggccagcacctcataattcagctccttgagcatactgataatgctgcgggcaataatacgcgacgctgtgtcagaagaaaggccggtaatgagtgaacggtccagcttgataacgtcaagcgggatacggcggagatagttaatattgctgtgcccggcaccaaaatcatccagagagatgctgaaacctttatatttcagcgcttcgagtgtctttattgcagccgcgttttcgattatctgctcggtctccaggcattcaatccctaaaagttcggcagggatacccgcacggatcattttatcctcaagtgcgctggcaaaatccggacgtgacagatcctgaccgctcacgttaaacgagaccggtaactggacagggctgtgacgaaacctgacaagacgtgcaatcgcctggtccgatacccagtcggtgagggcgctgagtaaatctgtctgctctgcaagcgggatgaacgccgccggtgagagttcgccaaatacaggatggcgccatcgaatcagtgcttcaagcccgacaggaataccctttttgagacaaattttaggctggtaaactacatacagcccggtgttattacgcagcgatgaagccaaatcattgagcagagtaaaatcacgcgttcgacgctcgtctgacgcttcgctgaagcgcctccacccggtattctctcctgcagcttcatacagtgcactgacagaacggcgaagcacctcctgagagggcagcaaatctgctgaaaaatccacctcgccagcccgggtagtcagcgccacggtaagcccgtcaccgatatcagcatgaatgccctgaagtttgtccaccacccaggacgcattcagtttgctgtcggcacgcgtaaggagcgcaaaccgtcccgttgcaaccgtgtaaatcgtatccgtttgtgcaggtttcagccgcagcgggaggagcgtggatacgtctttcaaaaggctttccacaggctccatccccattgaacgcgccagttcgtaagcatgcgacaggtcaatacagtcaataagtataaggcgccgtggcgttttatcccccgaggctttcagatactgaaggtcacgcatcagacgctgacggtttggcagggaagtcacgggatcggcgaagcttgcagcatgccagacctccagaaaagacataacaagcgcagccagtaacttaagcgtggcaaccttttcggcgccgaagtcatgcggtgctgtatcggttacgcagagtgttcccagaataacgccttcgctgttcttcaatggcgtgcccgcgtaaaaacggatgtaaggcgtaccggttatcagggggtgggtactgaaccgtttatcgtggagagtgtcaggcactaccattgccttatcattatcgacaacgtgccgacacagcgagtcagcgcgtgaggattctttcaggttaaaattccgggctgctctgacatactgcttctcatcatccagcacagaaatgaagctgccaggaatacccagagcctgactggcgagtcgcacgaacttttgaagtacatcatcccggctttcgtcaggcctgcgcagcgtaaggagcgcgcgatgccgtcgctcctcgtcgccgctaagattggtcagcatgtgtagcacctccgcaccgccctgaagccggtacgaaaaaaaggaaaagtgaaagctgcaaatacagctttattaataaatttattaagagaaattttaaggcttcagtacttataagtatttttttaaactgttctacacttctgtcaaagaagtaactttcttacttaagtgtagacataataatgcatatttgtgcctgtcaatccatgaattagatttattgtttgtgtccattctcagcgttgacgcgaggggagatcttcatcagccatagagatactgagcacatctttacgatgctctcaggtacggtttctcagcggctcttcctggtagattcaggccgctgaaaaacggttctcattttgttcgctacgtctcgaatgcagtaaaaggcgcttcggctttacttgaaaaaacatcacttcttacttctcaactggcccgaaatgccgctaaccgctttgatctgatgtgagttcaggaagagaaaaacaacctgtttagtaatctaatcggccgtttcaacgcactgttgacaggtatatttgaaaaaaattaattgtccgggtttatgccatgctaaaaagaaaagttcatctccggcttctgctgacatcactcactgcgggaggcattatcgttacgtgcctgttgatgatgggggcgatttttctttttcagaaaaaaaacattgaagaaagcctgattgaaaacaatattgcttatgctcaaaagctcgctgacacaaccgaccgttatctcaggacagcgcagcaggagctggaatggagcgcctctcagattaaaacgctggatgatgttatctatcttgctcatgaaagcgacagactcagactgcagtccggctttttcaataccgtagtagtcgtcaatagtgatgcggttatcgctgcgacatctccggaaagcataaaacttgttggtgtaaagctgaaatcggttgccagtcgtcagtctattgatacaaaaaagccatttatctcatctccgtttacgtcggcgacgggcaactacgtcattttcatctctcaaccgcttttcactcctgaaggcaattatcttggttatatcggggggacaatttatctcaaaaagcaaagcatgctgagcgatatcctgagccagcattttttaaacagagaagccgtggtcagtattgtcagcaacgaggggctgattattttcagccatgatcagtcaaagaccggcgagaaaatggtccttcctgcatcacttcaaaaacgactggccgacacgcaaaacggcaggttcattacggagaacgaagggcataaactacttatcggttatgcaaatctgcgcacaaccggctggaatgtttttatggcggggacctctgagacggttaatgccattcttcttcactccgttcggaatatcctttggttcattatcggtatcctggcactgaccacaggtatcatggtactgcttgcagggcgaattgcattacctcttgaaaagcttgccgaaatggtgcgtgaaggcggtagtaatgccaccgctgagtcagttcgcggcgtaaaagcatggtattacgaagccgattgtctgactgaagccgttcgggatcaccgaaaggccgtatcaggacatatggctgctattagtgatgaggcaatgaccgatccactgaccggtatgtataaccgccgcggctttactgtaatggctgatcggttaattaacacctcggaacactgcgttattgctattgatattgaccactttaaaaacatcaacgatacattcggtcatgatgcaggggatgatgctctggtcagtcttggttcgttactcagacaggcctgcagacccactgacattgtcagtcggttcgggggagaggagttcattgtaattcttacgcacacgggcctggctgacggtataatgactgcagaacgtataaggctcacagtcagcatggctcatttccccggggcaggaaaaatgactatttcagccggggtggccgttttcattggtaatgaaagcgcgcgcgaagatggtctgagtcgtgctgatgaagccctttatcaggctaaacgggccggaagaaatcgagtctcggtaaatgacgctgattagttaacatcagagcatctaaagcttaagaacttaatgttttgctgaccctacgaaaaaaacagtgccatttaaaattataagtttggtggattagggtgtagattaaaaatcaaacaaaaagaaatgccgctccagagcaataccgcttgtccgttgaaatggacttttatgccaggaaacaggaaggtttatatgttcaaaagtgaagaagaaataatcaacattgtcattggagaagcactattatcgctgctggatgatgacgctgaagtcagttcggaaatgctctcggcccggctaaagcggatgctcagaaccgagacctgcgatacacgtcgtcaggccataaaggatgcaatactggagaccggaggttacttaaacagcgcggtaaacggggagcttaacgccgccagaggaagttctgctaatggaaaaaggttctcaggacagctcaactcacactgacagcagcggttgaccgtttgctcgtttagagagcaggtgatgattaacataagtcagttcatcatgcgcttcatcatcttcacagccttttcacatctgacccgcaccgcccagtcactgtcactggtttcatggctgaggcggtttagcgcagattagcgcagaaataatgtcttcttgccttacgctgtcttttcctcttagtaactgcctggtaactaaacctgtcaacgccagcgctttttcgtcggtatcctctctggaacccatgaagcctccgcaaagcaaatagccttaaattatagcatcctgagcggagcggcccggcagcacctgccggactttgtctgggatgcagagtatgaagcccgtaaagctggtcagcttaaaccggtacttttgttttctctggtattccgtcagcttcctgaccagtgacgcagaccagaaaattattcatcatcgcaatcgccctgccggtcgcaatcaggtcggcggcaagcaggacgtcttcccgcagcagcacgaccataagcccgggctccgccatccttgactgcacaggctcaaaagcccggttcagatgaagcaggttgttagcaaacgtggatgtcttcaggtaattcccccgagttagctggttcaccataaagtcaacaccctccttcatagcgtgaagggtctcgtacatctgtacggcttcccgttcgttgtctgtatcgtgactcataccttaaacgtctccaccatgttgcgcagggcgtgagcctgcccggaaagcgactgcgaggcagaggatgactcctcaaccagcgccgcgttattctgcgtcacgccgtccatctggctgacagcgatactgacctgagagataccctgcatttgctcagaggacgccagcgacagttcgtccatggattcggccagttcgccgaccatgccgacaatcttcaggatgctttgtccggttgaagaagccactgtcacgccgctttccacctgcgcgacagcctgttctatgagaaccttgatgtcacgggctgccgtggcgctgcgctgcgcgagcatcctgacctcacccgctaccacggcaaaaccgcgaccgtcctcacctgcacgcgccgcttcaaccgcagcgttcagggccagaatattggtctggaaggcaatgctctcaatcacggaggtgatgtcacgcacctttgtggcgcttgctgagatgtcatgcatcgtgtcagacatacgctgcacatcggcttcaccgctgcgggcaagcttcgcggcttcacgcgctgagcccgccgtctgctgagcgcctgccgcgttactttttactgttgccgaaagctgctccatgctggcggccgtttcctgaagggccgcagcctgctgttcggtacgtgaggacagttcggtgttgccctgtgagatttcgtcggcggcgagcgctacggacgatgatgattctttaatctgcgacaccaggccgcgcaggtttgcctgcatgccatcaagagaggccagcatactggttgaatcgttacggcgaagtataacctgggtcgtcaggtcacctgccgcaatggccgatgccagcacctgagcctgcgcgggctcaccacccaactgacgcatcagcactctgataatgacaatgcaggcacccacgctgacaataattgatgcgccagccagtaaaatcaggatgagagatgactgcgaagctaaagcgctgttcttcgccacttcagaactactggttttctgttgtatcccagtcacgatcagcaaatcgctcaacattgtgtcctgtataggctgtacttcttttgtgagacactcaataaactctttatcacgattggccagaccgagctggctggccttcgagaaggtggcgaagaaagatctctccgtatccgtcaaccttttaaatgccttacgaccggccgggagtgaatccttctccagcaggtcccccagggcctgacggttggccgtaaactgcgcttgcgtttcctgcatccgctctgccagaggtttcattgcgttagtatctgccagtagcccaatcgttctcacgtcaatggccatctgtcttatttcacccagcatctcttctgcaatctgatacttcttcattttgatgtttacaatcacgtccataccctcgcgggcccggttcagtgcatttagtgcagtccctgtacagataataaacaggagaataagcaggccaaagcctgcggtcaggcgggtagatattttcatatttttctcgttttgaggaagtgctgccgtgtatatgttagtgctgtcattaactgatattaagccgggcctgctgccgcgcctgtcaggcgtaacattctgccggaggccagcttctatctggctgaatgcgttccccgaaatacccttgcagatgattactgaaacaaagcctgttggcacagttgcgtcgaaaactctgtcgtttttaccggatctcaaatcagtatcagactctatcggcggcaacaggggggaactccagagttcaccaaaaataaattgggtgcaatttaattgatgtcgatattgttgctgtcatcggcagttggcagttgtttaagccatccattcctgtccgtgatatcctgtttttccggctccctgacgtctgtcgcatcaaacgattaaccgaatgcctgccggccctcaacctcatcaggagcaacggcatgacagactttaaagatagcggcgaagataaacgcgttcagccccagaaccttgagcagtttctctgctttgcgctgtactcggcttcgctggccatgacaaagctttaccagccgcatctgaaaccgctggggctgacctatccgcagtatctgacactgctggcactttgggaaaaagacggtgtgacggtgtccgaggtcgggcagcgcatgcacctggaatccggcacgctcagccacctgcttaagcgacttgaacaggccggctttatcagccgcacgcgcgacaccggtcatgatgaaagaagggtcatcatccgcctgacccaggcaggccgtgaactggaaagccgggcagccggcgtgccgacggcgatgatttgtgaaatgggcataccttatgaaacgctggcccgcctgcgcgacggggtaagacacgtacaggaaaaaatcattcaggctctgccttctcaggaaaaccaaacatcctgatgcgctgtcactgcatcaggatgtttaaaaaagtcgttttttggcagatgcgttcacctgacgcggtaaatttcaagggcacttgccaggattgacttgaaaaagccgcctcgctttgatagcaagggcctaaatacgagattttaaaagttaggctttattttcaaagggaagataatgaaaaacgttgtactcagcatgctggcaaagatatctcacatcgatgccgacatgaagcagttaacagctcgtgttgaggctcagtctctgcttatcagtgcgcttgttctggctgtgagtaaagagggtggtgtcactgaaatgatcgaaagcgcgaataaggcgatcaacacggtcatcgactctgctgaatgcgatgacctgcttaagtctgacgccgcgcttctgctgagtgaacttcagagtctgctgaccatctccagggctgttgacgaggcggatgaagaaattcatcatgaaggtattgcagaactcaaaggattatctaaatccgttgattgagcacgcccatttgctgttcagatcactgctgtcgcaattgttaatctgctgtcagcaagccgagaatacttgagtatcacattttaccgcataaatccttttttaaaggatttatgcgggaaggtgcatgtccaaatcagttacagtggctttagggacaagatactgagaaccgtgttacatcagaaatgtgtccagccgtcgtccgttgtttcaggtttattaatgaccgtcgccggaagacgtgccggagcgacaggggataaaaccgaagggccgctctgaccgcccaggctggcagcagctgacgcagattcctcgacgagtgacgcattctgttgcgtggtgctgtccatttcagtcaccgctattcctacctgctcaataccatgagcctgctcagcgctggctgaagtgatttcctcgaccgtatccgtcagtctgccgaccgcagacagaatgccttcatggtttctgaggcgtttaacaccagttcattaccttcaccgacactgcgtgcgttggtctctatgagctgacgtatctcgccgacatcgttacagtaaggtatgaaacgctgcgttcagcacacttcaaacgacagcggtatgctttcggacccgcagtgacaaagcctgctactgctgatttatactgaacgtacgaagcaaaagcggccgcagaactgaaaaggctggccacagacgattcggtccgtatccggaacgtctgtggccagtgacagtaaagtttcaggcttgatcagaacagtagcgtgacgaggtaaaagcgggcttttttatgtttatcttacatctgtggtgacggatatgcatcacccttcacccattagtcactatttaactgactgatattaatgaattaaaattaatggtgaacagtatgaaggattattaataaaatcttttttcagtggagattacgagaaaatattgagcattaattaacctattttgattatgaatgaacaccaattcggcggatatgatattcagacattcattagtgcattgctaaatagatacagtagaaggggtgggtggaacgtatttcttatagcctaagtctcaataagccccagatattgaccgaaaacttcttactattcatatgattatagaatcagcaaaagctgggcgttggctttgcaaataatcaatttaaatgcatataactctaccaaaaaggcatagagttttgttaggttccgtctttaggaacctaaccagtgggtttgttagttttccgcacgactattttttaaccttattgagaatctgctagttgaaatcgctaaaataaagtagggggcataagtgggggcatttcaggtttttcttttaaaaaaaataattaaaacaatgatttgaatcattgtttgagtccggccttcggcaccaagtgaagtgagttgtaggactaagaagctgcctgagggcggctttttttgtgtctgaaattataaatttttagttgaaaattatttcaaatacctaattataaccttgaggacgtacataattcattaattagaaattagaaattagaaattagaaattagaaattagaaattagttcgatatttttatgcataaatttttttaaattaacctaatttgtatgtttcaataattaatctaataaatactatgcggccatcaaggcattccggattgtatctcatatcgcagtgtaaatcagaaatcatatagccctgattaaatatttataatcccatttgatgaaataatatttttttaaaaaaatttcaatagttaagggctttataaaaaataagaaaagcattgaaaattaaaaattatagtgataaatgtttaggactacactgcagctttcttatttgaaaacagcagtgtagtcctatgatattattaattaataaagtctaagcctattcttgactttgatactcctaatctacttagtaagttcaaggcatattcatatcttaactcagctattatctctgcgtctgtggtcaaaatattcacatcgttacctttaggagagggttcggcatattttaaagtaacctttttatcgtcctcattaaatacgccttgtctatcaacataataatccctcgccttaggatttgcttttccatcgagaccataagtaaagctaagtatttttatttcttcatctttgttatgatgacgaataaaaagaagattattctgtgttgcatatttgagtatttcttttgtttcatctattttcgatagttttggcaattgagaaattccaagggaatcgcacatactttctcgcatgttcctcaaggctattcttgcatcatacatttgtactaaagtcacagatataagatcattatcactatttttttggccgggaacaagatcacacattggtgttaaacaaagccaataatttccattaaaagtcaatatatgaccagttactaagtgatgtgtgctgattttctttgaacaactgaaacaattagcttgaataacttggtcagtaatattttcaagtgtctctttttcaataaagtagtcaagaggattttccattttatttattgagttaactaaactaatagtgaaatcatcaaggctatgttttatttcgtaagcaagttcttcccacaatttggtcaccgcttgccaggcagaagttttgatagcgagattatcattgtttaaaagttctttaagccaagccgcctgaagtaactttttattaagaatattacttgcagcgtaactgccattagattcaatttcatgtctaagtttagacaataccaatttatgcgggtgaggtttagactctgccatcgcttcaataagttgatctggaatttcactaataggtgtatctttttttcctaacacagttagaaataagtcttcagtttttacccaattacatttttcattttttccccattcgaaaaattttgatgtgctttccgaaaagaaattttcatggaatttaaatttttcaaacgacaaccacctcaagaggtctcgtttgcttatttcaatactttcaggcttgctatcatataaagatttgaatacatctaaatatacatgctcaaaacgaggatcttgaattttattcttgaacgtattgataataaataacaaatcgatagtggatattgaagaaagaatcatttcttttatgttgtagttttcaatttcccaatcatcaagagctgaatttatttttgctaattctctttcagaaattatacaaattttaggtttttcttgtaacgaaataattatatcaatcagtacatcttgaaccgtacctttatcacctgtataacctttagtatggacggcaacaatattataatgcctgttacttgataagtttttaattatatcgattgattttttacaatatcctgaatcttcaccatcgagatgatagtcaaggattaaaaggtcgctatggtgaagtctgttagagactgttcctaattctatatttgtctcttggccattgtatatgtctagtagccagttatattttacatcgcggctcacttctactatatctctaagccttccaatattttcttctttgaaattattcggctttcttgagattaattcatctaaagtaggatattcatcatcaattacagtcaccgttcggatcggctcaatataggctatctttaaatgtggcctgtaatcaaaagcaatgttagtttgcatttttcaatcctttaaaaatgatggcaaagttagcaccatttaaaatctttttttcatcacgggtttcataaaaaattgaatgaccactgactgcaagattttgtttacaaagatacagtccgacaccacgaccacctctttgctttttcgaaaagaatatagtgaataactcgtctacatcatccatgtcaacgccaggaccagtgtcggaaacatatacaatgccatctttaacatcgaataatatttccttggtaagtgtttcggtttcctttacccaatatcttgaattattgaccaaattaatgaaaacgggatatatgcgtgatggttgctcatatatggctaatttttcaaaatcgctggtgcatctaaaatagatgctatcattttctaatttgtttttgaaaaaattgttaacatatgtgtatatatccagtcctgttagtaacgcacggactttttctccagataatttaagagggcttaaaaaccgccaagaatcacttaaagactcatgagcattagttatacttaacaatgcacttttttgcaatggatcaagtgacgaactactcaaatttttgattccgcgctcaatagtcatgtcaaatccttcaatctcatgacctattatttcaacagtaatccctaactgcgctaacgcattgacttgttcaacttgctttttcaaacgtgagttttcattgactgaaacaatagctaaactttccaggtctatttgttccttgaggttttcgaatgctgaaatataaggagataatttttgtgttacttctatatcttgaatttgataatctagttctattaactcgagggtttgtttaagaccaatttttttattatcaagatcagtaagatacgctgataccttttcatgaaaagctttatttatcgcactaactgtttcttcaaatctctcttgttcatctttaagagattgtcttccttttgtagccaattttcgtatctttgcatgcaatatagccgctttactacgaaaatctttcgcagctatttcaatatcatctttaacaactaattgttctaaagcgaaactcaatgagctacttatgtcttttaactggcgctttgcatctaattctatatctctgtattccctgtaatctttttcaatactgcctaaactccgtggcacagctcctaaagaataagattttagctcggcatcgagtttatcaacttcttctcgtaaaaagagaagttcttcttgatctatatttttattttcgatggttaaacttttagatatttcggatcaattattattgattagactgagtttgtttatattattttgtatggatgctttaattctttttaattcttttttaagaagttttttcctgtcttcttcagccttggatgcattatattttgcattaatttcttcgagtttttcttctctaatatgagaagaacggccaatgaattttttagcaacttcaactaatatatgctctacaacttctcgaaaaattttggaagctttattatcgattatcccttctcgccctgctttatcacggagattagggttgtgttctttagttattgatacaccaccaaaacaggctctattactaaacatatacagacctgcatttttagtacgtcttttttcaatttcaaaaaaatcgttatcttccctaccatatggcataactcgtaagtgatcacgaaataccattacgccgccaaactgttcacgtattgtatcaaatttagtatgttgttcatcggacagtgtcgtattctttttttgtacttcaaatgtacctaacctcatgaagaaaggaccaaatctagtatcaattcttgtcttataattagtttttggttttatagttatattttcgtaccactctccaaaagctttaactcttccactaaaaaaaccagtttcgtcaatattcccctcaactatatgctctaattgttcaaaatcggttatatcgaaatttctcacctcatcaataatcaatctctggaggttaccattccacactaatacgcttgttttaaaatcagaaaccttactttcatcgtcacggcggaatggattaacgaaactatttaaggtttgtataaagcgctctttagctctaagttcagaaccttccgcctctgaacctgattctaaagataattgggctgtcaaatcataatgtatatcagcaatgaacattgcagtaccacattctgaattattttgccaaacgggccaagattgaaaatgtttttctgtaaaataaacatctatagcggttttttcaattgcaagttgcgtaatttctttcttttgctcggtttctaactcgctaaatgcagtccaagcactttcaattcttttatcacgtgaggcatcttttccatccccccaaatattactcattaatgcatcaaacatgtcaggtaatatatttgatagctcactttttgaattgaactcggtaatgggtatacttatatcattgagcattaaaaaaggattttcaaataatctccagtcaagcaaacatgctacataattattatttttcttttttgatatgagtagcatcaaagagcctaaagcagcgcaggacaatctaccgatacccttttgaccttgcttctctcttttatcgactataccgttacgttcttctataggaacttctttatttgttgctttagattcagtgccaactgttagccatttattgattacatcttcaattgacattccatgaccgttgtcgacaagtgtggcaacaggaatttctccatcaaaaatattaagcgatacacttgttgcatatgcatcgtatgaatttttccataactccgaaatagctgtaggacagtcggctatttgctctctgcctaagtgatcaatggttcttgctcttgtttgaaaattagctgaaataaccattttcgcctcttgagattattttaatttttctgaaaattagactataagttgtgagattgatgatattaatatttctccgagaagaggagggactgcattgcctatttgcctggcttgttctgttgtatttcctgtaaacaggaaatcatctgggaacgtttgaagccgtgctgcatgtcttaaggtaattccatggtttttccacggatgaacgaatcttcctttagatgggttatggcacccagttgtgatagtatttgagggcaaatgtatcatcattctgccatatacatctttgtgtccttcatacccgtcactgtgacattttaattgaaattctaatccagcatcagcacgactaccgtttaaaactgtagcattaaaacgcgcctccatatttggagtaggtttcatatgtatgttacaaggatcatttatatttacaggactagattcaaactctaagctttcaagcattttaagaatttcatctttattatagtttttctttttactaaaatgttctgataaatatctttcaatcaaagctggagtcagtttctcgaaaacggaagatgctgtacgccacgctttttttccatcaaacttaacttcaaaagaagatgggctaaaatgtgtttttaaaggagggaaatgaatttcttttttatctttataaatatcatttcttacacccaaaatgaaaactcttttacgattctgtggtaccccataatctcttgcattcaatatggagcaatgagtaagtgtataattattgtctttagatagttttttaaaatcgtctaagtaacttttgtgacgctcccatagaagacctgatacattttcaactaagaatatttttggctgaaactcatcaacaaaagcaaaataccttaagagtaatttatttcgtggatcattaacgcccgaatcttttaatctgtggcttgagaaaccttgacaaggtggcccaccaagaatcaatgataattcttttttttctaattttaattcagctctaagctctttagggcttactaaaagtatatctttttgtaaaagctttgtttctcgtttcaaacgattaattaaattttctttatacgtatgagcggcagccttgtcgaattcaattgcagcgacaacatcaacatatcctaaattatgagcagctaaactaaaaccacctgctcccgcaaataaatctaatgctttcatggctttccgaataaaggttaaaacttttccattatacattattcatattaaatgacaagctttgtttttgttgtgatttaattggaataacatgttattaccctttcacttcttgaaaattatgattttaaacaagaataattttaacctgtttttatctattgagtgttttcatttcactgcatttaaaatgtatgattagagttaattattcactgactattttataactatctatacgaaatttcctgtgattgcgtatggcactatacaccttcgctaaatctgcttccgtcatagcaaccctgcatctgcttacaacataacaaaccccactcgcccccacctccgcaggggcaagcccatcaatccttaccagtcagtcaacccaatcgccttcatcacccgttttctcatatgcacaggcagtgatgccagctcctcaatcgatctcacccgcgtcccgttgatcacgtccctgggcttaaagctgataatgatccgcccccaggtcactttcacatccagttgcaccccaatgggaaaacccgctgttttcaaccaacagcctttaagcgtaatcgccggaatgcggcggtaatctggagtgcgggtcacataacccacggtcgcatagcgctgggtgtagtttgtctctttagcttcgtggtggcctgaaatacaatcgatggcagtcatgattactattccttacttaatagtgattgtgatcagcgatgcggatgtgttgccccacattcgtatcgcgctaaattacctgatgatttaatcagggaggcgggaacgcatcgagtgtgaaaagagaaaactgcgaaagggcacgcagaaagatctcgctgatttcagagaagttcatcgattttcgacctgtatccagcttccctctttgccatctcacagacatatgaaaatccaggtagatcaaggcagtttcaagcgcggttgaggctggggcagactgttaaaaacacgcgatttgagccggtgtcagggaagggggcgttttctgtcgcataaccacatttccctgtcatgaagacgcgtcattaaaggatgtgtgctgcgttcatgaaaaatgctgttttagctgtcatgggtaaggtgtaacgatgcgcctgaatatctgagacatcggttcgtagttcacataaacaccgtctatattagcctgaacccattcttctggtgcgatatggtcccagtcaaggtcgtaaccagcagcaagagaaagatgctcaaataataagcgctggactctgccattcccttcgcgaaagggatgtatcatgttaaattcgcagtagtattcagccgctttatcgcagaaagcatctttagaaagacccgacagccagttatcgttgtttaatttagtgaataatttattggcttcagcggtgatcctgtcgcaatgacaaaaccgtgtcccgcctttagaaatatctacggttcgcagcgtacctgcccattcatagagatttgaaaaaagctgtctgtgaagctggcacatataagccaggttgtagggtggctggctgaacacgatgtcgttcactgttatcgcagtgatctctctttcagccttttcaagcacatcggtctcttcgatattgagcttgttttttaatacagcgctacccggatagcagtaatgatcattagcggcatcatacttatccataagcattacctcctgtattttttcaggacactttccagcgatggtttttcatttgaaatatcaatgtcgataccttccagctttgagctacctttgaatttttttaattttgtttgctcgtaatgcgcgtaaggatcaaaaacgcttgaacaaaaaacaaaaatgaatgaatcaactttttgcttcagttccgtccagcttttggctttgacattgattgtcagaatgtccgacacttcttgttttgattgcttaaagtcttctttattacaggcagactctaatgcctctttgtttgaagagacaatgttcttaagctttttaattttaatgaagaaggaatcccagccattaacctcgagcttattattcagttcttgttcaaaactgttcttaagctcgaagtaggagccaaattttctgagatcatctgttgtcgatgctttcaatacttcgcttactttcatatcgattaacaccttcatcaccaataggcggtctattatacaattagagcgagaaggatgcgcagagattttgtgaggcatggcccgatacctgcacagcagagcatccacagggccacccaacctaaagtttggcacacgctcctcagcataagccagttaaccagcctgtcctgtgttcagacatggctgccagtcacaggtttactgaaccggtttgataataaacgccgtgcctcaacgtaacgcttgcagcctgtcctccctgagcggatcacccaggtccgcgcagaacgcaacccatgagacagggaggggttttgctcgtgaacacagccctgagcgttaacgcctcatctccttcacgcgaccagcgcttttctcaggcttttcgttctgtgcgacatgcccagtgcgcccctcactcacccaaaacccgccccatccccacccacatcaaaaaaattttaaaaaaattattttttacgatccattcagcctgtttttttctcagaaatatccctggtagataaaaataaaatcggtgtcagatagggaaataaagtctgccttcggaataaggcagtatcttatataagaaagatctgatggccttaataacacaataactctttttaattaacatgcggcgttttaagtgtattgcctaattaaaaaaccgccactagaatgcgccgtgtccgataatgacgttctgtaacatgtttatgtaagacgatcattacggtatgccagggaggcaattccctcgatcaccctggcatggcatagcatgaaatatgccatctgatatcatgctcatattacttaatcgtaataataaaataaggaaatcacagatgaaaaaaatcaatatgtctgaagcaagcgcagttgtcggtggaacaacaacgtgtgtaaacagctttgagctgaacctggtgggcgacgccacggtatgtaacgcagtaaaaacctgtaccgataaaaatggtgtggtgacgaaaactttcaccccagccgctatcatcaactgcggaaacgcaggctaagatatcgctctttatcactaaataagagtaaatttcagtaatatttattcttaaaggcgttgtgtattatatacaacgccttcctgataaatactgaatgtgccttattgttgtattcaggatcgaagcccgccatgaaaaaaagaatttcttacgtgctggcctataccgtctttgttgcggttatttcagcagtgattaccaccgcctggttccatatcttcgtgttaaatcaaaccagcagtgcagagcagcaggtgctgacctcgctttctaccgacaaactggataaaagcccgattgccgacggcgacgatattatcgagatcttctcttacggctgccattattgtgagatcaacgaaaagaacgtagacgagctggaaaaacggatgccggcgggtaaaaagctggtgcgtttacatctcagcctggacagtcaggccgggctggcgcgctatgcgccggtgttcgccacgctggaagtcatggggattgaagaagcccatcgccagagcgcctatgatgcggtgatgaaagacaagattgatttaagtgatgcgactcagcgtgacgcgtggctggaaaaaaataagattaacgtcgcggaatatcacaaagtcagtcagtccgccgacgtgaaagcgcgtctggattatatgacgcgcgtttcgcagtattacgatatcaacgccacgccgacctttattgtcgcgaaaaaatggatggcgattcaggatcgtgatttcccggccttctctgacaaactgctctctattttagaaacaggtaaggcaccggagtaataatgaaattttatgccctgtggtgcgcgctgttctggcggaacctcaccgccagaagtcagtggctggcgtataagttccagctggctggctacagggcgcattgtttattatttcggtgttttcattaccgtattatttttgcgtttgcccacgtcaggcgttttttaaaattaatcccgcgtgatgtgaaatggcgcgcagcggtggcggaagctaaccgtcagtgtctgctgcaggataataaaaaatttgattatatctggctgacccagcggcgaaagttgctgattgaggcagtgacctacgggcagaatcgccggttgttgcgcgagctggcggcctgttcggcacagcttaacgacgtggtggagccgctccagcgcgcagggcagccggtgcttctggcgccgctgcacatggtctcggacgttctgactacaatggtgggcgcggcggcctatccggggaaagccacggtgatcacctcccgcagtgcggatgcgcattccgaagccgagcggcggctgggtgggttagatctcacctattgttcgattcatgaagataataaaaatattgccggaaacttaatgacctcggtgatggcggcggcggagaataaacgcaatattattttattccccgacattacgccggacttcacccagtttgccagtaaagacaaagccgagaaattaccttgccgtttatttgatcgtccggccagtttacacagcggaattatccggttggccagaatgatgtccgcgcaggtggtgttttatcatctttattttgataacggattaaaaataaaggtgcacgatccgttagcagccagaaaactcaaggatgatatgccgcgcattatcgagcaaagcattcgggattattcgactgactggatgctgtggcattcccactcactgttttttattaatgactaaacagccatcacaagagaaaagaacagggcgttttaggggttaaattatggaaaatagtattccaaaaatcgtttatcaggcggaaaccaatgaatgtgcgttggcctgtgttgctatgctggcggaaacccagggaatggatgtgccgctggacgtgctgcgcgaacagtatccggcgtcggcccacggcaccgcactgtcaaccctgtgcaccatcctgtccgacctgggtattccggcgtatccggtggctttcgacctggatgaactggcagaactgccgttaccggccattttgcactacggcgccagccattatgtcctgctggcctaccgccagggcagctatgtgtgcgtgatgaacccggcgattggcgagcagctgttacccattgccgcgctgcgatccgaaatcagcggctatgcgctggtgctggataaagacgccatcggcgaaaagcccgccgtggcagcccacaagcgtacgcggcgcttccgcgcgctggactgcatgagcctgaaacagacggcagggattccgggcatttaccgcctgatgctgctggcgtttctggtgtcgctgaccctgtttatcatgccggtgatggtcagttcggccatcaacaatgtgttctcctccggcggtgaacgcgatttcccgtacttctactacctgctggcgtttgtggtatcaaccctgctggcctttgtcgtgcgcagcgtcaccgagcgctttatcaaacggtttgtggtgatgcaaagcgtcagggggttcgccagcctgctgagcaatacgctcgcgtactttgaaaaacgcagtccgggtgagatctacagtcgcttcgccaactggcagatggcggcggcccagaaaatcgagctggataacagtctgcgcacagactggatcgtgggcgtgattgcgctggcggtgatgtgttacatcagcccgctgcttgccacgatctccgccgtgggcgtgaccttaatgggcctggtcagcgtctgggcgatttttcgcgatcgctattacacccagcaggtgcaggtgaaaagcgcggagcaaagtgacttcctgctggagtcgatccagggcttcgccacgctgaaatcggcgggcctgagcgctcagcgtcagacggcgtttgccggttttgccgcgtccctgtttgacgtcaggcagaagcagaaggtgtacgaacaggtcaagagcagcctgtaccagctgattggcagcctggagatggtgtttttcatgctgctggccttaccgctgctgaaagacaaccacatctcgctgggggagttcttcgcctacagctttgtgcgccagatttttaccgcctatatcacccagattttcttctcggtgttgcagaagaaccagctgcacgtcattgatacgcgggctgccgatctgtttccgcaggcagaaaaagacgaggacgccggggcgctcgtagcgcccgtccacttcacccagcggctcgattaccgtgcgctgcagtttgcctacgagccgggcaagccggtgctcagcaacgtgtctctggcgttatgccggggggaaaccctggcgattgtcggcgagtccggggccggtaaaagtacgctgctgaaagtgatcaccgggcttatcgcgccccagtccggcgaaatcctggtggatggcgagccggtaagcgcccgtcaggcacagaagctgttcttcctgcaaagccagggggacatcctgttcaacaccagcgtcctgcaaaatatcacgctgttcgatcgccatcacgacgcgcaaaaacagctgcgcattgatgcgtccctgcgcggcctgaagctcaccgatgtgattgacagcctgccggggaaacaaaacgcgctgatccgcgaaagccatcccgccctgtcgctggggcagcgtcagcggctgatgctggcgcgtgccatgtacagcgactgtccggtgatggtgctggacgaacccaccgccaaccttgacgaacagaccgcgctgcaggtgatgcaaaccctgatcgaccactgtcgtgaatacggcaaaacgctgatcgccgtgacgcacagtgaaacggcactgccgctgtttgaccgcatctgcgtgctgagaaatgaacagatgcaagaggttcaggacgcggcggagacgggcaggctgcctcagggggaaccggcgtgagtgccgtcataaaaaaacgtcccgtgctgagcgcaaaattctctaaacccgtttttctgctggtcgcactgctgcttattctgctggcgggcggcgcctgggtgctgcacagcatgttgtctgaccgcgttgtgccgcaggtctcgcaggtgatcgatcgcggtgatattgaaaaaaccgtgctggccaccggcattcttaaaccctctgtgcaggtgaacgtgggcgcacaggtcaacggccagttaaaaaagctctatgtgcgtgccggcgatcgggtcaccaaagggcagttgctggcggaaattgatccaacactgcaacagagcgaactgcgtaaatccgaggccgagctggacagtgcgatggcgcagaaacaggcgtcgttatttaccttaacccagtaccagcaggagctgaaacgccagcggcagatggatcgtgaaggatcaggcaccaaaagcaacctggagcaggcgcaggccagagtggatacccagaaggcacagatcaaagtgaatgaagcgcagatcgtgcaggcgcagatggcgctggaaacggcgaaagccaacctgggctatacgcgcattctggcaccgatggacggtcaggtgctggggatcgtcaccaaagagggccagaccgtggtctcctcgcaaaccgcgccgacgatcctggtgctggcgaacgtggacaccatgacggtgcaaacacgtatttcagaaaccgacatcctgaaagtccatcccggccagccgctgtccttctacgtggtcgcggacccgcatcatcgttatcacagcgtgatgggcgcgttgcaggacgcgcctgacgaggccttacaggatagcagcctgcgcggtcagcctcagcagtcttccgccgtgtattacaacggcgtgttcagcgtgccgaatcccgaccaccggctgcgcacctccatgacggcacaggtctttatcgtcaccgaacaggtcaaaaacgcgttacgcctgccggtgatggcgctgggtcagccgcagggtgatggccgctacgctgtgcaggttgtgaaaggggagacaaccgaacagcggctggtgcgcgtggggatcaacgaccggcagtttattgaagtgaaagagggcctgcgtgaaggcgaacgtgtggtcacgcaaaacaccgcaggggccgccaatggctagcgcgccggtgattgaactctctcatatctcccgtcgttttgggacgggcaacgcagcggtgacggtgctgaaggacatttccctgcgtgtgcacgccggtgaaatgctggcgattgtcggcgcatccggctccggtaagtccacgttgatgaatattctggggtgcctggataaaccctcagaaggcgagatgcgcattatgaatgtgtccactcaggtcgcgacgagtgacgagctggcacaactgcgcagtcagtatctggggtttatttttcagcgctatcacctgatgccttatctgaccgccatcgagaacgtcacgatcccggcgctgtataccgacatgcccgtttcggcgcgtcagtcgcgtgcccaatatctgctggagcgcctggggctggggcagcgcatgcactaccgaccagcgcagctttccggtggtcagcagcagcgcgtcagtatcgcgcgcgcccttatgaacggcgcgccggtgattctggcggatgaacccaccggcgcactcgacagcgccagcgggcaggcgttgatgggcattctgcatggtctgcaccaggccggtcatacgctcattatcgtgacgcacgaccgcagcatcgccgcgcagtgtcagcgcattgtggaaatccacgacggccagatcgtcgccgaccatgccaacccggcgagccaacagggccagccgcagggattacccacggttgccgcgaccggacgcaccaccgtctggcaaagcatcaaagaagcgctgcgcatggcgtggcgttcgctgctggggcatcgcatccgcgcgtttctttccatgctcggcatcattatcggcatcgcctctgtggtgtcctcgatggcggtgggcgagggcgcgcggcaaaacattctgagccagataagccagttgggcaccagcaccatcgaaatccagcccggtctgggctgggatcagccgcgcccggattttgagcggtcgctgacgctggaagacgtggcgctgctgggcaaacagccctttaccgacagcctgtcgccggtggtgagcaaaaccgtgcgggcgattcgtggggggaaacaggtgctggtatcgctgctgggcgtgagcaacggtttcttccgcgtgcagggcctgcattttgttgccggcaaccgttttacgccacgcgacctcgacgatcgtgagccggtgatcatcatcgatcccaacgtgcgcagcacgctgtttgccgacgggcaggaaccgctgggcgagattatccagcttggcggggtgccgttccgggtcattggcgtggcggataagcacgggccgaagtctgtcggcgagcagccaggtgcctggataccttatacctcgctgcttgaacgcatgtcgggtgatacaccgctacagtccattaccctgcgcattgctgacggttatccgattgaaacggcgcagcagcagattgagcaacggctggactcggcccatggcaaacgcgatttcttcaccctgaccaacgatcaactgacgaagacgatccgcaaaacctcagaatccatgacgttgctgatcacggcgattgccgggatctcgctgctggtgggcggcgtgggcgtgatgaacatcatgctggtatccgtgacggagcgcacccatgagatcggcattcgtctctctgtcggggcgcgtccggtggacatcatgcgccagttcctgattgaagcgatggtgatttgtacgcttggcggcctgacaggcattgtcggatcgggcatcgcggggctgattttttctcaggttacccaggagttccgcatgattttcacctggccgcccatccttctggcctgcgggttttccgcgctgatcgggctggggtttggctttttcccggcgcgcaacgccgcccggctgcacccgaccgaggcgctggcacgcgaatgaacaggctgacgcaattctccacggtgctgatggcgctgatgctgaccggctgcggccaggcactgaaaagcgactatcagcggcctttgctctcggtgcctgacgcctggcgcgtacaggataccggcgaaggcgtggcgacattcaccccgcactggtgggacaactttggcgatccgcagctgtcgcggcttatcgtcgccgcgctgcaaagtaatcacgatttagccctggcgggcatcaagcttaagcaggcacggctggcggcgggcctgtccgatctcacgctgacgcctgatttttcggtcaacgccagcgccagtaacagtaagaatttacggcgtgatacggcgtccgtggaaaattacagcaacacgctgacggcggcgtatgaactggatctgtggggaaaactggcgcgcacgcgtgagcagtcggactggcaggccaaagcctcagaacaggatttgcgtgccaccgccctgacgttgatcggcacggtgtcccagctctactggcagatagccagtctgaatcagcaaatcgggaacctgcagcgcagtctggacattgcccgggatacgctgctgcgggtgacgtcgcgctggaaagccggggatctcggccagcttgattatctgcaggcgcaacaaacggtgctgaaccgggaaaacagcctgcacgatctcagtcagcagcgcgaggaaagccgtaacgccctcgcgattttactgagccgtccgccggggcaatatccggcagagcgccgttcgctggacagcgaacagtctgtgccggtggcgcagcgcctgccgctggagacgatagccaaacggccggatgtgcgggccgccgagctgaacctgcgcgcggcgctggccggttcggacgtggcacggctgaatttttatcccacgctgacgctcaatgcctccctgaatgccggggcgtcggtgttccaacagtggttcagcaatcccgccagaacgctcggatcggcgctcgatctgccctttatccagtggaataaggtgcgactgacgattgcacagtccgatctggaggtgcaaagcgcggccatccagttccagaaaaccgcctacagcgcgttacaggacatcgacaacgcgatgtcacagcgcctgacctggcagcaggaaaaacagcggcagcgggataacctcgcactgagccagcaaaggctgacgctggtggaaagccagtatcgccacggtgccgtggcctatcaaacgctgctggatgcgcagaatacgctgctggacagcgaaaacgcgctgctgaacacgcaatacaactacctctattccacgatgaagctctggctggcgctgggcggcggggaagacgacacagtgaatcactaaggatgaatcatgcaaatggacagtttacaggcggcgaacgcgccacgtcgggtggtggtcaccggttatggtgcggtcacgccattggggatgaatgccgctgaaagctgggcggccatcatggactacaaacccggctatcgctattgcgacaagtctgccgcagggatcaaatcccgtttttacgggctgatcgatgaagaaccctcactcaacggcgttcctgccgcgatccgccgccgcctgccgcgtttcgcgcggcttaccctggccgccgcgcgggaagccatgcagatggcttttggtgatgaaaagcccgggcagcactacgatctgcgcgattgcggcgtcatcatgggtaccggctgggcggggcaggacgaaacccagttgcattatgaggacttcctgcgcaccggcgtaggatcgccgtttggctgtttcttctccatgcccaacgccgccacggcggccgtcagtctgttgtgggcgcttcggggataccagaacacgccggtggccgcctgtgcgaccggcaccatcgccgtgggcgatgcctttgagctgatccgccaggggcgcgccaacatgatgctggcaggcgcaggcgagtcgctgcgctcggattcggcggtatggaatattgatgtgctgggcgcgctggccagtgagcaaacggcgttaacccgtgcctgctgcccgtttagccagcatcgcaacggctttgtcctgagcgaaggggcggcggtgctgtgcctggaagcacgggaatccgccatagcgcgcggtgcgacaatactgggcgaaattctcggctacggcaattactcggacgccttcgattttaccgcaccggctgacgacaaaattgcccgggtacagaccattcgcggcgcgctgaaccaggccggtattgacgccagcgcactggattacattaatgcgcacggcacctccacgccgcttaacgatctcaacgaaaccgaggcgctcaaaatggcgctgggtgaggcggcggcttatgccacgccctgttccagtaccaaatcctatagcggtcatctgatcgcggccgcaggcagctttgaatccattatctgcctgcaggccttgcagcatcagattatccccgccacctgccatctcgatgcgcccgatccgcagtgcgatctggactatgtgcccaataagcaccgtccggcggcgttgaacacaacgctcaacctgagttttggcttcggcggcgcgaacgcggcgctggttatcggtcggggggaataaagcatgtcggtgcgttatacgctgcgtgacgcggagcgctgggccgcgttttccggagaccgcaatccgattcattttgatgccgccgaggcgagacgtctcggcctggacggattatgcgtccacggtatgcgcgcgctgctggatgtgaaggccggactcagccaggcgctggaaaaacacacattgtggtcggacggtctgctgttcaccagccggctgcgcgatcccgtgctgtgcagcgttccctatcagctggcgttaaacgaaacgcacaccggtgaccgggtacagatcagcggcaacctggttaacagctacaccctgcagagcagcatcagcagcaagctgaccgaggcgaaaccgctggcgttatcgccggtcagccaggcgaagaccctgcgtggggcggcgctggcggcactgtatcgccagtttcaggcggtggaaaatctccctattccgttatggagcttttttgatgccgtgctgtttcgtcaactggtgaacgccccggaaacgctcgacaccgtacaccgtcttctgcccgatcatcacgcgacctgcctgggggacatattcagccgggtacaggtggtgcagacccatcatcagacccatttttcgccgtggctgctccagacggcgggaaacgcgctgcaatgtgaacccttgcattatgccatccagccgacgctggtcatgggcgaaaaagcggccggtctggtgttagtgacgggcattcaggcatggcgcatcaatgagccgctgatgaccgtcacggtaacgttgaaaaccgggccgctggctgaataacaacatatctaaaccactaaccaaaaattcgatctgaacataagtaaatcattgaactaaaggaataaaaaatggctcaatttgatgaagtttacaccaaggtatgcgagatgctgtgtgatgcaaaagatctggagatgaccagtctccggccggacatgccgctgtatctgctgaaactcgacagtctggattatgtggaactgatggtgctggcgaagcgagagtttggcgtcacgattgaggccgagatgttcgccagtaacgtcaacatgacgctgagcgagttgtgcgagtacctcagcgaaaaaagccagtaagccatgcgtaatcaatggatcttagtcaccggtggaagccgtgggattggccgtgcgacggtattgcggctggcaaaacagtggaatgtggtgttcacctggtgcaaggatgaaagcgcagcgcgcgaggtggagcttgcctgcaaggcgttgcccggcagggtggaaggttatcaatgtgacggcggggatgagcaggcggtgacccggctggcgaccgatctgctggcgcgctacggtgcgccctatgcgttggtccacaatgccggtattacccttgatgccctgcacattcatcaaaccccggcgaactggcgtaaggtgatggacaccaacctgaatactctcttctactggaatcatcatctgctcgaacccatgatgatgcaggggacaggctcggtggtgctgatgtcgtcggtgaccggcgtgaaaggcaacagcgggcaaagcgcctatgcggcaagcaaagccgcgatgattggtctggcgcgcaccttagcggtggaactgggtcgctttggggtgcgggtcaacagtctgttgcctggctatattgacacccagattatggccaccatccccaacgccaaacgggcggaactgcgaaaaactattccgctgaaacgctttggcaaagtggatgaagtggcgggtgccgtcgcctggctggtcagtgacgacagcacctatatgaccggtcaaaccctcattctggatggcggtctttctgcctgatccccggcctgatctctgctctgcttaaacaggacgtgacccgtcctgttttttttactgacgaccacctgtcaggcgcgttctgcctctttcctgctggctatccttaacctgtcccttctgcggctgattgcactcaacggcactcaatgcggcgggcaaaaggggcctttcgccgggtcagtcagcctcatctaaaaaacgttgcacggctcttatcgaatccggcgcgggatctgagataaatccttgtaaatacgtgcgcctaaataagtcatcccggccagaaaagcacagaaagggtgggcataagccgttagtcaggcgttttaggtcgtgcggtaacggcgttgatgttaaataaaaccattaatccgtagattaaatgctgtgagaaatttaaaatgttaatgtaattaaatccctcggttatatcctcacagtttcacggggattaatcccgccgtttttttcattgccttctgtttgatgtattgtctgttaagacgtatattaaaaatacatccgtaagttattcacgtgttacgtaaaggaggttttataaacagccgggaaaactgatcgctattattgcacaaaacatccttcgcacgcgctgtattaatgcgcgcgtattgaccctgtcagaaaagcatttctgggtgagtgccaccggactgaatgtttatctgagaccacatgaatatgaagagacactatgaaaaatcgtaaatacctgacgccgtctgaagtcgagaagctgcttgaagcgaccctgcacggcaagcacccagagcgggattactgcctgatctggatgtgtttcatccacggctgtagagtcagtgaaatcagcagctggcgactgtccgatatcgatatagaggggaataatatttatattcatcgattaaaaaacggcttttctaccgttcatccgctttaccgacgtgaacgtaaatcattatcgctgtggatgaataaaagaaatcattatcgtggtgcggaaacagactggttatttctttctaaccgaggcacaaaattatcccggcaacgcatttactggttaatccgaaattatagtcaggcggcaaatctgacaattaatgcgcatcctcatatgttaagacatggctgtggttttgcgctggctgaccggggaatagatacccgtttgattcaggattatttaggccatcgtaatatacagaacaccgttatctatacggcaagtaacgcgcagcgattcaaagaagtgtggtaaataagctgtaacgagttattacaatggagtcattttgaactaaattggagcttactttagtgagctgttatattcctgtcaatactgtttgtattatcgagtaacattttattttaactatttaaatttcaaagtgttatgtgaagattttctgtttaattacctccctgcacccctcggttttttcttatctctgtgtcacccctttatattccgcattacgttagcttaaaaaatactatatctatatcttcttaaatcgttttttttaagtgttttatcctgagttatccctgttttaaggtgtaaaaaaccaaaggagtcactttagttcaaaatgaatcgtttgtctttcgggtaaaaccgttcggcgatttattaatttgagacggagtctcatgaactaaataaaggaatgacagatggttttgtcataacgaattcgatcgccgcgttataggcatatcgattttaattgtttacaggataattctcgtgaaaaaaacgcttattgctattgctctgatggcgacttccgctatttcttcttctgctttcgcttctgatggcgccgtgaacttcaccggaaccattaccgatgcagcctgtacgattgacaccgcgtctcagaaccaggacgtgttcctgggcaacatcgcacgtaccgctttcgcgggtgctggttctctggctgcgccgaagaaattcactctggtcctgactaactgccctgacaccgtaacgggtgcaaccgtacgttttgacggtacccaggtttctggcgacaacagcattctggccctgaccgctggcgacagcacagcaacaggtgtgggtgtgcagatttctgacagccagaaccgggtcgtcccgctgtatgaagattcttcggtttaccctctggtcagcaccggtcctaacaacctggacttcagtgcgcgctacatctctgtagcggattccgtcaccgtgggtgatgcaaacgcggtaacccagttcaccgtcgtttatcagtaatttcgcgttcgtagtagcagatcagaggccgctgttgcctctgatctttttgaatgtttcagggcaggtagggacaccatgaagaattggcgcaaaacagcgttggcagtggtattaacgactttttgcacgatcgcgcaggctggcgtcgtcgtcggcggcacgcgtctgatctatgacggtgcaaacaaagagtcatccatcaatatcagtaatcccgacaaaaacgtgtacttgatccagtcatgggtggacagcggggataccgcgccgggcgcacaggcgaataaagccccgtttatcgtgacgccgcctttattccgtctggacgggaatcagcaaaacattttgcgcgtggtacgggcaggtggcgatctgccagagaacaaagagtcgctgttctggctcaatatcaaatccattccttctgtagagaagcggcaaaacaccctgcaaattgcggtgaaaacgcgtatcaaactgattttccgtccggctggtctgaaaagcacgctggaagaggcggccaaaacgctgacctggaaacgagtgggtaaccagcttcaggtgacgaatccctctccgcattacatcacctttttcaacgtcaggatcaacggcactgacgtcaaaaatgccaccctggtcgcccctgagtccgatgccatgttcgatttgccggccagcgtcgccggcggatcgctgacctggcagtttatcaatgactatggcggtaccagcaaggttctgacgggcagtctctgatctcgtcgtcggggggcgcattacgcctgtcgcctataaggaagtgatgcacgcaggcgccaaactgcgtgatgagttggaacaaacacaatgaaaaaaataacaaatattcccgcgtcagccggtttcaaactgtcctgtcttgcacagctcgtggcctgtcaggttgcgttgttcatcggcggaacgggtgtggtcagtgcagcggaatacttcaacccggccttattagaaatcgataaccctgtacagggaaaagcggatttatccattttcgaagacggcgaattgcagccacccggcacctatcgtgtggatatttatcttaatggttccgaggtcgatacacaggatgtcacctttacccttgcaacggatgcgtccggtaagcaacgccttcagccctgtctgagtggcgagcagttgcgggagatgggcgtaagaattggcatgttcccggatattcaggccacggatgcctgcgccaattttaccgaggcaatagcgcaatcctccgcaatattccgtttcgatcagcagcggctggaactgagcattccgcaggcggcgttaaattcgcaagcgcgcggttatgtctcgccagagctgtgggacccgggcattccggcattgctgctcaattacagcttcagcggtgccaacaccgaagcgcgggaaaatgatgcccgaaacacgaatacctattatctgaacctgcgttccggcgcaaaccttggtgcctggcgtctgcgcaactactcaacgtggaaccgggacagcaaagggcaagacagctggaactccatcaatacttacctgcagcgcgatatccagatactgcggagtcagctgacgctgggcgacagtaactcgccaacggaagtgtttgataccgtgcctttccgtggcattcaactcgcgtctgacgacgatatgttgccagacagcaagaagggctattcacctgtcgtacgcggcatcgcgcagagtaatgcccaggtcaccatccgccagaacggctatgtgatctatcagagctatgtccctgccgggccgtttgccatttctgacctttatccaacggcgggcagtggcgatctgaatgtgaccatcaaagaagcggacggcaccgaacgcaccctgatcgttccttttgcttccgtaccggttcttcagcgtgaagggcacctgaaatacagcttcaccagcggtcagtaccggtcgtacaacgatgaggtcgaaaaaacgccctttacgcagggcaccgccatctatggtttgccacatggcgcgaccgtctacggcgggctgcaggccgcgagtaaataccagtcgctggcccttggtctgggacaaaatatggggcgcatcggggcactttctgctgacgtgacccaggcgtggagccgccaggagaatgccgtgaaagaaaacgggcagtcctatcgcctgcgctacggtaagagcttcgttgaaaccggaaccaacttcagccttgccagttaccgttattcgacggcgggattttataccctgcaggaagcgctcgaaagctacggcagaggcaatgacgataaccgcgatcacaagaagagccgtgccgaactcacgctcagccagaacttatggcagcaggggggcgcactctcgctgagcctggtgaaagaagcctactggaataacaaccgctccagtgagtcggccagcatcggctacaacaacacctggaaagggatctcatacggtgtgaactacagctataaccgcaacggcatggacggcaatggcaaccgcacctattacaccgaccagattatcgccctgaacctcagcgtgccattgagcaaatggctgccgggcagttatgccacctataacctgaacagcagcaaaaatggcaatacctcgcataacgtgggcctaagcggtacggcgttacgtgacgacaacctgaattacagcctcagtcagggttacaccactcaggggcaaggcgcgaacggctatgccagtgccgactataaaggcacttacggtgaaatgaacgccggttacggctatgaccacagccagcgccgcatggattatggcctgcagggcggcattgtggtccatgaaaatggggtcacgctttcacagcccctgagtgaaacgctggtgttggtgaaagccccgggcgcgaacgatgtgagcatcgccagcaataccggggtacgaaccgactggcgcggttatgccgtcgtaccttacgccaccgcctatcgccgtaaccagatttcgcttgataccgcgaccttgccggacaacgtggatatgacgctgaccagtgcgtcggtcatccccacgcggggggccgtggtgcgtgcagacttcaagccaaacgtgggccaacgcgtgctgatgacgctcacccgcgctaacggcgagccggtgccgtttggcgcaaccgcgggcattgatgatgacaaaaagagcactggcagcattgtcggcgacggtgggcaggtttatctgtcgggcatgccggataggggaacgctgacggtgaaatgggggactgcggcggcacagacctgccgggtgagttatcgcctgaatgaacagtcggccacctcggggattcaacttattaatggagcctgccggtaaggcggaacagggatatgaacgaacgcatgcagacctttattctggacacgacctcacaccgcaattcgttgcgccgttctttcgggggcaaacgcgcagcctggctttgcctggcgctggcgggcggcatgttaagtgcccaggcgcaggcaagtgattgcgccccgacagacgggacaaaatcgtacaacttcaatatgtcttacctgctggcggacccgtcacagaacaccacgggcagggtgattaacaatgcctatcagtggaatctcagcgggaactacaacgtgacctgctcatgtaccggcagctataccggggcctacgtcacggcaaaagtgccggataccgggctggtctacagcgacggtaatctcaattattacagcatcaacgaatatctggcggtggccagcgaggtttacatcgccggcggttatggtgcaaacagggcaacaccgttcaccagcgtcagcaacctgaacagcgcgaccaactgcggcaggtatccttacgccaccggctcacgcggttcgatctcactgtattttcagcggccctttgtcggcgaacaaaccattcctctgacgaaggtggttgatgtttatctcgcttcagatccgacaacgcagtctggcgtaccggtttcaaccgtctggatgagcggcacggtaaccgtgccgcaatcctgcgagatcaatggcgggggcgtgatcaccgttcctttcggcgacatcatgtcaggggatatcgccaccaaaggggaaatggcgaaaaactttacgccgaagaacgtcaatttcaacgtcgcctgcaccaatatttccgagggcgtgaaggtcagcctctctttccagggaacgccagatgcaaacgatccgacgctgctgtccaccaccaaccgcgacgtaggcgtcaggattcaggataccgctggcacaaccatcgtgccgctgagtggacgcttgccgctgaggatggattacgcctcgcaggtcggcacctcggggattaacttatttcccgttaacagcacaggtcaggcacctgagaccggggatttttcggcgacagcgacgattcgcgccgaaatagagtaattccgtgatgcaacgcgtaagggaaacgaaaatggttaaggaagcagcgttcagtttgagcaacaaagcaaaaacgccggcgttgatactgtggctgacggccgtcatgttggcctcgccggtgagggcgaatacccagcttaatattactggcaacatcaaagcctcgccttgtcacattgacctgccagccagcggattgaatgtggatttaggccagaacattttagcgacatccctggctgaggcgggcgcgtcaaccgactggcgacccttttcgattgtcctgagcgaatgcccggcatcgacgcgggaggcgacgatgacgctgaacggcgtggcggatgaggtcgaaagcacgatgtacgcgaatacaggcaccgcctctcaggtacaaatcgaggtgcaaagccgtgacggtgtgccgctcggcaacgccacgcaaagggtacagcgcgtggataacgccggtcgtggcaccaccttcgagatgcaggcgcgcgcctacagtgcgcagggcaatgccacgccaggaaccattgttggaaccatgcaggtcacctttacttatcagtagttgaaagggcacgaacagagagaggaaaacccacacagcacgtccatcttctggtcgagaggaggctgccgtcagggcgcgttacgaagaaaacaaggaggtaagatgaacgtcgtcactcatttaacgccagaccctgctccatcaggcatgtcgcctgccggatcaggggtactgattatggatgcctgcccggcgaccgcgctgggcataaagcagatcctggtcgggtcatgtggaataaccgatgccatcagctatgtgcaaagtctggcgggcatctcatcgcgcgtggccagcgcgccgccagcgctactgattatggatatctgcggcgaaaaagagcgcatgctggatggactgcgcctcttggggcaactgcatgaaacctgcccggccctgaagatcattatctgcacggatttcagcgactaccggatacttgagatgcttgtctcctcgaaagcgcacggcattttgttaaaacacgaaccggcactcgcgctggcgcagggtgtcacccgatgtctcgctggcgagcggcagtggctaagccccaaagtgcagcagttgctggcaaagaccaccccgaaaaataccgcgctgacagccagagagctggatgttcttgcttacctgttttccggcctgagcgtttcccgggtggcgcaggcgcttcatcgcgatatccgaaccatcagtacccataagcgcaatgccatggtgaagctgggttttcacaatgacagtgaactctttgcgcagggcacctggatggcgcaaatcggtcccgctaccggactttaagcgttacctctggatgtgtttcttaatggataaacggccggcagccccggcctgcaaggagcaaccgcctgatgaatcagacctgcacatcgccccgcaccgtggcgctaatggacagccatcctttaacgctcgctggcctctcgacgctcattgagtctgtcgatacagactgtgacatcatcattcgggaaccgagcctgggcaaaatgttcgatgccctgatgtaccagtccgtggatatccttatcaccgacttgcagagcgcggaggagacgctccaggaaggcattgatctcttactgcgcctgaacgcgcagttccccgacatgaatattgtggtgtatacctcatgccatgacagtaacggactgcggaccttactgaatcattacaatatcagcgtgatcgcacgcggggaatccctggccaatacacaggaattcttcaaacaggcgtttgaacagaagcgtgtgctcagccccaaaatctgctgtgaccttgcacgaatcaatgaaacccatcactgtacgccgtcgaaattaacgcgcagcgaacgtgatgttttaaggcacctttttaatggcatggatttgcaacagattgcgcggatgaagcagttaagtatcaagacgattagcgcccataaatgcaatgcgatgcgaaaactcgatgtcaggaccgacgcagagttgtttctacagttaaatactatgtttaatcaaggattcgatttctcatgatccaacacgcgcatttgagcagcctgtgtcagtgtgttcgtaataaggcaccgattatcgtcctttctgataattactggttgtatttcggtgtctcacaactgtacccgcattcgaaggttatccacgtcaggtttcttgatgaagcgctttatcgcaagttatggggtaatgctgattcagtcatattaattattgataacgatatctttattcagggtgagtggttatcgatgctggggatgtttgaggtctgtacgttcctgaaaatcatctggctaaaaggggataaaaccggcgcatttattcccgtcgatcatgccaaaagttttctggtcgagaagaaaaaagcccttttcgaatttgaacgtgatttgaatgacattttttgcggccaggaattacggatcgcgaaaagtccatgcacaagtttaaccaaaaaagagcgctatatgattaaatacctggccgccgaccaggatattcagaccatctctgagcgtgcctgcttatctctgaagtcagtctaccatgtccgatcaacactgatgagcaagcttggcttcgacaatgcatatttctttcagcttatccttttcaaaaatatcgacatactctttcccttttttaccaacagaacgcacgcatttcatgtccagcagcgtcagtgagccatgaggcaggttgaacctgttgagccagaaaaacagggtgcttattattccatgaggtgacaaccgcacagaatggataagcgtttttctaccaaaaagggaacgctgaatgtcaggctgtcatttagcgactgatcattttcctcatcctgtggaacatcaggtttaagataaataccagcatagataaatgtatctgattgaatgcggggctaaacgaatgtgcccttgcacaagcaaaatgttctggacaaatcaccttggattaagttgctgtttttatggattttatttgtcttaaaataatgccggtttgatatgaattataaataatcctaaaagcgggcgttaagttttaatttattattttcagtctgttattgttaacattactggggtaaatcattcttttattttgtctgttttatcatttttgcagtttaatattctggttgtcttgttttttgtggggttaagttctttaatattcatatttacaacaactccgctgattaaatattccgtttttataaaaacacacttccaaatatattcatctgtgtgatttaatctttggcccataagcttatgacaatacccgaattcggattcgctacatcacaaccgatgatgcctgtatgaatttacattgaaacaataaacggatgtaacaatttgctatgtgttttttatgcgtttatatcaccttaaataggtaggtggattgaaggaagaaggccgtaattatgttggttatattcttatctacagtttttgtttgaaatcttatggaagagtaaaaataaaaagatgaaaagaagaaaatacctgacggtgaacgaggtcgaaaggttgatctctgccgtgggcacctcaaaaaacagtgaaagaaaccaatgcatgttgctgatgtgctttatacacggactcagagtcagtgagttgtcgcaactgaaactgagagatgtggagatttccaataaaatcatctatatatcgaggttgaagaatggattttcagtccagcatcctttgcagcatcgcgaactgttagcgttagaggcctggatgcagaagcgttcaagctatttgggttcggattctgaatatctgtttttatcgcgacacggtaaaaaagtatccaggcagcagttataccgtattttcaaggtggccggtaaagccgcaaatatcaacattgatgtgcatccgcatatgttcaggcatgcctgcggctatgccctggcggataagggatgtgatacgcgactgatacaggattatttaggccacaggaatattcaaaacaccgtcatttacacggcatcgaatgctgcccgttttaaatctgtcgtgttttagcctgcgggggaatgccttttttaacgaccagaccggcgatgaggaaaaagactcacgccacctgagaggtggcgtgagttatggtcgctggcgtgttattgcactggcaaaaacctgtcggcacgatgttcctgtgtcggctggcaggggcgaggttatcgtggctggcgtcttcgcgctcctttacgcgaaagtgatggagagaacctgagtgcactggactccagcggagaacgccaaccctttccttgcctcacaacctattgcggcagacaggcggcgcgaaaaagagaatcttgagtcacgttcggccgcttgcgtcactgcgaaaagggaagtcgcttatgagactctgtgactgaggaggacggagagaaaagtttactctgcggcaataagtgtggtgctttgacagaggacgcctttaagccttcattttacgtaaccatcaggctataaacggctcagaaaccctgataatcatcgcgaaacgctgcgtgaaccatgatgcaaattgctaaggcgctcaaaacgaaatgcatatttttttatcatttgtcttaccgctggcgctcgtcattttgctgataaagtatttctttctgccgatgttcaaacgagatgatttctttgctgctaaaggtgagttaaagaaaatctccattgatacacctttgcttaaacgtcttgggatgaacatggaggattactattacgacgcagagtttctctatcaaaagcgtaaggaagacatccttaatacaatctcgctgggccaaattattcaggtcagatcgaccggaacgatgatcagcaatcgccgcgtctggcaggttcgttacctctccggggcatcccggacagaaaaaacagtcagcattctgcataattactcagtatttaatcaggatttcgccggttttctttcagccgttcgggcagccaatcctgaagcagaagttgaaaaaatgacacgcttgcgcctgtaaacgttggaggctgctattttccagtgaaaaccaaacgagccgcatgtgctgccttgggcgatattttttgtgagtattacggctgtacggagacgggagtgaatgttctgtcagatcctgccgacatgctggactgccctgcgagcgtgggacgtccttatgacggtaaccaggtaaggattcttgatagcaacaataacccgcttaatgcaggagaaaaaggcagagtggctatctccagttatatgctcatggatgagtaccatgacggaagtaaaccgtttatggtgcttgagggggagcgctactttctgatggctgattacggctatctggatgatagcggcaggctgtttcttatgaaccgtaacggtgaaatccatagtcaacatgatgtttactacattgaggaaaaaattcgcgcgctgtcatgtattagagatgtagccctgataactatccagcttgaaggtgtgaatcacatcaagtgtatttttagcactgaccagaatgataaagagaaatttatccgcctgtttgaaaaaatccatgaggaggccgtcaaaacgggagtcattaatttttcagcccactgtgttgacgacatcccttacagccccagcggaaaagttcggttcagtgaaatcatacgtattcttgatgcggcataaacaaccactatcagaatttctgataccagaataaaaactcgcgaatagttaatacatcgcgaatatgaaaatataaaaacacttcctgcctaacttattcttaatacatgatgaaggtgaataaatgaatgtttatattaaaggactgctctgctgcttcttagccacggtttcatggggcgcgatgtttcctgtcatgacacaagcgctaaccagaatcgatccgtttaatttcaccacgctccgttatggcatcgcaggtattgctttcgcgctcatgctgattttccgggaagggcgttctgctttcaggctgaagggcgaaaaatggggactggcctggctgtttggaacgttgggatttgctggatttggttttctggtgtttttgggccagcatcttgcagggccaactggcgcactgaccgcatctattatgatggcaacgatgccaatgttggggctacttactatctgggcactgaaaaaggtacgtccacaagcaagtacctttggatttatcctgctgtcctttagcggcgttgtgctggtcatcaccaacggtaatgtgtcagcagtcctggactccccaatgagcgtaacggcgaatctgttactgattggtggggcactctgctgggttttatataccatcggtggaagctattttccgggctggagtccgctgcgttataccacgctaacgacgctgctgggcatgacaagcgtcatcagcattgatgtgctgctaatggctacaggtaagattgctgtgccagataccgctgcaatgatctttgtgattccgcacctgctttacatggcactcgtcgcaggtctgatggcagttttgtgctggaacataggtaaccggattatcacccccactaacggcgtactctttatggatgttgttcccgtcaccgcctttcttgtgtcagcactgaacggcgtgttgccaacgaatatgcagattattggtgcagcaatcaccgccactgcattggtgctcaacaaccttaaccagcgcaaaatggcacggcaggccgtaaacaacaccatcatgaaaacgtctgtcgcccgccgctgaggttctttatgctcctctcccagcaagaggggagctttaaggcctcacgttgttacatgccaaatatctcttaccgtctcgatcagcgcagccaccacgggggaggtttctttttcacggtcccagacaaaacaaagctgactcaccgttttttcgccgggccagatatacaactcaccactatcctgaagcgtaagcgcaatatcctcccgcataagggtgataccgacttccataccgaccaactcagcgagcgttttttcctgatcagcgataatagcaggccttatctctatgccgtgcctttggagaaaatccctggctattgaactaaaagaacatttttcaggcgtggcaatccagggcaattctcgcagatcatcccagccagccgtctcaagttgtgttttccaggcgcgggggccaacaatacatagcgtaataggggaaaccacaatcatgcctaatcgctcttcatgcacgttgccgatgatgaaacccgcgtccagttcaccggcgagcaaactatcaatgataaggccggagatattctggcggattgtcagactgacgttttgatgccgctgacgcagttgggtcagaacctgtggcagattaaggatcactggaactgaaatcgttccgagcgcacaagtaccaatcgcattaagcgagcgggccttgttgacaaatttactggcggcctcaagcgcgaggcgggcttcatcccgcatgattaaaccgggtgcggttagcgccataccacgaggggtgcgcgtgaacagtcgaacattaaattcggtttcgagtgactttatatgggcgcttaccgcgggctggctgagaaaaagtagactggctgctcttgtaaggcttgctgtttctgcgacggtcacaaaggttctgagttggtttaaatccattacgcttcccgcctgttgtcgttagatgatgcgtcagtgtctgtgactgacttaatttacattagaaattgttactttacgttaaaataccaacggctatgcatcactttcctgatgatgaagtgatggtctgctaccctttttgttcggcaataaaatgaacaacgtgccaggattgaacctggtggtgaaaaagacttttttttgggattagtaagaaacagttgtctggtttttctgtggaaaataaatgtaatccatagcgtaaaattgccagcggaaatctgggtattgaaaatggcagggaaaaattcgttattacttatcgtctaaaaacttctcgtgaatgccattccacgaatttatctgatggataatgctgactgacctgcggcaatttaatcggtttacctgaaaagtcccagaacaggcggtcgacaatgccaccgccgtttacgcccgcggaaactacaacgcgcatattctcatccagcccaatcgatcctttatcaaaggctttatgatgaatggcgcagagtgccagcccgttaacgacttcacaggggccgccgtactgtttccatttaatatgcgcggcttctaccgccaccagcgcattatcgtggcgcatattgaagccacataccgcacactgatagtgataagcgcgcagcacctgctgccggaagtgaggatcgcgctgtttccgcatctcactgatgccaaaacccagttcatccgccagcgcttcctgaatgctttcgggaaaatgcgcttcaaggatttgctgtgccaggctatcgattagcctgctatcacttttaacccgttcataatgctcagcatcaaagccaccggcgacctgataccgtttcagttccccagccggaggttgcttacttcctgtcgatgagcagtgctctgcattaaccagctcccaaaaaccgtcaccctgtaagcgccagaagggcatatcaggacgatactgacggcgttgcgggccataacgttctaacagtgcatgaagcacaggctgaacttcagatgcgtagtcaaaaaaccggccatggccatggcgatattgagacagcgcatagagcacgagtagtggtttatggggcgcgcgttgttcgcctttacgccagacggtgatttgagaaagtaatttttgcaggtttttggctgatgtcatgacgcagtttgatagggaaataattgcgataatgctcgcaaattatcgcttgatcaatcgattagcgacggggaaatacagggaaagaaggcgatgctaaatagcgaaacgaaaaccggctcccagaatcctcttccacccacatcaacaggttatgacagatgaggctgtgcgaagccgaataaaagccccttaacagggcttcgtttacccagcgaaatcaaaaaaaccaccgccgccgacgtataaacccccgcacagatcagatcacaacgccgtgcccgactgaggtttttcgctgcggtttgcgaggccaaaatcagcgcatgcaggctacatatcatcacgccggtcagtgcgcaggctgccatcagaacattgcactgtcactgcgctgcgggtcagtccattcagggcagggagccgttaccgctgaccatgccgtcagcgggttgcagaataacggtgatcactgtcgagtgtgaatacgtctgtaatcggcagtgtttttacattcagacgttgaatgtctctacggcgagacgcagcgtctgagcctgttcagaaagcgactgtgaggcggctgaagactcttcaaccaacgcagagttgttctgcgttacaccatccatctggcttaccgccacgctcacctgagagatcccctgcatctgctgattaaggtgtgctattttatgccgtgagtctctcattccatgcatcagtaaactgaatattgccatcaacaatccgccgggtaattttttcatactgcaaactgatactttcaacgtggttcattttatcattacccgctaagcggacattaggcacgccgcagttgacgccagtcacttttacattttccataaggactgtgtaataacaaacttcttgtcctgcatcgtttatgtgatagaacttaatttctgcactttttaacgtttgaccagtagccgcagccttataaaagtaaggtgtagaactatcaacatctttttcaatcatcatggatgaatgctgacgcgtaccagtaattttcccgttagtgctatcgacagggaggttaacgccatgacccagtccgatgatctctatgctcccttcccgatcctgaacgtcaaccgatcctttaatatctgcgccgccgtcgtctttaagccacatatagggaggaattggcatactattttctccttgtttttctgattaacatcattgttattaaataaaaagcaatactgatcgttacgacagtgaaaaagtctatgtagaaatatgcatcgtagattgattctgcattaacatcacccgttaaaaatagggctaactgactgacaaattcatggtctgcatagttctcgggatgaccgagtgagcgagcaacagcgaacgttataatcaaaaaaaagaggattttaaccgcgttacgggcaagcgctgtaaccattcgttaccacctcaatccagccacgagccatgagatcccgcatgcaaggcacctgaacaggatctgttttgaggagtgcatctcttatgcgcgagtagtccgaattatgtggaatggttaaacatccctctgagacttgccccggatgcagtctgaataatccgcggtaaacgccttctgtccatgttccgtcatcaatactcaggtcatctttgtacaaagcaaaccactcgtcgcgtccaaaggccgtcccatggtaaaatttattccatgcatcctgaatttgcgtctttgttttagaaaatacgccaccagagccacgttctacaatccagtatttacccagtggtaacggaccattacttttaatggctccacatgcaccgtgattacggtagataccattgcctgaaaaggccatgaaaacacccaccccatataaattaaaaggcgcataatctgcaccatcaagcgtcaactttccctgtaatgccatgatataccattccctgatgaggtttgtggcttatcatataaatgaaaaattaagtcatcaactttagccttacgattttgaatttatattcaattaatgtgctgtgcatttgatttttcgatttgctttgttaaggactgtctttactgatgagttttatgtgatttttattttaaatggattgattttgtgtttcttggttttcattagtgaatagtgtgagttgtatatcaggtcagtggtttaaaaaaattgtttcagtaactcatataatgagaagtgaaaactattttttcagtaacaagaatgtaaattgaaattcactggccttctataaagggcggcctaataagccaacggcgatcttcttatacaataaaccggtgatggatgaaggatagcgcggattacgtctccgcgaatataacgaaggcctctgaatgacgttaccccagcgaaaccgaaaaccaccgccgccgacgcataaaccccccgtacagatcagatcacaacgccgtgaccgattgaggtttttctctgcggtttacgaagccaaaatcagcgcgtacaggctacatatcatcacgccggtcagtgcacaggttgccaccacaacatcgctctgtcactgcgctgcgggtcagcccattcagggcagggagctgttaccgctgaccatgccgtcagcgggttgcagaataacggtgatcactgccgaccgcgaatacgtctgtaatcggcagtgtttttacattcagactttgaatgtctctacggcgagacgcagcgtctgagcctgttcagaaagcgactgtgaggcggctgaagactcttcaaccaacgcagagttgttctgcgttacaccatccatctggctgaccgccacgctcacctgagagatcccctgcatctgctcagcggacgacagggcgatggtatccattgatgtggccagctcgtcaaccagatcgatcactttaagaatattttggcctgtttcattcgccaccgtgacgccagattccacctgactcactgcctgctcaatgagtgatttaatgtcttttgccgccgtagcacttcgctgtgccaacgtcctgacttccgctgccaccacggcaaatccacgtccgctttcacccgcgcgtgccgcttctactgccgcgttaagcgccagaatattcgtctggaatgcaatactttcgatgacagaggtaatgtctctgaccttagacgcgctttgtgaaatttcgcccatggtgcctgacatacggcggacatcattttcaccattttttacgtgtaaagccgtatccctcgcggcgttggccgtctgtctggccatggcgctgttactctgcacggtggctgtcagctgttccatacttgccgctgtctgctggagtgcagcggcctgctcttcagtgcgggaagccagttcgttgttaccctgtgagatttcgtttgctgaaagcgcaacggaagcagagccagacttaatgtcggatacgaccccgcggagccgcgactgcatactggacaaagaggccatcaggctccgggtgtcatttttgcgtagctgtaccgctgaggtcaaatccccctgagaaatcgcataggcaaggcgctgtgcagtcacaggctcaccacccagttcactcatcagcttacgaatcaaatagatgcccgtggacaggccaaaaatgaccgcgacagctaacagtaccagtaagatgacgtaagcctgttccgtcgttttacggttggcactgacggcgtcatcagatcgctgcgtgagcacctgccccatggccgtcagtccgtcaatcaggggattctgcgcgggtctgacggtatccagaagaaacttcactgttgcggcgttatttttccccagcgccagtggaaccgtattactgaatgattccagtgcatctttttcactgctttttatcgcttcaaacgcttttatttcttcattgttgcccgactggtcaatcatctgccccagttgagtgctgctgtcgacaaagcgggtctttaattttccgagccgcgcagattgctccgcgatgcctttttcatcggtaaataacgacagattccttactgtaatggccatgtcgcgctggataagcgtcaggtctgtgatcagttttgtttttttcatatctccctgaacgattgattcaagggcatttttggactgatacaaagaatgaatggcaacgactatgcacagggaaaagaagacgattaacgtaccaaaacccgagccgagccgtgttgagattttcataaatctttcctgaagaagggtgggggagacgacgatctttcggcgcagactcggcaatctttatcccggccgtgataattaaaatgtaagcaatcacgacataaacttttacaggaaaaacccctctcgcgggtctgttaatatttcttatttataggtttatttatggctcggcccgcggcagaaaacggcagattgcgagtggaaaccgcgtcgcgccagcatcttgctgagcatccggtggggacaggcccacgcattgggttaatgcatcagcgtcagacgccggcggatatcatcccgcgcttccttatcggactctcacgccgccagcgcttctcttggatgagaaaaaagaggcacgccccgcagcgcacctccacgtcatatcacgccacaacactacggcgatacggctaatcctgcatccgacgttccggcatcctttggcgctttgatcaagatccacagcgccgccgcgccaatcaaatcaaacaccgccagcgcaatgaagaacgggccaaagccaattatgctgacgaacgcgccgataaacaggttaaagatcaactgacccgaccaggcacaggcacctgccatccccacggcggtcgccacctcatcctttctgaacagatccgcacccagcgtggcggccacggtggagagcaactgatgcgagaaccccccaatgctgatcagcaacacggcgatataggggttgtcaacaatgctgaccaggccgatggtggtcatcagcaccgccccgagagtaaaggtaatgcggcgagaattaatcaggccaatgccacggtcgttcagaaacttcgccacgaacccgctggcaaggcaacccagatcggccatcaggaagggcagccagacgaacatagcaatctccttcaggctgaagtgcagggtttccacaaagaaaatcggtacccagaagttaatggttccccatgccggatcggccagaaaccgcgagatgccaatgccccagaaattacgctgtttcagtatgcgtaatgcagaggtcttttctttcttcccggtgtgaaggtgtttttcctgaccgctttcaatgtaggcgcgctcttccgccgacagccgtttggcctctttaggatcgtgataaaagataaaccagacaaaggccgctacgatagccaggccgccggcaacgacaaatgcaaactgccagctgtggaacataatgcaccaggcaatcagcggcggagccagcatcgccccaaaggaggtgcccatgttaaataccccggtagcaatgcctcgctccctggccggaaaccaggtggccgcggttttcaccccggccggaatcgccgaggcttcactaaagcccataatggcgcgcatacacgccagcccctgccaggaaccgatcagagagtgggctaaggtggccagcccccagacgatggcgcagagaaagaagcccagcttcaggccgatagtatcaattaaccatcccatcaccggctgaccgatggtataagccagctgaaaggcgctcaccacccaggaatactgctccttggtcatgtccagttctttcatcatcgtcggcgcggccacgcccaacgccgtgcggtcgaggtaattaatgatcgtaataaagcacaccagtaatatcatgtgccatctgtaatagcggattgttttcatgattgttcctttattgttaccttttcctcatgctttcgctaaacaggtaacatgattgcttaaattagatgtaggttaattaatagagtgttagttaatctcatgattgcatcttgttattattgggtaagcgattttgcaataaacgcataatcgagtggtgtgattacgcgcattgtttaatatcgtgaaaataactttcggtaaataatgtgatcggcgtaaccgacatggctaaagcgactaaatggcgagatgcgggtttggcatcatggtaacgctaagctgttccagccataacgtcatgacgaaagccttttactggcgggcagaagggaaggtcccttacaggttgatgggctgtttaggttttttatttcgccgggttttaggcgttacgttaattatcacgatgggttttaagtctgatggttaataaagccgtctgtagttgttaacgcgaataaggccggggcgttatatacacattcaaatgctattctcttttggtaacttaacctgccagcgcaggtgtttttatgctttacagaaaataaaaattaagggcgacgttcagcgttggtgaacataataacctgcaggaaggcgcttcaacgttataagaggaatcttaaaaggtagtcgtttgatgttgaacagggtttcagtattattttcagcttgtgccacctctaaaggaagtgagatgcaaatctgtacgatggactacgatcgtctctcgccagacggaaaaagggttaagcttgactgctatggcatcggttcatttgatgttttgtcaggcatcgaccgctatatcaataaccctgactgttcagatatcgaaaaggccgcgatcccgccgggcacatactggatagtcgatcgtccgaaagggagcgtgctaaaccaactgcgtgcagaagtgattgatgcttatcatttgtacaaaaatcatcattccgaatggtttggtttatacaacgcagaaaccatgagtgatcatgtttacgtcaatggcacacggcggggcagctttcgtctccatcctttgaacagcgacggcaccggtgtttcatggggctgcgtaacgctgtacagctcatcggagtttcaaaccctcagaaatgcgttgctgcggatacccaagataaaagtgccgggcgggaaagacctgatggcttatggccgccttgatgtgcgcggcattccagattttagtcagtgtggtgtgagatgaaaattgcggtattcattattgtgttgctggcggcttttgtgctgatcccggatagctggatcaacacgttatttatgagccatatcaccatcgaaggcgatggcgaagaggcgatgaacagttattcgtttacgttcatcgtggttaagttcgtactgtcgctcgtgctggctgtcctggcctcgtggggataccgaaagctaaaacgttagcccgccgcacatgcctggcgggacgcacttaccgcggccaggcgtttcctgaacaggatgatctctattcaacgcgcgtttgcgggtatttcccgccgttaccgcccgaagacagtttgtcgcgaatcacacctgccgcttttcagccctcacactgcccgtcttgataatgccgtagcggctgactcgttgacttccgtttgcttccgttttccccgggtgctgagatctgcatcactttcatgccgcgtgcgctcccttacgcttaacggccaggctggaggggcggaaatgtttctggaagaacgacgcaatcagattttgcaatggctggacgaatatgaacgcgtcaccgttaacgggctggcgagtcagcggcgtgtcacgcggaaaaccaggcgcagacagggcaaggtctgcattccgggcgcatgtcatgtggatagcgtcgccaggatggcgcgatttcctaaacgtggtgaatcgccgatggcgcacagcagcacctctgggccaggcggcaagggtgccaggcaggcgatggccgccagccgcgccggatcgcgcgttcatttggttgccaaagtcggcaccgaaggggtcagccagttcgcgtttgatcacctttcgtcatcagacattcactctttccgtttataccagaccgataccgaacccacgggcagcgccatcctcgatgtctcgcaggaaaacggtgagagcatgattgctgcctgttccggggccagtaaaaccctgacggatgccgggattgccgggctaacccacgcattcaccgaggcggatgtcctgctgctcccgcttttccggcgctcagtgtggacaccaccggcgcaggtgatgcctttaacggcgcgcaggccgacacatgggcatcggcctttgcgtcccaggccgtcgcgcgggaaggcgcaagcactatgcccaaacggcatcaggcggtcatccgacttaatcaacgataacccgacgtaacgcaaccgccgcgcgctggcgctggcaggagaaaccatgaaaaagattgaaggtattgtcccggtcatgctgaccccgttcaccccggatgatcagatcgattatcccggcctgtcacgcctgatcgactggtatctggcgcagggcgtggacgcgctgtttgcggtgtgtcagtcgagtgaaatgcagtttctcagcctggaggagcgcgttgcgctggcgcgttttgtggtggagaaagtgcagggccgcgtgccggtgattgcctccggccacatcagcgatggattaactgaacagactcaggagctgcaggcgatggccggaacgggcattgatgccctggtgctggtcaccaatcaccttgatccgcagaatcagggaagtgagacgttttatgctcacctcaatcatctcctcgcggcgctaccgaccgatcttccgttagggctctacgagtgcccggcaccgtatcgtcgcctgctcagcgatgaagagttcagcttctgcgccaacagcaatcgctttgtggtgctgaaagacgtgagctgcgatctgcccacggtacagcgtcgcgtcaggctggccgaaggcacgccattggcggtaatcaacgccaatgcggccattgcgtggcccgctatccaggccggttcgcgcggtttcagcggcgtgttcactaactttcatccaaacctgtatgtctggctttatcaccagggcgcacagcagcctgaaaaagcccatgagctgtcgctgttcctgtcgctgagcgccgtcaccgaaaccctgggctatcccaaaaacgccaaaatttatcaccagcgcctgggcacctttaccagcgagcactgccgcgtcaaccgggacaacgtgctggagaaatgctggggactgagcgtattgcttgaccagattcgcgaaggcagtgcgctgtggcagtcacgcctttgataaaaatcgctttacgctgcttatgcatcggtttactacaggggaaaacaccatgattgtatgcgatcaacttgactgggcgcgtgagcgccatgcgtttcatcccatcgttgaccaggcgattcgctggattgcgaccagcgatttcagccagatggaaacgggaaaatacgatttgctgcctgacaaccaaatgttctgcctgctgcaggaaatggagaccgagcctgccagcgcccgccgggccgaatcccattttcgctatgtcgatatccagtacctgctggccggacgtgaaacgatcggcgtgacgcgtgcccagccgcagcatgtgatagcggaagaccgtcggattgaaaacgatgtcgtgttttatcaggacatcacggatgaatacagcatcgcgctgacgccagggcagtttgcgctgttctttccccacgatattcatcgccctggctgcgcgtctccgctggcccagcctgtccgcaaggcggtgattaaaattcatctcgatctgtttgccgtgcaggcgttgccatgaagccttctgcaccgatgtcagagacgacggtaagcgagcagggcacgctgaaagggcgactgcgctggggcatcgttacgctgttactgctggcggcgatagtgaattacctggaccgcgccaacctcagcattgccaacaccaccattgcggcggaatttggcttttcccagaccgaaatgggcttactgttgtcggcgtttctctggccctatgcactggcgaacctgcctgcgggctggctggtggacaaactcggccccaaaaagatgttctcctgggcgctggggctgtggtcgggttttaccgtgctgacggcgtttgccaacagctacagctatttctatggtctgcgtatgctgctgggcgtgtctgaatccccgttctttacctcggggataaaaatcacccaccgctggtttggtgacagtgaacgcgggttgcccaccgcgattatcaataccggttcgcaaattgccaacgccattgcgccgcccatcctcaccgtgctgttactgacgttgggctggcgcggcatgttcgttgcgatcggtgtgatggggcttcccctgctgctggcgtggtggaaattctatcgcgatcccaatgcccgtgaggatgcgctgctgcatgccggacaatacagcgcggccacaccgcaagagaaaaccgcggttcgctggcgatcgctgttccgacacagcaccacctggtttatggtgatcggcaatttctctattatgttcacgatttgggtttatctgacctggctgccgggctatctggaaaaatcgctgggcttcagcctgaaagccacgggctggattgcctctattccgtttctggccggtattctgggcgtgctggttggcggcatgctctcggacaatctggtgcgtcggggcgtcaaagccatcaccgcgcgcaaagtccctgtcgtctcaggggctgctctggccgcctgcttcgtggcaccgattccgttcgtcgacagcacgccgctggcaattagcttgctgtccctgggctattttttctcgcaaatgccgcagggcgcgctctggacgctggccagcgatattgcaccgaagtcacaggttgcctcgctgggggcgattcagaactttggcggcttcctgggggcggcgatggcgcccatcgtgaccggcattattctggataccacggggaaattcaccaatgtgtttctgctcggtgccgcgctgctgatgctgggcgcgctgagctatggcctgtttgtgcgtaagccgctgcaggcaagctaacaagcccaaccctggcggcgagccagggttgcaccaggtggcagcccacgctgacggttatcgctgacagggtttaccttctgttaacgagggctgacgtgagatgtaccagtacgaaaccgtttaacgcggtaatcggcagagcagggggccgatcacgccggttcaggatgatcggcgcatcgattgcccttaaagaaaatgattcatccagacgggggcgttttctccgtctgtcatcgtcttttctattcgggttaacctctttgcccggcgcgtaattatcgttttttctcttccagacaataaatcggtttaattaaattctgttgaactaaaagagaaaatataacaacattgcggccgtttatcatggcatcaggcggtgcactgcaggtgggcggcctgagtctggcggtgtgcacgccgacgccgtttgcgttgacggttgcagcgatacaaatacaggggaactgagcggtcgctttggcaaagacggcgagcagtgatcacgcccgactcaacgccaggtcatctggcagggttttgacttaacgagaggggcagggcctgtgaaaaataagccgcgttgctttaagcagaagcaaggcgtcaaagggcatattcatcctgaatcaatatcgccagcctgttaataatggcgtcgagcgtcccatccgatgcggatgtatggagcaatccctcaatatagcgatcgccgcgagtataaacggtcaccagactcaggcactcagcgacagacgcgtgcgaaatcctttctttttctctcagcgacatattgtgggttatccactggttccagccaaaacccgtcagcataagttgatttttttcggcggatagcggcatgttgttttcaatatcgtcctggcagtcagcgatgaagcgttttagtacggtattgtcttgtctgataatcaggagattagcccgttgcacgatgtcatcgtgccaggccagccgtgaaagccaggattttggcagggcatggtaaccgtaatacgcacccgcaagctgaccataaatagcggcgacactgtccgcgtcatcgccaagatttgccgccagtaatgccccttcctcaaatgtctcgctgtgccagaaacaccagagagcggcttccagtgagtgaatcacatagccagaactgctgatttcatcacgcgatttaagacggtagcgaccttgaataatggctaaggagtccggatgcagtgtttttatccatgcgtactgcgcagaatgaaacgcgttgaatagccttgctttggtcggcgtgttatcgctgttgagcagcatgtggatcaggcccgtgatgtactggcaggcctcaatacatcgctgttctgcatgagtggtggcgctggccagtttcgtcgcttcaaagaccgcagtgagaggggcgtgatgcatgaataatgccacaggcgcggtgcgcatcaggctgccgttgcccgcacttctgggggcggtgctgcccgccagcgcaatgccttcagcgctgaatgtttttaacgcgagggcgacggtcgtgccaatatcgaaacaggttccggtgcaggagttataaccataatcgcgccagttgatatagcgtcgcatttgatcggcaggtacattttcgccccgttcgatcaggctgtcagccagacacagcatcatggacgtgtcatccgtccattgaccgggttcaagcataaaggggccaccgccaaccaggtcggttaccaccggttttgccggtctgggctgaaattcaagggtggtacctaacgcatcgcccagcgccaacccaactaatgcgcctttagcccgattgattttatcagcattcatccatttgtcctgatttacctcagcgccagccagccagggcggcacgcttctcggcttttcaaacacgatttgacacattaacgcgagttgaaagcgatgtcgatcaaaggctattggcgggcaggggggaggaaagcaggacgggaaagacaggcgtggatttcattgccacgccgaagcctgacctttagcggggcggcccaccggcaaccccaactgaaccgctagtgactttgcttactgtcttcttctttatgctttttcgccaggtaatgccccgccgcgcagcccgccatggcaccggcaaccgcatgatgtttaagatggcccgccacgccgcccaccagcgcgcctttcaggcagccttcggcctgtgcctgagaggcgaccgacatcaaaaggcccagtgtgaccagcagaaagggaagtttacgcatcgatactcagtccttataaaggggaaggtgttaatgctgcgacgataaccctaatgcgaggctggcgggtgagaaaatgcgagtcgttgcacgatggttgcagaaaaaagggcgggttttgcatgccagagcgtggcggaattttttgaaccgcatcacaccctgcattttttgcgaatccattttctctcttccggggacagaaagatgtaataactacctcgccatacacaaaacggaacccacgatgaaaaaaaacttagcctgttttgcattcctggcaggaagcctgctgacgggatatgtccctgtactgattgccgcacctttaccgcaaaccccggatacaagtatcccggtgagccgctacgttacggcgctcaatcctgatcactccattaccttccgtctctttgcgcctgccgcgaagcaggttgccgtggtgaccggcgccacgccgctgagccagcaatcgcatgacatgaaaaaggacagtgccggcatctggtcgtggaccagcgcgccgatgaagcccaacctgtatgaatactatttcgacgtagacggtttccgcacgccggataccggcagccgtttccctaaaccgcagcgccaggtgaacaccagtatgattctggtgccgggcagtattctggatgagcgcaacgtgccgcacggcgatgtgctgaccctgacctatcattccaccgccctgaagtcggaacgtcaggtgtttgtctgggcgccgccgggttacaaggccgatgataaaccgctgccggtgctctacttctatcacggttttggcgataccgggctgtccgccatttcgcaactgcgcctgccgcagatcatggacaacctgctggcagagggcaaaatcaagccgatgctggtggtggtgcccgataccgaaaccgacatcgtgcaggctattcctgaaaacttcccacctgcggatcgtcgcaaagacttttatcccctcaatgccgccgctgcggataaagagttaatgcaggacattatcccgctggtggaaaaacgctttaccgtgagtcgtaaaccggatgaccgggcgattgccgggctgtcccagggcggctatcaggcgctggtgtcaggcatgacgcacctgagcgactttggctggctggccagttttagcggcgtgaccaccagtaccgtgcctaatgaggtcgtgacgcgccaactgagccagccgcagaccgtgaataagcagctgaaaaactttacgctggtggtgggcgataaagatatcgtgacaggcaaagacattgccggactcaaaaccgagctggaaaagcagggcgtaaccttccattacacccagtatccgggcttagggcatgagatggacgtctggcgaccggcatatgtggagtttgtgcagcagctgtttaaaccccagtcgcactaatcccggcttcaacgcggaccgcgcacaggatgagcaggacatcctgtgcgcattctccccaacgcggcgggaacgctgcggtttcgttggcggcggatggcatcatgtcagccacgcggtaagcgcttacgcatcacccgctgcccaaacgcatcactgccttctgcgacccaaccatttgcctgataaaacccttccgcgttcgagccgggatcggtggtcagtacgatggcctccgcgccctgatcgataaaccactgtgtgatagcgttcagcagttgtgtcccgatgccctgtttttgatattcaggtttaacaaacagcccgccaataagcggttcgggcgcattgatccctaacccgtaaccggcatactcaccgtccacctggcaaatccagccgccgccctgacgaatatcgtcgagcgcttgttcacgctgtaaatagtggatttgatgcgcgtgcaggcgattttccgttacggaaaagcgtatttcatatatttctttaagatgatgaggttcaagtttagaaaatgagaggcgcatggcagctctgaatgaaaatgacgatggcaggtggtcaaacagtatcgcctgaataacggcgtttcaaggcgtaaaacgtcatggggtgccgcttttctacaaataccgtttttaatcttgttttgtcatttcgctggcatcctggcatcctggcgtcatcggcctgccagtttcatctgttttacgctggacttaatgcggcgatgaccggcggcctgagccgtattccccctttcccttgtacgctgaaaggaattaataaaggtatcctggctgagcctgcataacctgaccacaatacgatccagacgtaactggagtttttcagttttcgagtcttcattaaataacaagggtttaacgatcgatttttaaagtttgataggtttaatcatagaccaatccgttaaaattcatttgattgatagctggcgacgatcaataatcgatctactttaatgccgttaatcagagcatgggaatggaaatccagaatcttgataataacaaccgtgcctggcggttcattgctgagcctattgtaaacctgaaatctgaacgtattgccgttgaagtcttaacccgatttgccgcaccagggacgccttttttccatataaataacatgcataaagaacagaaaataagtctcttaagagaccagttgttcttgattgataaaaaaagacatttctttgaaagtcaccagttgctgtgttctgtcaatgtcgatgtagagatggcttttgcgctgctggaagaacgggatatttacgaactcgccacagcgcattcttttctgcgcattgaagtatcagaagacttccccaatctggcggaggggctgaataatcccttactgcgaaagttatataatcattacaccttatggctggatgattttggcagtgcctcttcccattttccctgtttgcaaaagggattatatgaggccgttaaaatcgataagttttttttctggaagcaccataacagcccgctctggaaagataccctgatgcaaattaaagactattgtcagtttattattgtagaaggcgttgaacaggaaacttactttcagtttgctaaaccctatgccgcggcattccagggctacctgtttgacgccatcaattttgaggcattgggctgaacatcgcgtttagccgctaaccagaaatggtcgtttcagccacacccggcgcaatcccacgcttcactacccgggccgcccgcacgctgatagcctctcttgatgcatcccggccctgccaaagcagggtgacgttccctctctgtcctcacccctttttaccgccttttcataccgctttcctgccccccgctttgctgacgcaatattgcagccgccaaccggaggccaacaggctattccattaacgtgttcagctaaataaaagggaagggcgggtaaaaacagaaaggataaattcgagcgaaccttaccgaatgatcctctttttttattacgggtttaattaattaaaacgaagtttatgcgagaagtctcgcagcgatttgtttaattacacaggaagtatgataattattgcgcactattatgtttttttgcatatagcctgatgaatgtctgtgtggataatggctgaatatcaagacattcaaaggatgctcatgcaatggacaataaaaatatcgtttttcttgattacgctacctttcccgggagtgtgaagttaaaaacgattcatggcgcgcataatttaatcttgcacgcaagaacctcaccggagcaatgcgctgaacgcattgcaaaggcggatgtggtcattactaataaagtcaagttaacgtcagagctgatcgctcaggcaccggatcttaaatttattgcggtggctgccacaggttttgatgcaattgatatcgacgcctgcaaagccagaaatatccccgtcgcgaatattcgggattatgcggtggataccgtacctgagcacacctttgccttgctgttcgccctgcgccgcagcattacggcctatcatcaggccgtgcagaaaggacgctggcagcaggcaggccagttctgttttttcgactacagcattaaaaatctggccggttcgactctgggcattattggcgatggcgtactcggtaagcgagtgggcgaaatagcgaaaagtctgggaatgaaggtgctttttgctgcgtataaaggggtcagtaatatggggccgctttataccgattttgacgaagtgttgaaaaccagcgacatcttatcacttcattgtccgttattaccctcaacggaaaatatgattaccgaaaatgagtttgcactcatgaagcctgaggtcctgcttattaatacggcacgcggtggcatcgtcaatgaagaggatttatatcgtgcattaatgacgcggcgtattgccggggccgcttttgatgtggcaaaacatgagccgccagacaatgacgcgccgatcatgaaactcacgcaactcccgaactttatcttaacgccacatatttcatgggccagccaggaagcgattcaatcattagccgacaaactcatcgacaatattaatgcctggctgagtggcaaaccaataaatatcgttaacccgtagtacataaaacaccaggagaataattatgtttttgggaaaagaaatccgcttaaaacgactgctaaataaaaaatcaggacgtctgctggccatcaccatggaccatcctattacacgcggcgttttacctggcattggcccgataaacgaggtcatgggcaaggttgtcgccggtaaacccgatgccattacgatgcacaaaggcatcattgaaaaatcctttgcgccttatgccgattccgatgtctccatcatcatgaaagccaccagttactccattccttatcacgaggcgtttgatacgcccgttgcggatgtagacgaagcgattcgctttggggcagacgccatctcggtgggttgcattctgggtgggccggaacaggccaggcaactgacctttctggggcagatcaccaaagcagcaggctcggcagggctgccggttgtcgcacacatctatcccaaagggccgatggtagataaccccttcgatgccaaaaatctggcctactgcgtccgcgccggtgctgaactgggggtggatatcattaaaaccctgtggtccggttctgctgacacctttaaagaggtcgtggcgtgctgtccggcaatggtggcgttggccggtggggacatgggtaaagatctggtgagctttttgaccaacacccggaaagcactggatatcggcgtgggcggggtcacctatggccgctttgtctggcagcacgacaaccccaccgccgttgtccgcgcactggacgccatgattaatgacgattgcagcgtagacgaggcgatcgcggtttacaaacaagccggcggcaactaagtccgcgacagcataaatgaggaaatcagtatgaaagcagcagtgctatttgaggccaacaaacttgaagtgattcacgttgatgcacctaaagcggcgcaaggtgagttggtcatgcgtgttaaatcagcggctatctgtggtacagacagccgcatcataaccggcagaaaaacaaaaggggtacgttttccttcggttatcggtcatgagtttgccggtgaagtggttgatgtcgggcaggatgtcactcactttgcgctctcggatcgcattgctgttgatcctgttattccttgccgttcctgtctgtattgtcgcagtggaaaagaaaacgtctgtcagcaccgtcaggctataggttacgagtttgatggggctttcgctgagtacgtcaaaataccggccattgcccttgaggccggcaatgttttcaaactacccgacaccgtctcttatgatgccgccgcgctggcagagcctttagcctgctgtattaacgggcagaaaaacgtgggtatccatctgggggatgtggtggtcattatgggcgcaggcccaatagggctgatgcacgtcgcgctggcgaagctgtcaggcgcatcgaaaatcatcgtcagcgatctcaatgaaaaaagacgtcaggtcgccctgaaatgcggggccacccaggccgttgacgccagtcagcaggacctgaaggccattgtactgtctgagacggccgggctgggagcagatgtggtgatcatggctatcggcattcccgcgctggttaatccgtcgctggcattactgagaaaaggcggtcgagccaatctgtttgccggtttctcaaaagatgatacggccgatattgatgtcaatctgatccactacaacgaactggtgattaccggtgccagtgcgctcagccgcgaaggttatgaaaaggcccttgcgcttatttcatcggggcaaataaacgtcgaagccttaattacgcaccgttttagcttatcggagataaacgaagcgctccgccatgcgcaaaatggcgatgcggtgaagatcattattcataacgattaacgtcagccaatggaggtcatagcgatggaaaaagcctttcttggtattgatgcgggaagcagtggcgttaaagtttgcgcttttaattttcacggagagttgctggctaaggccgcacgtgatgtcaccattatatcgaaaaccgccttaagccatgaaatagccgttgaggaatacgggttacaggttgaagacgcgattagagaggtaacggcgcaagtaaagcatattgtctcgattggcttctccgtcgcttgtccaacactggtcttgctggataaacaaggtaagcccgtatgtaacgcgatcacttatctggatgggcgttcagaggcgtttattaaccaaacgctgggagacaagaaagagtatgtccgttcattaacgcataacagccccggaccttctgcctgttgggtggggacgctgggctggttgcagaaagagcagccggagttaatgaaaaaagtccacaatgtcgtgctgttaaacggctatcttgcgctgcaactcggtgcgaagaaaacgggtatcgatcccacgcaggcggcctattctggcgcggtggtgttgtcttctgcaccaaaatggtcgagcgatcttctcaggttttggaagtttgaccataacatcctgccgccaatttaccagtgcacgtcggttgtggggcatatcactgcagccgtcagtcacagaaccggcttaatggaaggcgtgcctgttattcttggttctgctgacaccgcggcggcggccttttctgtagggcttatcgatggtgggacggcctttgagtcgaccggcacctcgggcgtcatcacgttttgccttgaaacgccgaacttcgacagccgtttcatgaatcgttaccacgttgtgcctaatcagtggctggcccatggcgcaatgtccaccaccggcggcacctttggctggctcaatcaggccttgtggccagaaatgcaggatatcggcgaactggaaaaactggccgcgatgtctgcgcctggcgctaacgggttgatttatcttccttacctggcgggcgagcgcagccctttatgggacacgcgggcttctggcgcctgggtggggttaagactgtcgcacaaacgaaacgatttaatccgcgcagcaatggagggaaccgcttatggcatgaaacagatcctggaaatcgcttatgaaaagtggggcgtcaggcttgatgaaattttaagtgtagggggcggttctcgtaatgcgttatggacgcagataaaggcagatatcctccatattgaatataaccttgcccaaaccagtgatgcagcagcatttggtgcggcaatgacaggcgcaaccggggccggctttttttgcggtattaacgatcccgacttgccgatattaaaaacggaagaagccagttttaaacccagtaatgataaaaaactgatcgacctttatcacaaccattaccgtatttacgattcactttacccgatacttaaatcaaccatgcattcattagcgagcaataaaaacacactgtaatttttttaaaataataaccaaacaggaatcgttatttataacgtctctttattttttcttttgcaaaagggaaaattatgaaaacctcttctctgtcacaggtaaaacccgccacgaattttcgctgggtggtgctggcattaatctttgctgtttatgccgtgaattatgcagatcgttcaaatataggttcggtattaccctttattactgaagaatttaatatgaccaatttcgaagcaggtcaaattgcgagtatgttcttcctgggttatgccatttgccagattccagccggtttcctgctggctaaacgcggtgtgcgtgggattgtcacgctttccatcctcggtttctcggcctttacctggttaatcggtacagcgtcttcggcgctttccatcaaatggttacggctcggcctgggggttaccgaagctccaacgccggtcgggttaacatcaaccattaacaactggtttccaccaaaagaaaaggcgactgcaacagggatctacatcgcttccaccatgtttgcgcctatccttgtaccgcctttagtggtgtggatctctttaacctttggctggcgttgggtgtttttcctgtttgccattcccgggctattactggccgtcatatggtatttcctggtcaaatccagaccggaagagagtaaatttgtttctcccagtgagctgaaatatatccgtgcgtctgaaacagagtccggtgatgaggtcactattgagaatattgtgcaacatagccggtttgcaacactggataaaatcatcagggtaagggaaattaagccgcttgattctgccgccaggattttccgttcgcgcaatgtctggggaaacaccatcgcctattttatgatggtcagtatcatgtacggcattttgacctggattccctcttatctggtgaatgagaaaggcttctcatttgtcaaaatgggcttcgtcgcggccatgccgttcatcggcggatttattggctctatttttggtggctggatctctgacaacatttttggccgacgtcgtaagcccacgatgattttcactgcactggcgaccattcttatgatggtggtgatgattcacgtgccgcagagtaccgctatggtcgcgggagccttgtttatggtggggctgttactcaacattggctggccttcatttaccgcttatccaatgggcgttgtagaccggaaaaactatcctatcgccatttcactggtgaacagcggcggtaatctgggcggctttgtatcacctatggcagcgggttatttactggataaaaccgggcaatttagttcagtgtttacgtatttcggtatctgcgcggtgattggtctggtgttgctgctgattattgatgagccgaagtaagactcacagcctgataatgaaaggcacagtaacgtctttgcccgtcagcaaagcagaacataacgttgtgtcagtctctggcgcgctgacccgtttaccgaatagccggtgtgcggtatgacaaggtggtgatgatggcgccgacggtgtacggacgctggcaaaccgcttaattcagaaaggcagcatcgggcaccgatcggacacgcgctggtcggtgcgcttttcattttgccattgataaaaagcagcgcggagattttaccctgtggcgtatctgcgccggtggtgcccgggcagggaaagcgtctgtgctgccacgtatcgccctcatttaatgcctacaagaacagcccctcttgtgatttacggcaatcgcgcgggctgcaaccgaaccagcggcggaaggcgcgcgaaaaggcgctcacttcagagtaacccagcagcagcgccatctcggaaacagaaagatgatgctgtttcagataatgggtagccatctctttgcgaacgctgtcgaccagtgctgaaaagcaggtgcgctcatcgcgcaagcgccgctgcaacgaccaggcggataagccctgtttttcagcaatgatttctaacgacggctctccgttcagtaactgaaggtggatgtcggttcgggtctgattcacggtatcctgacgaacgacgggcgggctaagccggcggatggcatcctgcatgaccagtagcagcataggatcatgatccggcatttttcggttcagatccgccttcgcgatgatcatcgagttaaagggttgatcgaagtaaaccggtgcatcaaacactttgcagtgttcatgccagtgctccggacgcggatgctcaaaatgcacttcgcgcggtgcccagtggcgaccggcggcatggcggatcaggttgaggaacatgcccagtgtcagctcggcgtcctgtcggcgcatcaggatcacaccatgacgtacctgatagtccagttgccagcagtcgctgcgttctgtcagccggatgcaggtgttgtgttggtgaaagggaaaagcattcaccacattatgcagggcctgttccagcgtggcggaacacaatccgatatagccaatcagccccagggactgtggccggaactggtgaccgtactgcagaccaaagttgtccacgccggcctggcttgcggcttcctccagcacccggcagtagctgaccaaatccagactcagcgtggggcaggcgagcgtatcgggatcgatcccgctgatcccgaaaatgcgatcgacatcgccgccctgtgcattgataaattcgcctaagcccgttgcggcggcggataacacaccgcgatggccactgcctgcgccggagatggccgttaaagcggcttctggaactctgatggtcatcttgttttccgcaaaaagtgaacgtcttgttattctgcaaaaaacataccagctggaatatccgtgataacaaccgcttacccggtgcgcttttatttttgcaccgcaatcaggcactgcggcggtgcgttaaacgccaatcggcagcgcagcgccctcaagataacgatgacacagccgcacggtgtggctggcccattggtgacccaggctgcgcgccatctcggtttcacggtgggaagccacccaggcggtaagctggatgcgccgctggatcagcatggccgggatcatcgccagttcctgatcgctgatatgcgcgacctgttcatatccctttaaccagttttctacccactggggcgcgctcggatgatgttcaacaaaactgatcgcggcggcaaggtcgtgtaagtaccagcccatgccgcaatcatcaaaatcgatcacccgggtttcacctttatctaccagcaggtttgtcagacgcaggtctgcatgaatcagcccatagcgcgcgggtgactggccaaaatccatcatctggcggcgcacatgttccagtgtttcttccactaccgcgtgctcggcggcgggtaagcctgctacgtcacgccagtctccccaatggccggacggagaaaccatcgtatggtgatcccagataatgcggcgaaatccctgcggcttttgccattgccgactgtgctggtgcagacgggcagtgatggcacctaactggcgaaacgctgccggatcgacgctgtcggtcagcatatcgccctctatccagtggaacagcaccgcatagcgttcgccaccgtcgggcagcggcaggatctgaatgcgttcaccttgccgatcttctacagcgacgggcactataatgtctgccgcctgaagtgcgtccagccagagcagttcactttcaatatcctgcttcgcgtgataatcgccgcggtgaatccgtaacgcatagcggccctgcggcgtgctgacagaaagcgtggcgttttccgagcggcacagcagcctgacctctgcctgcgaacaggcgggatagtttattaatgcccggtgggcaagctgaaggatggtgtcgttactcagcgtgtcatactgtttaatgctcatgtccggctcccaggtttctgcgtgtggagtcagcatggcgctgaaccctgcctgcacgcttgacctgaaagcagaggaaaattgactttggcaggcacctgacggcctggcctggggcaagttgaccttaaatcacggcgttctgttttctgcggtcaagtttttccctcctcactgtgtccatcatctacccgacagcttttgtgcagcctattttccattaacacagacggggaacgcagtgatgaaagagaaactgaaacccaccctgggcaccctgcgactctggggcatcgccgtggggctggtgatatcgggtgagtatttcggctggagctacggctggggcgcagctggcaccctgggctttctggttacgacgttttttgttgccgtcatgtatacctgctttatcttcagctttaccgaactgacaacggccattcctcaggcaggtggcccgtttgcctacagccgccgggcgttcggtgacaccggcgggctgattgccggtatcgctacgctgatcgagtttgtgtttgcgcctcccgctattgcgatggcgatcggtgcctatctcaatgtacagtttccggagatcaatccaaagcttatcgccgtgtgcgcctatctggtgtttatggggctgaatatcgtcggcgtcagcatcgctgccacctttgagttactggtcacgctgcttgccgtgattgagctgctggtctttatgggcgttgtggcacccggctttagtctggcgaattttgttgcccacggctgggcaggacaagaaaccttctcaggggcttctgtgtccggcatgtttgccgcgattccctttgccatttggttctttctggcgattgaaggcgttgcgatggcggcagaagaggcaaaagacccgcgccgcactattcctcgcgcctatatcagcggcattttaacgctggtggttttagcgattggcgtgatggtgtttgcgggcggtgcaggcgactggcgtacattatcgggcatcaacgatccgctgccgcaggcgatgaaaatgctggtcggtaatgattcgcgctggatgcacatgctggtctggattggcttattcggtctgattgccagttttcacggcatcatcatgggctattcgcgccagttctttgcgctggcccgtgaaggctatctgccgcccgctctggcgaagctgtcgcggtttaacacaccgcaccgtgcgattctggccggtggcgtggtagggattttggccattttttctgacggtatcagctttcaggggatgagcctgaccgctgccatgatcaccatgtcggtatttggtgcgattgtgatgtacatcatgagcatgctgagcctgtttaagctgcgtcgcacggcccccgggctggaacgcagctaccgcgcgccgggttatccggttatccccgcgattgccctgtgcggctcgctgatctgcctggcggcgatgttgtggtttaacccagagattggcgcgctgttcctggcctttatggtcgtgggttacctctattttctgaccacccactcccggcgcggcacgatcgcgcaaacctctgtcgcggcggagatcgactaacgcagacaggcgctgccgcgcactgatgtgcgccagcgtctgcattgaacctgaggagcaatgatgacggtacgttcaaccattatggataccaacagctttcgtgcagagaacgcggaagcgctggccccggcgattcgccagttaaccgataaacgcagtaaggtgctgggcgagtcgtatcggctgttttatcgtaatcccgtgcatctggtgcggggacagggtcagtatctctgggaccaggcgggtaaccagtacctggatatgtataacaacgtcgccagcatcggccactgccatccggcggttgtggaggccgtgcatcagcagatgatgcggctgaatacgcacacgcgctatctgcatgagtctatcctggaatatagcgaacgaattctggcaacgatgccgacggccatcgatcgggctatgtacatgtgtacgggttccgaggcgaacgatctggcaatacgcatggcgcacgcctggagcggcggcacgggcattatcgtttcgaaagaggcctatcacggtaccagtgcgctgacgtccggtgtatcaccggcactgggcagcggtcagccgctgtcatcgcatacccgactggtggcatcgcccgatttttatcgcattcagcctgccgatcagggtgcctggtttgcccacgaaattcagaaacagatcgatgatatggccgcgcacggtatcaagtttgcggggttcctggccgattcgattttctcttctgacggggtattgcccggcgagcctggctttttaaagcaggcgattgaagtggttcatcaaaacggcgggatttttattgccgatgaggttcaacccggttttgcccgcacgggggaagcattctggggatttgcgcgccacggcgtggtgcccgacgtggtaacgacgggcaagccgatgggtaacggtattcccgtatccggtttgatggcgaaagcgccggttatggcggccttcagtgattcgctgccgtatttcaatacgtttggcggcaatccggtttcgatggcggcggcgcatgcggtgatggatgtgattgagcaggaggcacttcaggcacacagcctgaaaaccgggcaagccttgttatcggccttgcagtcgcttcaggatagttatgcctgcataggcgacgtgcgcggcgcaggcctgtttatcggctttgagctggtcacggacagagaaactaagcagccagacaaaaggctggcgctcgatctggttgaggcgctgcgcgaggaatgtgtgctgacgtctgtcgccgggccttacggcaacgtgctgaagatcagaccgccgctctgtttccagacgggcgatatcgactgggtggtcagtgccatggatcgctgcctgagaaaactgcagggataaaccgtcgccgggcacaggatgactaactgcccggcgtatggcccggctggcggtgtagcggtgattggtgagcgaagaaagcccgacgcatgccgggctcagtcaggtcagcaaaacggaatattgtgttaaatattgaggctttcagtcttattttaatttaacttaaaggatttataatgaggttaatttaacaggtgtgtatcttgttacgggttgaatattataattttttgtactcagcgtttgctaaggttttttaatcaggccctgggaaaaggcctgagatcgtttaatctgattaatgtaaacttcctgcttacgacgcgtgcttgcgttctgattcaatttgcttacgccatgcgcgattgtgcaagcagtaggcaatcatgcgataaaaaatcatgctgttaagacatcttaaactcaatgcaattaaaatggttccaatgattgaggctaccaaatgagtggtttttatctctgcaccgagtaacatgccaaatgtggtatatataaaaaatagcacgactaacacggtagtgctaaaggttaagtaaacatagcttttaagtgcccagtattgccctcttgctatcagaatcattaaagggtttatgatgatgcaatatataaaatctgtgattattgttcctgtcaaaaaagcatgttctgaccagttcatccaatttgaaatgccatgccagagagagatttgaggaagagaaaaacttatcaatgtgagcatgacacttgctatcagtggaagacccatagtatgccatccaatcggcacgtccatctcatctgtcatctcatctttaatggattcaagctgttcgtcattagcctggataatttgtacggtgacttttttactgagcgctaatgaacttttcaaatgattaagcatgattgtcaaagccctccctgtgcatttttcattaaaaaaggatatatcgatttaatcaaatacaatacggatcgtatatttaaacaaaaaagcctcgaaacgaggctgtaaattgtacaatttagttgctataaactttttactttacgaggtgtggtttttttctttgcatttcaatttgcttacgccatgcgcgattgtgcaagcagtaggcaatcatgcggtaaaaaatgctagtatccagacacttaaaggaaaggtatacagcaaaaactcccgcaaatgaaagaccaaatagtaatacatgcacgtctgagtctgctaatgccgaaaaaaaacaataaatgatgaagagcaaagaagataatgttgttatcgaaagaataactaagtggaattttaaaaaaagataactgccttttgccacaaaaaataatgaaagaacaatgaggaacgcataggaaaatgctgaaaccataatgccaatcattaaagcatattgtggccatcccattagtgcataaatgcctttccaaaacgagacctgaggaataataaaactaaataaagccagaaagcaacttgcaacaagtggaacgcccattgtgtgccaaccgacaggtttcttcatctcgtcaatcatttcatcttttattaattccagtttggcaatatcagatgtatcaatttttttgttataaatttcgcttagggtcagcgtttttttgagctttttcagcatgtgtatcaattaacccctgtagcattaaatgactggagtaatcctataatatattttcctgactgtgatatgttctgtggattacgaatggtccctgtcaaggcactgccgacaaatgcagaggtattaataatggcgttagctaactctttttgtagtgatttctgcaatgcttcagtgggaaaacgcttagggtatccgcccatttgcataatggctttgatgccagaatttgaaatacccgggttttgaatacggatgatctcttgagtaattcgctttctctctgctctgctcaacgttttcaaccactcgattgcgcgtgcggatgaagcacccctcatcagtttgtaagtatcaaaaatactttttagtcctgcgcctgcacctgctaaagaaatcacatctaaagcggtacaagttgctgagtaccaaccttgactatctatccaactgacgctttcttcatttcctgcactgattaacaatagtcgggctccaccatttaaacactgacctacagttgcaaaggttccagcggcgattatcccggcaacaacgccagttgctcctgctgttaatggtactgtgcttcctgctgcgatggcgagaaatgctgtcgccacagctgccccacatgaaaacgccgtcgacgtaatctcattcgccaaagaaggcttactcagcgtatccgtgagtgacttcgctgctacctgcggcgtagtggcattgaccttagtaatcaccacatgactcacactacttcggtttggcgaagcgtagcggcgagaagggcgaacaagccattgttcgcggccatcggaatagatgatgcccacctgactaaaatcgcgcgtgcaatccagacgattggccagggcggtgaaatcaatgtcatctgcggacaccaggcccatccgtcggccaaggccgtaatccggaaggttatttgaataggattctgataaggccattagctcactccttgctgatgatgaccgggttatgaagcgtcaagggtaaagcgcagcggaaacgaattaattaggaatagtcttaatgatccattagagccatcaatgtgtcgatgtcgccatccatgccagccatccctctgtaagaagtttgtggcttatcaagtgattaaccctgctttacatttcatgacaatgcaaccttttcatgccgcgacttatgcgctgtcagccaggttatatccgttttatcaacaaaacgcgtagcaccaaagcgacataatttgttgctttaatgtggcggaaaggtttaaaactatcgtgcaggaattaatcaaatgcttgagtttttttaacctctccttttacatttatttgggataaataaaatcatgaaaaacagggtacttgttgcttttgctctccttgcgctgagtggctgtagcacgatgtcttctaatgacgccattcctccccttcagaccgagacagcaaaaatgctgggtttgagttcttctgatgagctgaccgtaaccaacgtgtccgcgacaaaaccagatacactgggatctcaaatgctgtcttatcgtgcaaccacagataaaggccgtatttttgactgtcagtctcagatgatccccggcatcctgggccaggaaccggtcgtcaccgtgccaaaatgtacgccagttaaagtacataactaaaaaccgtttccctgcctgtatttcgggcagggaatctccgtttaccggttcgcctttcgcaataaatcaaagaaacacccatcccgtggtttcctgtcttgaacgcgcgtttctttcaacggttgtacccattttagtggcacgaacccgatctgaatattcacgttgcaatcgctcagcatcagcagcgtgagatgttttccccttcccgagccgtcttgctgccgcaaagcacagacgttgcgtgagtgaccaggcatccgttttgagagcaaccgtgttgatcctgactcagcgccttcgttaagccgcctgcacgaaatcatcatcttgtttaacttttctaatgcttttatgccactctcttcctgattgtcatctcacaagcaggacgctcacctgccagaaacttatgtgacagggcatgataaattcgccatcgccgttagtagcgccgtcgcgtgttttatttatagcaataaatctactctatgcttcagtaggcattggatgtttgaaggcgtcctgacgacattgccgggccggtttttgatgggaaactaatgcatttggggatgagcgatcagatcggggttttgccttcataaaaaattaacaaaaaccccgtcatcaggtgagcatacgtttaataatcctgcctgataatccctcacctgaaataattcagtcgctcccgtgatgaaaagaagagagggttcatgaacttccgattcaccatgctggcggccaacagacggttattgcctaacgtctgggatgccgtggcttttcccctgattatctgcctgattgcgatggtggcggtgggctttcatcaaacgctgatgccgatagacagtttaaaaacgcaggcgatctcgctcgatccttctaatctgccagaatatgccatgcgcaccaccttgcgcatgctggtggcgatgctggcttcactggtcttcagcctgatttacggcacgctggccgccaaaagccgtcgcgctgaaaaagtgttggtgcccattctggatatcctgcagtccgtgccggtgctgggctacatctcctttactgtcaccttctttattgcgctctttccggggcaggtgctgggcgttgagctggcggccatctttgccctgttcaccagtcaggcctggaatatgacctttagcttttatcagtcgctacgcacggtgccagccgacctggttgaagtgtcgcgcggcttccatctgaccggatggcagcgtttctggaagctggatgcgccttttgccgtgccagggctggtctggaacatgatgatgtcgatgtcaggcggctggttctttattgtcgcctctgaagcgattaccgtgggcaataacacctttaccttgcccggcgtgggtggctacctggcgcaggctattctgcataaagacattcacgcggtgggctgggtattactgaccatggtgattgtgattctggcttatgaccaactgctgttcaggccgctggtcgcctgggcggataaattccgtatggaaaacacgcgttcaggcaatgcacccacatcatgggtgcgtgacctgatgcgcaggacgcgtctgattcaccaaatctttacgccattacggctgctgctgtcagcgctggcgcgtatctcgtggcgctggccagcaaggggaccggtacgtgctgagagccgtacgcaacgcgcctcgcggtggggtgatattgtctggggtgcctttgtgatcttactgaccctgtatgtggtttaccgggtcatcacctatgttcaactcggcgtcacgctcgatgaggtgaaacacgtctttacgctggggctgattaccttattacgtgtgacgatactgatcctgatttcgtcgctggtatgggtgccgctgggcgtcatgatcggcctgcggcctgccctggcggggaaaatccagccggtcgcccagttcctcgcggccttcccggcaaacctgatgtttcccgtattcgtgattatgattgtgcatttccatcttaatccggacatctggctgtcaccgctcatcgtgctgggcacccagtggtacattctgttcaacgtcgtggcggggaccacggcgtttcccaatgactataaagaggccgcagcgaactttcatatccgcggctggcaatggtggcgtcaggtgatgttacccggcatttttccttactacattacaggggcgattaccgcctccggaggcgcgtggaatgccagcatcgtgtctgaattcgtgcagtggggaaatactcaggtcacggcgcacggtttaggtgcttatattgcacaaaaaaccgccgccggcgactttcccaaaatcattctggggatcgcggtgatgtcgctgtttgtcaccctgttcaaccgtctgctgtggcgaccactgtacgtgtacgccgaatcaaaattccgtgctaattaagggacacctgatgttaaacaacccatccacactgaacgcagacgtgtcgaacagaaaaccagaagggcgcaaagcggtcctgtcggtaaaaggcattaagcacggttacgataaaacgcatggcgaagtgctgatcctcgatgacgtcaatctcaccctgcaggaaggggagattgtcgctctgctgggccgctccggttcaggaaaatcgacactgctgcgcatcatttctggcctgattacgccgggttccggttcagtcgagtatctgggcaagccgctcaacgggcccgccaaaggcgtcgcaatggtgtttcagacctttgcgctgtttccctggttgacggtgctgcaaaacgtggaagctggccttgaggcgctgggcgtggaaaaagcggaacgcaggaaacgcgcgctggcggccatcgacctgatcggtctggacggttttgaaaacgcctatccgcgcgagctgtccggcgggatgcgccagcgtgtcggctttgcgcgcgcgctggtggtcgatcccaccctgttattgatggatgagcctttctccgcgctggacgtattaaccgccgaaacgttacgtaccgatttactcgatttgtggaacgaaggccagatgccgatgaagtcggtgcttatcgtcacccacaacatcgaagaagctgtttttatgtgcgaccgtatcctggtgctgtcgtctaaccccggacgtgtggtcgcggaaatcaaggttccttttggtcatccccgcaatcgcctggaccccgcgttccgtcgtctggtcgatgatgtgtacacccagatgacggccagaccaaccagcgataacgtgaaaaagagcctcaggctgggcacacgtctgcctcacgtatcgactaacctgatggccggcctgattgaaaccctcgcggccgcgccctatcacggtcgtgcagacatgccagatgtggcccgttcgctgcatctggaggtggatgagctgttcccgatagccgaggtgctgcagtcgctgggctttgccgacgtgcgggaaggggacatttttctgacaccgcccgcccgggtttttgccgagtcggatacgcagcagcgcaaaatcatgtttgccgatcatctgctgcgttatgtaccgctggcggccttgattaaaactgttctggatgagcgcccgggccatcgtgcaccgcgcgtgcgctttgagcaggagctggaagactcgctggctgacagcgccgccaaagagaccctggacagcgtgatcaactggggccgctatgcggagatcttctcttataatgatcagaccgaattcttcagtctggaagacgttgagttctgatcccgttcgctcagtgaaacgtggctattcacggtttacaccatcccgattttcagcgcgggatggtgcctgaaagattctcaaggttaaaaatccctcctgacgcatcaagatgccgcattttatactgtccctctctcccggatataaatagcttactactgtaattaataattataattaattgcctgcactctcaaaaccagtcatttaattgggtaattcgtatattttttctgtttttgtttttcaaaaaaataaagagttatcagtgtttaattctattatgtagttattattttgatcctgaaaattaagtattgataatttattatttattaatatttcatgatcgaattaatatctgtgagttaggcgatatttaaataattataattaggtccttttttaactacaggagtaagactattttgatgccctgatgaaatgaaggtttagacatgaaagatgacaagattttaatattgcgtacctgtgctaataatatggccgatcacggcggaatcatctggcccttgagcggtatcgtggagtgcaaatactggaagcctgtcaaaggctttgagaacgggctgacgggactggcctggggaaaaggatcggattcaccgctaagcctgcatgccgatgccaggtgggttgtcgctgaagtccctttcgatgaatgtatcgcgatagaaacccatggctgggttaaatttccccgtgctgaggttcttcacgtcggaacgaaaaccagtgcaatgcaatttatcctgcaccatcacgctgattatattgccagtacggaaacgcaggccggatcggttattcctgatgtcgcttcagaaataaaggcaggggagcgatcgctgcccgtagtcgatgatattgatgcaaccatcgaatcaggcagcactcagccgacgcaaaaaattgaaatcggaacctatggcagtacgctcagcggcacgcatcagagtcagctgatcgccgggtatggcagtaccgagacggcgggcgataacagcacattaattgccggttatggcagcaccggtacggcgggggcagacagcgcattagtcgcaggctacggcagcacccagaccgccggggaagagagcagtcaaatggcgggttacggcagtacgcagaccggcctgaaaggcagcgatctcaccgccggttacggcagcaccggcacggcgggggatgacagctcattgatcgccggttacggcagtacccagacggcaggggaagacagctcgctgacggcgggttacggcagcacccagaccgcgcagaagggcagcgatctcaccgccggttatggcagcaccggtacggcggggtccgacagttcgttgatcgcaggctatggcagcacccagacggccggggaagagagcagccagacggcgggttacggcagcacgcagaccgcgcagaaaggcagcgatctcaccgccggttacggcagcaccggcacggcgggggatgacagctcattgatcgccggttacggcagtacccagacggcgggcgaagacagctcgctgacggcgggttacggcagtacgcagaccgcgcagaagggcagcgatctgaccgccggttacggcagcaccggtacggcggggtccgacagttcattaatcgcgggctacggcagtacccagacggccggggaagagagcagccagacggcgggttacggcagtacgcagaccgcgcagaagggcagcgatctcaccgccggttacggcagcaccggcacggcgggggccgacagttcattaatcgcgggctacggcagtacccagacggcgggcgaagacagctcgctgacggcgggttacggcagcacccagaccgcgcagaagggcagcgatctcaccgccggttatggcagtacctcgactgccggttatgaaagttcattgatcgcgggctatggcagtacccagactgcgggttacagcagcacgctgacggcgggttacggcagtacgcagaccgcgcagaaagaaagcgacctcatcaccggttatggcagtacgtctacagccgggtcagacagttcattgattgcaggctatggcagtacccagaccgccagctacaacagtgtgttgacggcgggctacggcagtacccagacggcgcgagaaggcagcgacctcaccgccggttatggcagtaccggcacggcgggctcagacagttcaatcattgcaggctacggcagcactcagacagccagctataacagcagcctgacagcggggtacggcagtacgcagacggcgcgtgagcagagtgtgctgacgacaggctacggcagtacctctacggcaggtgccgacagctcgctgattgcaggctatggcagcacccagaccgccgggtacaacagtatcctgacagccggttacggcagtacccagacggcgcaggagggcagcgatctcaccgccggctacggcagcacctcaaccgccgggtccgacagctcgctgattgcgggctacggcagtacccagaccgccagctacaacagtgtgttgacggcgggctacggcagtacccagacggcgcgagaaggcagtgacctcaccgcgggttatggcagtaccggcacggcgggtgccgacagttcaatcattgcaggctacggcagcacccagaccgccagctatcacagcagcctgacggcgggctatggcagtacccagacggcgcgcgagcagagtgtgctgacgacgggctacggcagcacctcaaccgccggtgccgacagctcattaatcgcgggctacggcagcacccagactgccgggtacaacagcatcctgaccgccggttacggcagtacccagacggcgcaggagcgcagcgatctgacgaccggctacggcagcacctcaaccgccggtgccgacagctcattaattgcgggctatggcagcacccagactgccgggtacaacagcatcctgaccgccggttacggcagtacccagacggcgcaggagcagagcgatctgacgaccggctacggcagcacttcgacggcgggttacgacagttcgctgattgcgggctacggcagcacccagaccgcgggctatcacagcattctgacagccggttacggcagtacccagacggcgcaggagcgcagcgatctgacggcaggctacggcagcacctcgacggcgggtgcagacagttcgctgattgcgggctacggcagcacccagaccgcgggctacaacagcattctgacggcgggctatggcagtacccagacggcgcaggagaatagcgatctcacgaccggctacggcagtacctcgacggcaggctatgagagttcgctgattgccggttatggcagcacccagacagccagttttaaaagtacactgatggccggttacgggagttcgcagactgcccgggaagagagttcgttgactgccggatatggtagtacctcgatggccggttatgacagctcattgattgccggttacggcagcacccagactgccggttatcaaagcacgctgacagccggttatggcagcacgcaaacggcagaacacagcagcacgctgacggcaggttacggcagtacctcaacggcgggcgcagacagctccctgattgcaggctacggcagtacgctgaccagcggtattcgtagcttcctgacggcgggctatggcagtacgttaatcagcgggcttcgcagcgtacttaccgccggttacggaagcagcctgatttccggcagacgcagtagcttaacggcgggatatggcagtaatcagatcgccagccatcgaagctcgttgattgctggcccggaaagtacacagatcacgggcaaccgcagcatgctgattgcgggaaaaggcagctcacaaacggcgggttatcgcagcacattaatctccggggcagacagtgtgcaaatggctggagagcgcggcaagctgatcgcgggtgcagacagcacccaaaccgccggggatcgcagcaagcttctggcaggcaacaacagttatctcaccgcaggcgatcgcagcaaactgaccgcaggtaatgaatgcatactcatggcgggagatcgaagcaagttgacggcgggcatcaacagcattcttactgcgggatgccgcagcaaactgatagggagcaatggctcaacgctgacggccggggaaaattcaaccctgatttttcgctgctgggatggaaagcgttacaccagtgtggttgccaaaaccggaaaggggggaatagaagcggatatgccttaccagatggatgaagacaataatatcgtgaataaacccgaagaataatcgtcttagcctggagggattattgtgttgcctgggggaaaagtatgtcagcgtattttacccagcacgcagaataacctgaaaaaacagagcatcgttatccggcctgttatttatctttttctgaacacgataaaccttcattggccggcctgtttcggtggtgcctgacccggccattaacaggagtgataagcaaaaggctcaatgctgagcctctgcaaaaacacatgattattcagggacgccagacggtgccgtccggggtgcgggccatcgtccagccaggattgccgccctcacaggggaatttcgccgccagcgcctcgttaatatctatacccaaacctggcttatcattaacataagcatagccctgctcaacctcagggcagcccggaaatacctcacgcagcgcatcattcattggcgtgtattcctgaatgccgaagttgggtgagctcagatccagatgcatattggcgcaaaccccaaccggtgaaatatcgccggggctgtgccaggcggtgcgaaccccatttaattcactgtaaatggcgatttttttcgccggtgtgataccgccaatcgagctaatgtggcagcggatgtaatcaatcagtttattgtcgatcaacggcttccactcattcacattgacgaacagctcgcccattgaaatcggcgtggaagattgctggcgcaacattttcagccactcggtattctcgggggccaccggatcttcaaggaagaaaagctgataaggctccagcgctttggccatatgaatcgcgttaattggggtaatacgttcatgggcatcatggagtagctccacgctgaaacccagcttattgcgcagatgatcaaacaggcgcggaatgcttttcgcgtaggcttctggatcaaaatagatccccggcgctttgttacgtggcgagcgcttgggttgaatatttttcgctttcaccatgcgggtggcaatcagcctcaggtcgtcggtacctgcaccgccatacatgcccatctggcagcgaatatactgataaccttcctccattttggcgcgtgcgctgtcctccacttcggcttcatctgcgccatcagtgtgcacatagagcgcgataccgtcgcgacatttcccgcccagcagctcataaaccggcaggccggcctgcttacctttgatatcccatagcgccatatcaatgccggaaagggcgttattcattaccgggccgttacgccagtagccactcacggcggcagactgccagatatcttcgatcctggcaggatctttgccaatcagaaacggggcaaggtactcgtcaatggcactttgcacggcatagatgcgttgcgtgaaggtggcgcagcccaaaccatataaccctggctcattggtttcgattttaaccaccaccagatcgattccgcccggcgcagtcaaaattgttttcacgttggtgataaacagattactcacaatagctccttaattttcagaacattagccgccaccgtactcatcgctgctgctcacggctcaaaggtatgttgtcatacaacatgttctttctaccacaaagcttgccgatttcatttttgtcctgccgtttttgtgacagcgatcgactgaatcacctttctgtaaataatctgtgtttatattaatattatacaatgacttagatggtttttttgttaaggctttgtgatgcgcgcctcataaatacgcattgtgtgttgatttaatctgctcgtaaattcaccttaataagatagttgtcatacatatttaaaggtgagccatgactgcaatgttcgacctgaccggtaaaacggccttaataaccggttcctcccgggggctgggttttgcctacgcggaagcgctggcggctgccggcgcgcaggttattttgaacggtacgcgtgaagccgttctgactgacgccgtggcacagctcgccaataaaggctttggcgtaaccggaatggtattcgatgtcacgagtgaaagtgccatagaagaggcgttctccagtctggacgagcaggggatcgcggtcgatatcttaattaataacgccgggattcagtaccgcaaacccatgctggagctggaactggaaaactggcaaaaggtgattgataccaatctgaccagcgcctttctggtgtctcgcgcggcggcaaaacgcatgatcgcccgtaaccgtggcggaaaaatcattaatgtcggctcgctgaccagccaggcggctcgaccaaccgtcgcaccttataccgccgccaagggcggcattaagatgctgacctgctcaatggcagccgaatgggcgcagtttaatatccagaccaatgcgattgggccgggctacatcttgacggatatgaacagtgcgctggtcaatgatgcccagttcgacagttgggtgaaaagtagcaacccttcgcagcgttggggacgacccgaagaagtggccggtacggccgtttttctttcatcgcctgcctcagattatatcaatggtcagattatttacgtggatggcggctggctggctgtgttgtaagcctcattgacccgagaagaggaaaaagatgtgcatagcgtaatgactcatgcctgtgtggcaaagggcaaaaaagagattgtggttgaacagcgcgagctgaaatattcggatgatgatgtcgttgtgaaagtggaatgcggcggtatctgcggctctgatattcactattaccacgaagggcgcgccggattatcggtgatcacacaaccgctggtgattggtcatgaatttgtggggcgcatttttcatgccccggccgcctcgccgctacagccagggcaaaaagtcgcgattaatccctctcagccctgtgggcggtgtgagtattgccgggcaggtaagcagaatgcctgtgccaccatgcggtttatggggagcgcccagtttaccccgcacgtaaacgggggatttgcacagtatgtcgtggtgcctgcgcaacagtgcgtggcgtacgatgagcaggttccgtccagcgtcatggccgttgccgagcctacggcggtagtgatccatgcgctcaatgtggcaggcagcatcgtgggtaaaaaggtgctggtgatgggcgcgggtcccataggcgcattagcgattgcggcggcaagagcatctggcgcggcagagattgtggcgtttgatctgagcgagcgttgccgccgtattgcggtggaaatgggggcggacgcggcggtggatgcaagcgatcaggccgccgttgcccgctatggtgaaaaccggggatattttgacgtcacgctggaagccagcggcgcagaagcggcgattgaatccagtattctggtgacgcgaccaggcggcgttgtggttcaaataggcatgggaaaaagtccgcttaattttcctgtggcacagatgctggtaaaagaaataagttggaaaggcgccttccgctttattgatgaatttgacgttgcggttaaatggctggaaaaaggcattatcgatccgcgtccaattctctccggtcattatgactatcacgatattgaggcggcattaaatgcggccagtgataaaacgcaacattcaaaagtattagttcagttttcataaaagacactaaaacaagtcgtcatgactgtggctaaaaaacagcagtaattatcgcgggtgaaaataagctcacgctcgcgtgagcggcgctcgcctgtcatttaatggtctgttaacgcatcgtcgacctcagggtgaaagcatgagtcattcaaataccaacaccaccaaacgtaatacgtctgatcttgtcagggcatccgtgtcaggatggctgggtacaacgttagagtttatggattttcagctctattctcttggtgcggcattagtttttcatgaagtgttttttcccgaacaatccggtgcaatggcgctgattctggcaatgggaacctacggtgccggttatattgcacgaatcgtcggggccgttttttttggtaaaatgggcgaccgcgttggccgtaaaaaagtcctgtttattaccatcgccttaatgggcgtgagtaccaccttaattggtgtattaccgacctaccagcaggtgggtattttagcgcccttactgctggtcgcactgcgtattattcagggtttaggcgccggtgcagaaatatcgggtgccagcacgatgctggctgaatatgcacctaaaggtaaaaagggcattatcgcctcgctggttgcgatgggaaccaactgcggtaccttgagtgcaacggcaatctgggcggccatgtttttcttcttcaccaatgacgacgtgattgcctgggcatggcgcattcctttcctggccagtttcgtggtgatgggctttgctatctggctgcgctttaacctgaaagaaagcccggtgtttgaaaatgtcgcccaatccgccaccgttaagccccacgaacagccaagccagtccgttttcccgttaatgaagggcaaagccttctggattgctaccgggttgcgatttggtcaggcgggtaactcaggcattatccagacgtttctggcgggttatatggtccagacgctgttgttcaacaaggcggttcccactgatgccatcatggtgagttcggtcattggttttctgtccattccccttatcggctggctgtcagaccggatagggcgtcgaattccctaccgcatactgacgctgggctcgattattctggcttacccgatgatttcgctgatcgtcgataaagcgcagtccgtcagtaccatcatggtttgcctgatcgtgatccacaacatcgccgtattaggccaggcagcgattgaagggatcaccatggcggagatgtttggttccagaaaccgttttgctcagatggctgtctcgaaggaaatcggagggctgtttgccaccggattagggccgctgctggctggcattttctgccagctcacgggctcatggtatccgattgcggtcatgttgatctgctactcctgtattggtctggtggcatcactggttatgcctgaggtggccgatcgggatcttaccgtggaggctgatgcgtcaggcggcgtacctgcgggtcgtcagcacattgcccccacgctccgggcaggaagcggcgagtgatgtctggggctgggtgttagcgcaggactttgttgtaacgcatgagatagaatggcgtcatgtaggacatcatatgagacagtgttgtgagcataaaatccattcagaaacagaacgtcgttaacgaagtgttcgagcaaattaaggccaggctactggacggtagctggtctgcaggcacgcgtttgccttctgaagcggagctgacgcactcttttaatgtaagccgcgtcagtatcaggagtgcggtccaacgcctgcgcgatctcggcattgtgattacgcgtcagggcagcggcagctatgtgtgtgaagacttttcgccgcatatgctcaacaataacgccagaccgttaatgcatctgagccgggaagcgtttaacgacatgatggtctttcgccagaccgttgagtttaaatgtgttgagctggccgtggaacacgcgacggaagaggatatcggcctgttggagcacgcgctcaataatatgctcatcaacaaaggcgattataagaagtactcggaagcggattacgactttcatctggcgattatccgtgcctctcataacagtgtgttttacaacgtgatgaagtccattaaagatatttattactattatcttgaggagctgaatcgctcactgggcatcacgcttgaaagcgttgaggcacatatcaaagtgtttatggcgattaaaaaccgtgacgcctcctcggcggtacaggtgcttaacgaggcgatgaaacataacgtggtcgcgatagagatgattaaaaaagaggaaggtcattaggacgcacgtttctgtgcggctaaggctatctcgctgtccgtcgggtgaggacaggaaaacaagattcaccggctgctttgtgcttttatcttgtgctctgcttgtctgtttatcgcctgccacgccacggttattgcgtgacgcgttcagggatgaaggcgtgccgatcaggatgacaaggtgttattcagcacggatcagcagaataaaaaagggagccaacaggctccctcgtcgatcaatgcagacagcactgcttgtattttttaccgctgccacaggggcaaggatcgttcctgcccggctgtttttccgccgttatcggctgctgtatctgtggaatggcttctggctgtgagatccagtaatcatgaagcgccagcgcggcagggcaaatcgcatcaatgctgctttccatttcttctggcgtgagtgcatccaccttttccaggttctcttcgagaccatgtaaggcgatagcgtccagtgacgtctgaagctccgcgggaagcgcagaccagtccgttaatgccacgccacgcatgtagccgtagcaccactcttcaaccacggtaaattccagcccttccatttcgcgtacgccaaacagcggttcaaactgttcgggaaactcagataagcggtcagcaatgtcattcatatgctgaaagctgagttccataaagcgcgtcatttcacgctcattactccatttaggaatatgtttttcgccgccccagagcgcaattaaccaccggctgggttctaccattgttgggcctgaaagcacggcggtaagcaggccgtccagttctgagacgtcaagaattgacgcttcactgccgtatttttccagcatatcttcgagccattgcagctctttttcgcttaacgggccttctttcatgggtatctccgggcgtatctggtgcagcagaaaatttactgcgtgtaaaaacgcgcagtgtacacgcttattgcgctaatggcagcgtcgtcagattgccctgagcggcaacagactcggcagaggcattacctcacccgctatgttactctccgcgacctgcaacgcgctttgctgcacgatcggggttatctggcgctagcctgcttcgtttctctgacggaggtttgtatcaggcgacaacctgttgcctgaaaagcatcatcagaggcataaagattcggctacgtcgtgccgatataagcaccgcggtatacgccggcatgatgctgatatgaacgttcgtcagtgcctgataacaacaataagatgggcgcgagtgagtgaccagaaaagagtataaaacccggaggttatccggcctgttgagcggatgcagccgtctgtttaagcgcagcgctatgctgataatctgtacgctgttgttagccgcctgcggaacgctgtcgcaaacctctgcgccgacaggcgacaggctttatctgacgcacagcgacttccatgacaacctggacgatctggtgcgccattatatgcagcgcaaacaggtgtccggcatcagcatcgccattatccaccatcacaatcccaccctgttttacagcgctggcgtcaccgatgacgtacatcgctatccgattacgcctgataccttatttgcgctcggctcactgagtaaaggcgtgaccgcagaagtcattatcgaacaggttaacgaaggccaactgcactggaatgacacactggccgatttactgccctctgacgtcaggttaagtcaggatgcacgccatatcacgttgttacagttggtgacccatacgtccggtctgccgcgtcaggatatggatttgccgatgtttatgcagtttattggctatctgcgtagcggtcagaatttttatggcaacctggatagtgatgcggtgctggaatacctggccgatttttctgccccgcgtcagcgggtgccgcaatactctaaccttggctatgcgctgctgggctatattttgcgagaacggtgccacaatgatattgaaacgctggcccaccaacgaattttccgacccctgggaatgaataacaccggctttgtgcctgagcggttaagcggttttgccacgcgcgcgttaggtcatgctggcgatcagccaaagtttatcccgcgcggtgaccttaccccggactggcgtttccatcgtaatatggtcgcggctggcagcctttacagtaacgcacgggatctgagcgtctatctgcgcgcgcatctcaacgccgtcgccgatcctgcgctcaaccgggcttttgcagaggtcaataaaggcgtttatcagcagggctcgcaaacgcagaacatcgcctgggtaacagacaggctggcaggaagaaatatgacttatcaggtcggttatattggtggttattctgcctttattggctttgacaggcaggctggcaatgccatcgtggtcctgcaaaacgcgtttaactggagtaactatcttggtatcacattgctgcttaacctggcagagaaagacaggtaaggtataggttgggtccggaatgagtcgtgattccttacacttacctttatgagtgacggaaccgcaaccctgtttagattgtcttcagagtagtctactgttattaaaatcaattcaatgtggaaattattatgcgcaggactcaaattgcttttatttcagctggtttactgttcggctcgctgagcctgattcccgcggcccaggctgcgggtgaaaccaccgataacgtgccaccgccaccgcaggttcagccagccgatcccgctgctcagcctggcgataacaacgcgcaacctggtgcgggcaccgcccagcctggcaccgcacctgcccagccgcaggcaccgatgagttctgactccaatgacggtattactccaacaacgccttcgcagtcagctggcaatccgggtaagccgaattacgatctcagcaccattatcatcgattataaagagcataaaatcggtgataccgtgccagacaagtatcggagcaagacttacaccatcactgagtggcagaaacgcaacttgcctgcgcctcagccagatacgcactgggcttatatcaatgccaattacatcctgatcaccaacgacaccggtaagatcgttatgggtaaatctggcgatatcttcttccgcggataatcctgcggcgttatgtcagcaggaatcgcttcaacggcctcattaagaggccgttttcttttttctgtctgttttttatatgtggtgacttctcaacttctttgcaacatggcaacgtatttttattaaccgcacagaaggaggccaaatgtcacagcacgtcaatcagtatggtcaaccggtagggcaatcgctgcctgactggcagccacgtcctttacctcagcgtgaggtgtttcaggggcaggtttgccgtctggaaccttttagtgtcgcggcgcatgcgaatgcgctctggcaggcctggtcgttagccgaagatggccgtgactggacctacctttctgagggaccgtttaatgatgaagccgcctggttagcccatgccagtacaatggaggagagccgggacccgttgcatttcagcgtcattgatgttgaaaccggtcaggccgtcggtacgttgtcgctgatgcgtatcgatgcggcaaatggggcgatggaagtaggatatgtcaccttttcccgcttgctaaagcagacaagaatggcgaccgaagcgcattttctgttgatgcgttacgcctttgagcaacttggctaccggcgctatgagtggaaatgtgacagttgcaatctgccctcacgccgggccgcgcttcgtttagggtttcgttatgaaggtgaatttcgtcaggcgcgggtttataaaggtcgcacgcgcaatacctgttggttttctgtcatcgacagtgaatggccacacgtcaaaaacggcctgacgcgctggctggcagaggctaactttactcccgatggggagcagcgtgaaaagctggaaaccttacgcggctaaggcctgagtcgcgggaaacgttcagacaagcatatatttcatggtcgccatgagcagcgtggtggtcatgaccatcatcaggcgcttgacccagcacatatcgttttttagattgcctacgtccgtcttaagttcagccacgtctgtcttaagttcagcgacgtccgtcttgagctcagccacgtctgtcttaagttcagcgacgtctgtcttgagttcagccacgtccttcttgagctcagccacgtctgtcttgattatagcaacgtctgtcttgagtatagcaacgtctgtcttgagctcagcaacatccgtcttgagttcagccacgtccttcttaagttcatccacatctgtcttgagtttagcaacgtctgtcttgagctcagccacgtccgtcttaagttcagccacgtctgtcttaagttcagcaacatccgtcttaagttcagccacgtctgtcttaagttcagcaacatccgtcttgagttcagcgacgtcggttttgagttcaacaatatccgccctgaatacatcgttatccgtctgaaggacttctacacctttcgcaacatcgcctgtttcggttctgaggtcggactccgctttcttcaactgcgtgcttaacatcataatatgctgattttgaaactgaaaagcccgcatgacatcggctcgcgaaagggcattgtcctgctgtagttcagaaaaaatagccaccatcgcttctgcctggcgatcgttgatgcctgctcgttgtaaacgtttaaatgctttgtgtgtattcatcattgcgagtgtcattcatgcgttttcccgtttcatcacaccatgagcacatcatgtcaggagaagcggtttagtcacagaagggaaagactatattgcgtattaaatcttaatatatcaattagttaaacgagtagtttgcatcattttgcggggcggtacgcaaaaaatgcgtcatcagtctgcctctcttacacagactgtttaattggctgtgtaagaggctggcgctcactgctgtggttaacggctgtggtggagaagcatcagggaacgggcacaacctttaactcgaccagaccgatgccaagtttgcgcgggtcctgaccggggatgttgttaagattgctgagctgcggttccggcggaataagggttaaccgagagctgccgtgggcattatcaaaacgcagcgtctgggttgacgtctgctcacccagcgttaaccgttgctgggtatcacccacgcgaacggttgttggccggtgcgcattcggaccataggcgcgagcggttatcaccagatcgaatttagcgggcaaggggttaacgaactcaatcgtcaccgccggggcgaggttggcatttgaccagcgtccccaggactctggacgggaaatgccgctgaactgcttcacgctttccggtgcgccgggaagcgcgaacagaaagctgtcggcgtgataacgaatcgcattgtcttcgaggcgaagctgcgccactgcatgctgataactggcatcgttcaggccatctgccgggaactgcaccttgcctttccactggggtttatcgatgcgcgtgacggaaggatgccccgcgagctggcccatcgccaggcaccagtcgcccgacagggcaagcgccggttgccagatacgcgcaattttaaaacagcgatcgacccagacaaacttttctgccggcgcaaagtcggctaactggtagcgtaaaggcgctgaatattcgccttccggcagtggctccacatgcttatccgtgacgcgcaacaggatgggtaacgtaaagctggtgccggaaaagctgaacatattgttggtctggtcaagggtaacgctgtcgatctttttggggaaattccacagctgaatgatattggctttccagctcagcactttggttttcatatcctcaaactggctcgatagtgataccgctgacaggctgctgcgtcccaaacctatcgcattatcgccgcccaggatatccagcagcgtcgcgccgttatccagcgtactgcgcttcatatcaatcacctctgcctgtggctggtcaccgcgaatcaccataaacagatcgtgacggggatgcgtgatcaggaacggatgcgccgtgttattcatggccagatggtccgacgccaccacaatcacggtgtgcttaaaccagggtgacgctttaatgcgggcgattaatcgggcgatatgttcctgcgagcaggacaccgcactgaacgactgatttggcttgcccgcatagctgtaacttttgcgctggcaacttcgggaaataaatccatcgggatgatgggtatccaccgtgagcgtaaacagggcaaaacgtgtctgctgacgtgaaagtgcctcataggtttcaaacacctcatccagcacggtatcgtcgtaataaccccagttatttcgataagccggatcgctgaccttgtctttgagctcctgcgatccatacatgtgtgcggggtcaaaaccgtgagagcgcaaaaagacatctttacccgcaaagcgcaggtccgcgccctggataaaccagttttcataaccggagttttttaaaatatcccccaggcaaacgttttgtggataaaagctggaaagggaggcggaagcgttgccgtcgaaaggggcaaaaagaggaattccgcacattgatgccaccatgcccgcaatcgtgtaatcggtaccgggaagttgttctgtctggctgaaatcgatgctttgctctttctcccggctcagctcgggggccagtccgggaaaggcaatctggtcgaagtaggtccgctccaggctttcagcgtaaatataaacgacgttcagcgcaggctgttcaatgcgttttttgggcaccttataaagggcgctaaagtcagagttttcgcgcagtgagtgcgaggtaatgagtgagctgacctgctgaaaagccggggttgtttgtatcgcgccggcggcacaggcgaaagccagcaggctccagccaaaatgaaagggccgctcgcggcggcgcagcagccatgataaggcgcaaaacagcaaaaacaggacggtgataagaccaagagcaggcacgacgtatttactcaggccggcaccggtcaggctgttggttaaggtataaaccaccgcgtcggtaatgccatcgccggtaaaataattgctggcaaacagcgtggcattgagcaccacaaacagcatcagtaagaataatgtgaggtaaaaccagattctgtttcggcctgctttacaggaataaacagcaatcgcggtcagaaaaagtataactgacacgaattcggacaacgtcaaatcctcttatgaaatgaacatgtctcttctcaaaggggacattttcatggatttttggctcaatctatagtggctgtcatctggctgcaacctctctgcgcggatttggtagcggattcacattgcaggcaagcagtctgtcccgaagagctggcgagcctggcgatttcggatgaaactggccaggctctggatggatcaggcgcgttgttccagtggggcagagagcctggccggtgaggacaggctgctgtgcagggcttccccgaccaggctggcccgattgtaaaaccggagccgcaggttgaaatcgaggtgcgcgcgatcgctgtcactcagcctgatgaccggtggcggcgtaagcgggcgctgctggaataagacgcaacgcacacatgccgtgctgttgccggcgtgcacgctttggtaatacccggcgctggcttccgctttacgtagcagcgtattcacacggcgatgctcatccattgctaactgatgggccagcgccagcagttcttcacccggctgacgtaaattttgtcgtacagcagggaagtcactgcgcttcatcagctccagcaggtagttttgtcttccgacatattttaccggcgccagctgtttcaaccattcccggataaagggattttgggcgggagccgcgataaaaccggtttcaatcaccggcctgagcggattatcggtgcactgctggcgataataaccgaccacatccatcgggcggtcactttgcgcctgatggacccaggtgagatcgtcaaacagcagagtattacaatcgatgctgatgccgccgtagcgtaacaacagctccagccggatgatgtcgcttttcaggtcctgcgtgagatcggaagaaacaaactgcagatccggcagccattgtcccagactctgaggcgtgagcagatggatttcatgatccggattatcgcggcgaatgttactgacgttaagcgccacggaggcaggcacacggtcgccgggccagtacatccacacttgtttggcaatggcaggcagcgcctttggcacggacatcagcaccacgtcctgttccagtgccggatcgtattcgggcgcactcacggcccgatgttgtctcatcgtccatagcatgcgactggtgaaagcaagtttttcccattgacgccagaggtgatgcaaggaacggcggtgtgaattcatgtttcacctgttattttgattattgtgttttcgccagtcggcaaataaagggttagctgctaacccgtatataaactgagatcaacacagacatcacactgtgctgcaccgtttttattgtcttttcctggtggtactacggtggcgggccgcgaggggtgacacgcacggacgtgagcggccgcgacctctttatttaatagaacataattcaacaatccgctattcctgataagaactttaggataaaacggaaataagcgtcagcctgacataaaaataaatatttattcacgctaatgttttattccgctatggcaaaatcgacggagaacatcgtccttaattttgttgtcataaaacggataaacagtggatggataaaaaacaggatgctgaatcgagatgaaaacaacccttcagcacagttaaccaatttgccggtgcgcgcagcctgacagtcattgtctacgctttagctatacagataaaaaggagatgacatgccgtttgaatctcgaggattactggcgattgacagacaaaccagacgtgcgctgtttcttgatcccgatacctttgcggtgagtcaggccgtggaggttgttcccacgcgcctgcacgagctgctgatgctggctccctggaagaaagcttttcttcccctgtacggcgacgatatgggcggagaattgccgcatccgggccataaagtggcggtgattgatttacggcagcgggcgatcaacgcgtatatcgacctgtcgccgtcaaaagcgccgcacagtggtcagttggggcgcgacggcaaagtgtacctttgttgtgaaaatcctacggcggtggtggtcatcgatccgcaaacgcatcgtgttgaaaagaccattcctgttccgcttgataatactcaccgcctgacgctttctcccagcgggcgcaaactgtttaccgacaatgagcaggacgccaccataaccgtggtggacttatgtgaggcggaagggcgggtaattgataccatcctgatgcccggcccggtttcgggtcttactgcatcccccaagcatccttatctcatcgccagcgcagccgatgtgccgctgctttacgtggtcgatcgtcaaagccatcgcatccgccagcggctggcgcttcccggccatcagcagccctgccagaaggttcgctttagcccggatggtgactatttgatggcaatcgggcatcaggagccgatcgtgacgctttttgatgagttgctgaatcctgtggggcaggtagccctgactcgtcagccgctggatggctgcttcagcccggataagaaacggttactgattacccatgctgataaccagacactgagtgtcattgacctggcgcagaagacggtcatagcgaccactgatgtgggcgcgggctatgaaacgctgagttactttcaaatcggctagataaaaggtcgatggtaaatggccgagctccagtgtcggctgctggcgtgtttctctgcctgccagccgcgtttgcgcagttcgcgggcaatcattttattcataatgccgtggcccagcagcagaacggtgccctgctgcgacaggacgatcaacctgtctgcggcacgtgaggcgcgggcgcgcgcatgctgtagcgactcggtttcacccgcatagccacaaaaccacatggcgcgcaggatggcctgccagacaaaggtcggcaactggaggcggtccgcccgcagtaaaggaatgccgacttcactgaacagcgcatcaacgtaatgagggcgcagtcccaggcgctccagcgaagagtgggcgcgaggtaaaggactgcagacgacaaccgccgctttgctggcgatgttgatgctgcgatccggcggcccgtcgctaaccagcgaaagatcataggcttcgcaccagtccgccagcccctgtgcgcttaagcgtcgggcaaaaggatggtcaggtttaccgtgccgcatcaggataatggtcataatggtttaacggctttctccagtttacgcgccagtcaggtatagctgaggttggattctgtggcaatcgttgtgtctgttgtcatctgccagtcataccgatgtgcgacaacagcaggcgatgaaagattctgacagccagtttggcttaatgttaaaagaaaagtgaacctggtacctgtttatgctgtttttctgtgcgtcaggtcgtgattaaccacctgattttgcgttgaaaacggtatattagcgaaacttgatactaaagaaaatctaacaaattttccgaatagctattgatttatctacgcgcgtagatacactagcttccagtgattgctctcggtgctcgatgcacggtaggccgatcgaggaacaagttacattcgccagatttatacgaccgctgaaatatacagcggcgaagctcgcgatactgcggattccaacaccagggaatctttaactttcctttcatcatggttagccaactgaatgtcgccaccggggcgttctgcttgtagtcagggaaccgtctctcggaatggcatttatcgaactgcatattttcaagggacagcgtttatgacggcacagcattccgttacgcagcaggcatcacagccttctacctccgccgcagatgagcggtttaacacctcagccggccgcaaagacttctggcgcgcgacggtttcttgctggttaggaacggcaatggagtatgcggatttcgcactctatggcctggccgctggcattatctttggtgacgttttctttcctgaacaaacgccgactatggcgctgctggccagttttgcgacctggtcagttggctttattgcccgccccattggtgccttattttttggctggctcggcgatcgtaaaggccgcaaagtcgtcatggtgaccaccattattctgatgggggcgtccacaaccttgatcggcttgattcccagctatgcttccattggtatctgggcgcctgcctgtctggttttgctacgcttcagtcaggggtttggcgcaggcgcagaactctccggcggcactgttatgctgggggaatatgccccggttaagcgtcgtggtctggtgtcttcggtgattgcactcggctctaacagcggtacgctgctggcttcgctggtgtggttgctggtggtgcagatggacaaacaaagcctgctggaatggggatggcgtattccgttcctgagcagcgccgtgatcgccctggtggcgctgtggattcgccgtaacctgcgtgaaactcccgtgttcgagcgcaagaaagcgcaatgggctgttgagcgcgctgaggttatcgccgcacagcagccaggcgtggatacacggcctttctttcagcgtacccgcgcgttctggactatggtcggcttgcgtattggcgaaaacggcccctcttatctggcgcagggttttatcgtcgggtatgtcgctaaggtcttgatggtcgataaatccgtgcccacgacggcggtttttattgcctcactgctcggcttcctgattattccgctggcaggctggctgtcagatcgctttggtcgccgtatcgtttatcgggtattttgcctgctactgatgatctatgcctggcctgcctttacgctgctggacacccgagagccggcgattgtcatcccggttatcgtggtgggcatggcgctggcttcactgggcatctttggcgtacaggcggcctggggcgtagagctgttcggggtgaatcaccgttataccaagatggccgtcgcgaaagagctgggctcaattatttctggcggcaccgcacccttagtggcggcagcgatgctttcgtacaccgggcactggtggtccatcgcgatctatttctcggtgatggcttccattggtttcctgaccacctttgtggcaccggaaacgcgcgggcgcgatctgaatctgccagaggacgccatctgaaaaaaatgatgttacacagcaggcggcaatagatgaggagggcgaagtggcgaaacagataaaaaccactgtgacgcgcagcgacgttgcaaaagccgccgggacatcggtcgcggtagtgagctacgtcattaataacgggccgcgccctgtggcggacgcaacccgacagcgcgtgctggccgcgattgaacagaccggctatcgccccaatgccgccgcccgtgccctggcgtcaggcaacaccaaaacctttggtctggtggtgccgaacatcagtaacccctttgtcgcgtccatggcgcatatgttgctgcaggagtcgctgaatcacggtcacgtgatgttgcttggcgatgcaggcgacgatcgcaagcgggaactggagctgattcaggggctgctgaaccgccaggttgacggcctgttttataacagcgtcgatcgccatcctttcatcgatatcatcaaagccagcgggacaccgctggtaatgctcgatcgggttgaagcccagccgggcgtcagcatgctgcgggttgatgagcgacaagcggcttttcaggtgtgctcacatttactgagccatggttatcagcaggtcggcatgattagcggaccgctggatatgcttaatgctcaggatcgtattcagggctggcgtgacgcgatgcaggcacacgatctgccggttgatgagtcacggattttccctgcgacttatacccgtgagggcggttatcaggccgcgctacgcatgatccatcaccaacaggttccccgcgcgctgtttgccagcaatgaaggccaggctattggctgtatccgtgcctttagtcagcatggcattcgcgtgccggaggacgtagcgctggtctgttttaacggcacaggacagtctgcctaccatgtcccggccttaacgacggtgcgccagccggtaaaagatatggcccgctgcgctatccatatgttgaaagagtggaatggcgaggcgcgcatcgaagcgtttccgcaccatcttgaaattggtgaatcttgtggctgtcggccatcaggccagagtttataaaccaaataatgaaaagactgattattgattgtgatccggggaatgggattgccggggcgaatacggatgacggcctggcactttctctggcattagcctcaccagggctgtcgttagaattaatcaccaccgttgcagggaatacaccgagcgaagtgggtgctcgcgtcgccaaagatttggtcgcgcggttgggatcggcgattcctgtggtgcagggtgcccgtcaggcattgcatgaagatcctgctccctggcgtgaggtgctggacaaacgggttgaacagcttggcctgatgtcattatggcaggacgtacctcagcctgcggcgttaccggcggatgcaatggatgccgcgcaggcgatggggcaactcatctgtgataaccccggcgagtttaccctgattgcgattggtcccctgaccaatgtggcgttggcgatgcagcgttttcccgccatggcggaatccgtggcagagatcgtgattatgggcggtgtttttgccctggaagattacatcaaagacactaattttggcatcgatcccgacgctgcacatcaggtattgcacagtggtgcagccattaccctggtgccgatggatgtcaccacgcaaaccctgctgacgcaggacgatctgacacgcatcacccgtcgggatcatccactgccgcgctttgtgcatgacacgttgcagccctggatcgcgtattcgatgcagactcgccacctggccggatgctggattcatgatgcgctggttgttgcatggctgcttaaccagcgcgtggcatggggaacggattaccgcgtcgatattgagcttcgtccgggcgccacgcgcggtaaaacctggcgctaccgtcagcccctgcggctggacgtcgggattccacctgacagcggcgcgcgggtgcacgttctgcacagcgttgacaatgcgctcctgctgtcaatcattgagcacgcttttaaccaactccccggctaacccacaggcgatacgtcgcctgtcctctttctgttcctcttctctccctcgtcagacatgctttcttacagcctgatccactgcctgacaattgcgcggtacgctctccccataaacatgatgtatacatttgattaacaattacatcactctccgacagcgaccaggaacgttatggacgatgcgccagagtgtctcagagaggagacttctatgcttgactggacatcgacccagcgcaatgtggctttcgcctgttttgccagttggacgctggacgctttcgatttttttattctggtgtttgtactgagtaatctggctcagtacttccataattccgtcaccgatgtgtctgtcgccattatgctgacgctggcggtacgcccgattggcgcgctgctgtttgggcggatggcggagaaatatggtcgcaagcccattttgatgctgaatattgtctttttctccctgttcgaactgctgtccgcctggtcacccaccttcggcgcgtttctggcgtttcgcattttctatggtattgccatggggggaatttggggcgtggcgtcatcgctggcgatggaaaccattcctgaccgttctcgcggcctgatgtcgggccttttccaggcgggttatccctgtggttatctgctggcgtctgtcgtctttggcttattctttaatgcggtgggctggcgcggcatgtttctcatcggtgccattcccattctgctgttaccttttatctatttcaaagtgcctgaatcgcccgtctggctggcggcgcgtgagcgcaaagagagcagtgcgttgatgccgatactgcgtcagcactggaaaatatgcatctacatggtgctgttgatggcctgttttaacttcttcagccacggcacgcaggacctttatccgaccttcctgaaagtacagcaccagtttgatgcccataccgtgagtatcatcgcgatcagctataacatcgcagccatgctgggcggcatcttctttggcacgctgtcagaacgcattggtcgcaaaaaagccattattattgcggcgttgctgacgctgccggtgctgccgctgtgggcgttttccactggctcctggaccatcgggcttggcgcgtttttgatgcagtttatggtacagggcgcatggggcgtgataccgacttacctgaacgaactggtgccggggaatgcaagagcggtattgcccggctttgtatatcagttgggcaatcttattgcatcagtcaacgccacgctgcagtcgcgtattgctgaagcccacggcggcaattatgggcttggcatggcgattgtggcgggaaccgtggcggtgctgatttgcgtgtttgtcgcctttggtcgcgaaacgcgtggaataaaaatttccggcgttacggcaaagcagccgcattaatgcgtttcacagacgtccacccattttgccgcagtgagttcagccatcagctgcggcgaaatgcgtacggcactgtgaaccgcaccggctgcgggcaagacttcatcaaagctttttagcgagatatcacaataaacggtcaccgggttttccaggccaaagggacaaaccccgccgacgggatgcccggtccagttaatcacttcgtccacgcttaacatccgcgctttggcacccagaaccgcttttagtttgcggttatctaaccgcgcatcgccacgggttaccaccaggatcacctcattcttcaccttaagtgacagggttttggcaatttgccccggtgttacaccgtgaacgcgagccgccatttctaccgttgccgtactgtagggcatctcaatgatgtcgatttccggcgcacgctcggcaaaaaactggcgtacagactccaggctcatttttatctccatgctaattgaaggcgtaaaaattgccacaagcctgcaagggtgtaaacgagatagcgaaataataggtaacagaatgcatagcggcgatgaaagtcaggagaccgcgggggaaaaacagggtgaggggaaaaggcgggtgcgttttttttcagcgtattatcgggagcggacgccggataacatcgctatccggcgcgcgttttatatgacttcagttgccgtggtgctggcgatgccgggaagatcttcccaggccagaatggtatttcgtccctgatttttcgccacgtataatgcacggtccgcattcgctaccgcctggtcaaattcattatcgtaaatgggcgcaataccggcactaatggtgacgtgggtagaaacacgttcattaaacaaatgcggtatttccaaattcaccacatattggcggatgcgttcagccagcttcatggcgatggaggcgttaacattggtcattaatactaaaaactcctcaccgccgtagcgtgttaccacatcgcgtgagcgtacggcatcacgaatggcaacggaaacccgagccagcgcctggtcacccatggcatgaccataattatcgttgtaagccttaaaatggtcgatatccagcagcaagacataatgactgccggcatgattatccagaatgttatcaaggcgattctttagcccacgccggttatataagccagttaaaggatcgagcatactgagatcgctaaacgactctttttcttcatacagttgatacattaagcgcagcgtaaaatcttccgagcggcggcgcatcagatgctgcagtgaaaagccaatcaacggcagggcaatagtcaataaaatcaatggcaaatgctgtccgtggtccagcaacagcacggttagcattgacggcgtaatgtgcaggcagaacgccaccaaataatcactgagtgcaatggcgctgataaagaaaacgcacagcaaactgacaatcaaaaaaaatccatcattaaataaaacacaatgatagcgatcctgaatatgccatgcccacaatccccctaagatgagcgcaacgggatttagcaggggtaattttagtttagtttttattaaacaggtgctcagcatcgtcatgctaaagaacgccactatcatcaccggcaacgtggcctgtgattcactgttttccgccaaagggagcagacaaaatagcgaaacggatgcgtttaaaaacaaaaagagcatcagcgacaggcggtatttgctgtgtttcaattcatcataagattctattttcattattcatactcgtgacagccctgaaataacaaagcaaaaaccggcgcatgatttcggccggtcgacagacgttatattgatgttataaagaatgtagtcggtcgcaatttagcattttcttgtttaactgtcatcttcctgcctgcctgtaaaaaaacaagctgaaagttgagaatgattatcatatgctaatgggaatggttatcatatcgaccactggcagaacggttcactgacgggcaagggggaaggcgatgggcggtttaaaactggatagtgcatggggaagcatgctggcatgtgcagcaataccggcaataacattctggcagcccagctttgagcagtggcggggcgtgatgctgctcgcattgctgctgacactgttcatgctgtttaatcagcgcatgcggcactatgtcttgctgccttcctgtctggcgctggcaggtggactcgcggcgataggcgtaaaatttaccggtctgtagttgggattttaaaacgatgatgcagaggggagaaacaaggtggaaacagcggtggagaggacaacgttggtgcgaagagagggacttgaaccctcacgtccgttaagacactaacacctgaagctagcgcgtctaccaattccgccaccttcgcatcgcgttgtcttttcatatcaccgcaatggtgcgaagagagggacttgaaccctcacgtccgttaagacactaacacctgaagctagcgcgtctaccaattccgccaccttcgcgcagtgctcgcgatatgaaatttgtgattttggtgcgaagagagggacttgaaccctcacgtccgttaggacactaacacctgaagctagcgcgtctaccaattccgccaccttcgcatacccgcaacacgttaccgtattacaaccacggaggcgcattttagagattttactcaatgcgtcaacacatatttcgccagacggaaacgatcgctgcaaaaagcaacgttttcagcctggcgagaggcaaaaagggcgaaaaaggcacaaaaaagggattaacgggttttggcaccgcgtccgtaaactgcacgataaactttgaagcgaccggtttgcgccagcacttcatgattgccaaaggcttcatccagcacctggggataaggcaggaaggcgttagcgacaatgcgcaattcacctccgctgttcaggtgcttaacggcgccacggatcagggtttgtgcggcatccagactggtctgtgtgccttcatggaacggcggattggagataatcatgtcaaaacgcccggtgacgtcggaaaaaacgttactggcaaacacgtcaccttccagaccattggcagccagcgtggctttactcgcttcgatggcggcggcatgaacatcacacaaccacaaacgcactttgggtgagcgggccggtaatgaggcggcaagcacgccagcaccgcagccgatatccaacactttgcctttggtatgcggcgtgaatgtcgaaagcagtaaggcgctgccggcatccaggccatcgcgactgaaaacgccgggtaaggtatgcaccgtcaggccatccaactgatagctgttaccaaaggccgtggcatcaaaggcaggttgcttatccaggcggccatggtaaagaccacagcggcgtgcgctgtcgattttctccagggtagcccacgtctccagcatgccttccgcactgcgtacgccgctgcggttttcaccgacaacaaagatatcgcagccaaccggcagcaacgacaacaggttttgtaactgaaactgcacttccggtttattcttggtccagaagtacaccagcgtatcgcagccctgaacatcttctgcctgagcgaccagtccataacgcgcctgttcccccatgcggcggctcaggttttgccagtgatgatattgctgagtgtgcacgcgtgaagaggcggtctccagctgtgcgggcaggtcatcctgcagatcgccagcaaataaaacgtggcgggcggtaaattcatcactgtggcgcagaatgacttcgctggccggggtaaaagcagacatgtagggctcctgtaagatctgagcggagattatagtggtttgttggcgcatgttcgatgggtttgctagcatagcgtcgcattcagcgagcagagcaggtatatcatgacgtccaggcgcgactggcttttacagcaaatggggattacgcagtatcaactgcgccgcccgcgcgtgctccagggcgagatcgccgtaaggcttttacccgatacgcagctgattatcgtggcggagaatccaccaggtttgcaggagcctttcctgcgcgatgtcctgcacacgctcagtctgaaaccgactcaggtgatgaccgtcacgcccgaccagctgcaaatgctaccagaaaccctgagctgtgcgggctggttactgggcgtggaaagcgaacaaccctttaatggcgtggcgttatccagcgcttcttttaatgaacttctcagcagcggtgccgcccggcgcgcgctctggcaacaaatgtgtgatcatgacagccatttctttcctcacgcctgacgctattcccgacgcttttgctatcgaatgccgtagccacgcctttccctggcgcgaagagacctttgccagtaaccagggcgaacgtttcctgaacctacggttagatgtcgataaccagatggccgccttcgccatcacccaggtggtgctggacgaagcctcgttgtttaatattgcggtcgacccagcgtatcaacggcgtggctttgggcgggcgctgctggagcatgtaatcgagcaactgattgcacgcgatgtgatgacgttgtggctggaagtccgtgcctcaaacgcccctgcgattgcgctgtacgaacagctggatttcaatcaggtcagccgccgtccaaactattatcccaccgccggtggccgtgaagatgcactgatcatggcgctgacgctgtagtcgtttctgaggagttttgatgttagataactgggattgcatcctgtttgatgcggatgacacactgttccactttgacgcttatgctggcttacaacggctgtttgccgggtacgatgtgccgtttaccgaccaggattacctcgattaccaggcggtaaataagccgttatgggtcgattatcagaatggtcagttatcggcgcaggagctgcagacccgccgctttgtgagctgggggcaaaagctcagcgtggcgcctgacatcctgaataacggttttctgtcggcgatggctgaaatctgtatgccgctggaaggcgcagtcagcctgatgacgctgctgcacggccgcgtcaaaatgggcatcatcaccaatggctttaccgcgcttcagcagcgtcgcctggaacgcaccggttttctcgactacttttccgctttggtggtttcagaagaggtgggcgtgcctaagcccgatgccagaatctttgattatgcgctcacgcagatgggaaatccccagcgcaatcgggtattgatggtcggcgatacgccagaatccgatatcctgggcggtatgaatgcgggactgaaaacctgttggatcgatcacggtacgcgcccactgccggaaccgattaaacctgactggcgggtaaactcattaacagagctggaagccctgttaaaagcctgaatgtcacctgtcacacccagctagtgtcgtctgcgaaaggcccgtaatacgggcctttcgttcatattcgcgcgctatcaggcagatggcttagccgcgtcgtcctttttctcgtcctcttcatcatcctctttcacgggcgtactggccgtgagcaggaacggggactgctgccagcgcgtgcggcgatcgcgcagcaaggtacggctgaggataatgccaatcgccagcgccagtagcatcatcaggcgcagaatattggtggtgttatccacctggcgcgattcggtgaccaacacgtgggtatccagggtgatacgcagaaagcccgtcgggccgctgccgccgctcaggggttgaacgatctgatgattgaagtagcttcccgcccgtttgccatccagcgccagccgatcgcgcacattgatgttttcaccgctgtgcgccaccagactgccgtcaccggcatagactgaggcatcaagaatgcggctattcgcggtcatctgattaagaatggcctcaatctgaccacgattatcttcgctgttatccatgagcggtttcaggctgaatgccacctggcgggtaagcgtttgtgccagctcctcggcctgttcagaacgggccatttgatgcccaaggctaaaccaggatgcgccttgcataagcaccaccaacagcgccagcgaaatcaaaacgatcaccgtgcgatgtaggcgaaatttcagtgcggttttagccattaattatccgagtcacgtcacaacagaaagcctggatattatgttgccagaagcagcgcagacaaggtagcctcttgcgtggttttgttgttcctacaggagccctgatgtcaaatcatcttacctggtgcgatctgcctgctgatgtctctctctggccggggttgcccctttcattaagcggtgacgaagtcatgccgctggactaccgcgcgggtcgtaccggctggttactctatggccgtggcctggataaacagcgtctgaccgactaccagcaccggctgggagcggcgatggttatcgtcagcgcctggaacgtggacgactaccaggtgattcgcctggcgggttccctgacgccgtttgccagcaaactggcacacgaactgacgctggatgtcgccccgctggggaaaatcccgcatctgaaaacgcctggcctgctggtcatggacatggattccaccgcgattcaaatcgaatgtatcgacgagattgccaggctggccggctgcggcgagcaggtggctgaagttaccgaacgggcgatgcgcggcgagctggattttaccgccagcctgcgtcagcgcgtggcggcgcttaaagatgccgatgccaatattctgaagcaggtgcgcgatgcactgccgttaatgccaggcttaaccacgctgactaaaaaattgcaggcgctgggctggcaggtcgcgattgcttccggcgggtttacctattttgcggagttcctgcgcgataagctgcacctgtcggctgttgcggctaacgaactggaaatccgtgacggcaaactcaccggtgaagtgctgggccagatcgtggacgcgcagtacaaagccgagacgttaaaaaagctggcaaagcggttcgacattgcgccagaacaaaccgtcgccgtgggtgacggggcgaatgatttgccgatgattaaagcctctgcgctgggcattgcttaccatgccaaaccaaaggtcaatgagcaaacggccgtcacgattcgtcatgccgatttgatgggggtgttttgcatcctgaccggcagcctgattcacgaagagcgttaactgaggagttgatttggccaaagcggcaaaacgcgcatttgtttgtaacgagtgcggcgcagattatccgcgttggcaggggcaatgtagcgcctgtcacgcctggaacaccatcaccgaggtgcgcattgccgcctcgccagcggctgcgcgtaatgagcggctcagcggctatgcgggccatgccggaaccagccgggtgcaaaagctgtcggaaatcagtctggaagccttgccccgtttctcaaccagctttaaagaatttgaccgcgtactgggcggcggcgtggtgccgggcagcgctattctgattggcggtaaccccggagccggtaaatccaccctgttgctacaggtcatgtgccgcttagcgcagagtatgaaaaccctgtacgtcaccggtgaagagtcattacagcaggtggcgatgcgcgcccatcgtctggggttgcccactgacaatctgaatatgctgtcggaaaccagcattgagcagatctgcctgatcgctgagcaggaagagccgcaaatcatggtcatcgactccatccaggtgatgcacatggcggatatccagtcttcacccggtagtgtggcacaggtacgcgaaaccgctgcttatctgacgcgttttgcgaaaacccgcggcgtggcgattatcatggtgggccatgtgaccaaagatggttcgctggccgggccgaaggtgcttgagcactgtatcgactgttcggtactgctggatggcgatgccgattcccgttttcgtaccctgcgcagccacaagaaccgctttggcgcggtgaatgaactgggtgtttttgccatgacagagcagggcatgcgtgaggtgagtaatccctccgccattttcctgtcgcgcggcgaagaagtcacctctggcagttcggtcatggtgttgtgggaaggcacgcgtcctttgctggtcgagattcaggcgctggtggatcattcgatgatgggcaatccacgccgggttgccgtcgggcttgagcagaaccgcctggcgattctgctggcggtattgcaccgccatggcggattgcaaatggcggatcaggatgtgttcgttaacgtggtcggcggcgtgaaagtcacggaaaccagtgccgacctggcgctgatgctgtcgatggtctccagcctgcgcgatcgtccattgccccaggatttggtcatctttggcgaagtcggactggcgggggagattcgcccggtgcccagcggtcaggaacgtatttcagaagcggccaaacatggcttcaagcgggcgatcgtccctgcgggtaacgcaccgaaaaagccgattgagggaatgcgcgtctatagcgcgaaaaagctggcggatgccttggctattcttgatgatctctaagcttttccgtatgcccttttgtcgttatacaaaagggctggtgagggacaaacgtcctcacgtctttgatcatttcttgcaggaggcaccacatgtcggcgtttgattatttaaaaacggccattcgccagcagggccacacgctccaacaggtggccgatgccagtggcatgaccaaagggtatttaagccaactgcttaacgcgaaaattaaaagccccagcgcccaaaagcttgaagccttgcaccgctttctcggcctggaatttccccgccgggataaaaaaatcggcgtgatatttggtaagttttatccgctgcataccggccatatttatctgattcagcgcgcctgtagccaggtagatgagctgcatatcatcatgggctatgacgaaccgcgcgatcgtgacctgtttgaaaacagcgccatgtcgcaacagcccacggtcagcgatcgcctgcgttggttactgcaaaccttcaaatatcagaaaaacattcgtatccatgctttcgatgaagaggggattgaaccctatccgcatggctgggatgtgtggagcgcaggggtgaaaaccttcctggatgagcaggggattgcggctgactgcatctataccagtgaagcaccggacgccgagatgtatcagcaacatctgggcattcagacggtgctgatcgatccgaaccgatcctttatgaatatcagcggcacgcagattcgtcaggaccccttccgtttttgggattacatccccactgaagtgaaaccgttttttgtgcgtaccgtggccattctgggcggcgagtcgagcggcaaatccatgctggtgaacaagctcgcaaacatcttcaacacctccagcgcatgggaatatgggcgggattacgtcttttctcacctgggcggcgatgagatggcgctgcaatattctgactacgataaaatcgcgctcggtcatgcgcagtacattgattttgcggtgaaatatgccaataaagtggcgtttatcgataccgatttcgtcaccacgcaggccttttgtaaaaagtatgaagggcgcgagcatccgtttgttcaggcgatgattgatgaataccgtttcgacctggtgattctgctggagaataacgtgccctgggtggccgatggcttgcgcagcctgggcagctctgtggatcgccgtgagttccagaccatgttgatatccatgctgcgtgaaaacaacatcgacttcgtccatgtgcaggaagaagattatgacacgcgcttcctgcgttgtattgagctggtgaaaggtatgctgggcgagcaaagcgcgctctgagacaatctgtttaccgacataaagggccggaggatagccgtatctctgaccctttctccttgtgttatctttataataatggcgatttttccggcctgttgctgggaaataaggcctttcacatcgtcgtgcgcaaccgaatatcgtccgtaacaaagtcaaacaaaaaaaatttttttgaattctgcggcaacattattacgtatttaaatactgatgttatttcatttcttctgtgtgtttatgttaaatgtaagttcaatatttttaactggtttatattaagggaatattcataagatataaataatgatatacccggatgtaacgacatgaaaaagatcagtattggtagcgatgcggtattttatcctgggaaaagggaaataatcagtcataatcagacgttgaagttgcattcttctgcctcttattgttttgaattactgatcgcacgtcagggtgaaattgtcgatcatgagtctttttaccagtatgcctggcgtagatttgggatggaggtcagtgcgaatgccttatatcaaagtatttctttggtcagaaaagcgctactggcatctggtattcggcaggatgtgatcagaaccattccgcgccgcggctttatgctgtcaaatgccattctcattgaagaatcgacaagcgtgcctgtagcggctattccggataatacgccattatcagcagagggactggaaaacgtatctacagaagacgctggcacgccagatttaagccaggccagtgggcaggacgttccccaacatattcctgagcctgctcttcaggtcgatgagaatatgtcagaaaagccggttaccgatgcgctgcataatgcatccggggcagcttataataccggctatccagagtctgccgcgttagccgtcggagagttgcctgctcaacaggccatctacacacgcaacctgcttatggttgtgctgacggttatgacgattgtgatgtgtggtatggccattgtgaccttttccctttaccggaaggagatggatttcgtaaagcggtttgatatgaacggatgcgaaatatacggtaatgaaaaagcagataacagtttagtggcccgcatcgctattgatattcattcgggatgcacggaaagaaggaagatttatatcaccgcctttaccaacggtgaacgaatctccgtattgcaatgtaaaaacgcaatttcactattcggttcacctgactgtgtgtcgtattattatataaggagaaagtggtgaagttgacgttttggatggctgtgctgacgatggccgtagccggtgttgtgatgcttttttttcgccaggattatattcattgcattgcaaacatcaattacataagaagcggtgaaagattttcactgatcgtttctcacgatatgcgcaacgggcacggcgttttatccttagcggggcgattgaccggcgataatcaaaaagccatcagcatgagtaaaattatccggtttaattatcatcgtgatggcgatctttatctcgcgcagtcgacattgattgagccatccccggataatcaaatgagtattgagcaacaagaaaaatggcttccggcgttttttatcaccgtgggggcgacattccctttcgtcattaaacggacgggcatcgatacatgggtattttattctggtcctgttccgctcttcatttgtgaaaaataaaacgaccaaaaaatagccgataagccgtgcagagcataaacgttggacctgtagttatcttatgaaatttatcttttctgcaacacagggataactttatgcttttgattttaataaaattatatcttcttaaggtcttgttcacataaggtcagaacacttcacatacagcctcgctatttcgccccttatgattcccctgccaatgagcatgttatcaacctaaataataagagggaatcaatgaaagccaggtctttatcacgctgtatgtattttgctttgtgcggtgtaagtttactttcttttaacacctttgccgcatcgcaaaatactattcgctttcagggtgaagtcaacgcgcaaacctgtaacgttaatataaacgatgcaaccggtagcccgattattctgctgcctacggtatcgacagcctcgttgaacgcggcgaaatccaccgccggtaaaacaccctttacgatcaatttaacgggctgtgttgcgccggcggcgggtacaacccaggcaattaatatcaatctggcgggaaataatatttcctccacgggggatttattaaataccggcacagcgacgaatgtcgcactgcgtttactggatagtagtgacaaaacgatcaatctgtcaggtggcacggcgaccgtaaacggcatgtcgctggccagtggtagcaccagtgcatcacaaaatttttcagtcgaatattacagcgactctggaagcgctggagcgggtacggttttgagtagcgttcaatattctgttagctatccataactatcaggccccctttagccgagggggcaggagaaacctgtgttcaagtctcttgttattctgtttctggctttatccgctcccctttgtcaggcaagcgtcgtgctgaatggcacccggataattattgatggtgcgaaaaatgaaaaaaccattcagtttaccaatgcgggcgatcagcctgcgcttattcaaattcaggcgattaatcctgacgcggcgtccacactgccctttgtggcgctgccgcaaatttttcgcatcgcgccagccgccggtcaaacggtgaaagtcaaagtcaccgagaataatttaccgcaggacagagagtcgctgttctacatggactatacagaaatcccctctgtgaaaaagggcgatgaagataaaaataaactctatctgattattaagaacagggtaaaagtcatcgttcgccccaggcaactcgatttctctgtggataacgtcaggcaggcgctttcttatcgtattcaggggcgagatattctcttcaaaaatgcctctcctttttacgccaatatccgcgcgttttcactgattaagggaaataagacgattgcctgggacgatgccgtaacgctcgcgccgtttagtgaaagcaaggtcacgctgcacagttcgtcatccctggtgggatacgcccttaccgccctcctgatcaacgattttggtgctgacgaaaaaataaacctgaacgaaaaatagccgaaatgaataaagcttccttattcttattgttcgcgttcagtctgatccctgccagggaaagtcaggcggctgatgcgcaggatgactatacgtttgatccttcattagtgcgcgaaatgatgccgggacaggttgcgatgccggatgatgcgcaggatgcctggtttcagccgggtcgttatgatgtggaactttacctcaatggtaagtttcaacaatccacaaccttgcagatcgtgcgggcaggcggaccgctctccgtgtgtcttccgtcgccgttttatcacgcgtttggtgtcaaagcgcattatttgtctgccctgaaggcgacaggctgcgtccggccagacgcgcttttacccggcgccgccgttaacgtcaataccgccagcttacgcgtcgacgtatccatcccccaggcgatgctggttcagcggcctgtgggctatatcgcgccggaaaacctgacggctggctcgaccatagcgttcgtgaattacaaccttaaccagttctattcagattacaaaaatgcgcagcgttttgaatccacctatctgggcatcaacagtggtatgaacgtgggaatgtggcgttttcgtcagcagggaaacctgacccatgatgaatggggtaatcgctggcaaagtgccagagcctgggcgcagcgggcattgccttcgttgcaaagtgaggtcgggctgggggagctttttagtcagggcgacttgtttaatgccgtcagtttcaacggtgtgagtctggactcggacgaccgtatgctgcccgattctgttcggggctacgccccggtcgtgcgtggcgtagcaaacagcaacgcacgcgtgaccgtctggcagggcaaacagcggatctaccaaaccaccgtgccgccggggccgtttatcatcaacgatctcagcccggtcagctatggcggcgatctcaaggttgaggttcaggagtctgacggcagcctccatcagtttagcgtgccctatgcggtgttaccgcagtcgctgcgtccaggccgaaccgactacaactttgcggccggtaaagtcagggattacagccaatacaatacgtttacagagttaaccgttaagcatggcctgacaaacgccattacccttaacggtggcgcgcgtctgggtgagcactatcatgcggtgctggccggtggcgtttgggcgtccgatttcggtgccgttggcttcaacagcgcctactctgaagccgacctgaacggcggcgagacgaccgagggatggcgctacgaactcagctacagtcgtaccttccagcctacccagaccacgctgacgtttgccggctatcagtattccacccagggctatcgggatctcaatgatgttattgcattaaataatgcagaaacgccgggccgcaacaatatcagtagcgaatatatgcagcgtaatcgcctgcagatgacggttaaccagacgctgggtgagtggggaaatatctatatttccggctcgaagcaaaattactacgacggccgttcacgcaatacgcagtttcagattggctatggcaccgtgctgccaaaaaatatcgcgctgaatatttccctgtcccgccagtattcgcgcagagcttactcaaacgatccgcgtatggccgtgatgccccaacattcagacgacaccttttataaagatacccagtttcaggtcagcatctcggttccgttaggttcagaagccacgtcgccttatttagcgctggggggaacccgtggaagccaaaatggcagtaactataacgcctcactcagcggaataagcggcgagagcggcaccagctacagcctgaatatcaatcgtgatcagcaacaacgcgacacaacgttaagtggcagcctgggcaaaaaactctcagaagccagtctgaccggtacggcatccacatcctcacggtttaagcagatgtccgtcaatgcgatgggcgcggcggtgatccacagcggtggtgtaacgctgggcaattatctgggtgacacctttgcccttgtcgaagcgaaaggggccaggaatgctcgcattttgaatagccagggcaccgaaatcgatcgctttggttatgccctggtgccgtcgctcaacccttatcactacaacagtatttcgttgggggccagcggcagcgatagccatgtcgagattcaggacagtgaaaaaatcgtcgcgccttatgccggtgcgatggtgaaggtgacgttcagaaccttacgcggttatccggtcatgttaaagacccgcaccaatcgcgagacgacggtgccggtgggggcggatctgctcgacgatgcaggcaaccgggtggggacgtttggtcagggcggcaatgcctggttacgcgtcgcgaaaacccagggacagctgaaagccgtttggggagaggacgcgaaagcatcctgtttgattaactaccacatcccaaaacctaaacctgatgcggtgattacctacgcggatgctgtatgtcgtttttaaaatgtaaggtgttaatgatgaagtacgttttagctgtgatggcatgctttcttttggcggcatggctacctgctcatgccacctgcacgcgggtgaatccggtcgatcagggatgtgatgcctgcggagcgtccctgaatttcggcaatatcggcttgatgaatctacgttatcagcccgtaggcaccgtgctggcccgctcggtatttcgtgtggtaccggccatcaacaatgccaatccggatcgcgtgttatatcaatgcgatctggcagataaagaccagctgtttgaagtcttcgccaccaatggcgacagtaacgttggcggagcctgggacatgggcggcggttattttcagacttattttcccttcaccgcgttaaagctgattcatgtgcgtagcggtaagccttttacccgtatctggcaaaaagtgccgctgacgcagtatgacattcaggggaataaaatcctgatccgcgggcgggatttcagccccatcagcgccgaattaatccgtacctctgaaaacaatcgcacgccgggttattcgtcgtggggatgcccggcggcggcggcggacaattataccggctcgtacaactgcaatcagccgaacggctatgtagtgtttatggggccggggatggatgtgcccgaagcgggccaggacagctggaatcattttgaaacctgggggtccggacgctatatggctttcggtatgaataccgcgccggtggccaccctgacgcaaaacctcacccagggctgccgggttgaaaattacaccgcgaacgtgattttccccagtatcagtattaatgccctcaatgaagggcaaaccgcgacggctccgctcagcattacgctggcctgcgcggcggggacagataagatttccgggataaactcaggccaactgtcactgggatttcaacccagctacgccgcgtggttgcaggcacagcagttaggtctgacgtctggaagtgggatttccagctacctggtgtccgatcactatgacagtttgccttcactggcgaaaggcgtggggattcagctgaaaacctccgggggaagtgcggtatcgtttctgagctggagcagttttagcagcaatgcaggatggcggccggtgctggaggacgcgcaggttattagcagcggtcagccgagtgacgaaacgctgtatcagcgtaatttcactgccagtcttgcaaagcttcctggacaaacggtcacggcgggcaatgttgatgcgacggcctcgatcctcattcggctgcaataatatgaaaaagatcctgctgctcgtcatgtgcatcatcactcactcccaggccgcggttattccgcagcaaagccgaatcatctttcatcccggcgaggtgcaagtcccgctgttgttggtcaacagcggtgaatctcctgtcctgatccagacctgggtcgacggcggctcaccggaaacatcgcccggcagtaaagcctttccttttgtcgcgctccccggggtttttacgctgaacaaggatgaaaaaaaacagatcgcggttttgcgcaccgagctggccgcacagcttcccaccgatcgggaatccctttactggctcaatctttacgaaatcagttcagtgaaaaaaagcagtctgcgggcgggcaacgataagatcagtgtggcgctgaacacccagcttaaagtgattaatcgcccgtttacggattcgatgccttttgcggcacgcgttaaggcggttacgtttcagatcaggaaaacacaagggcagttttttattcaggccagcaatcagagccgttacttttttaccccagggaagatgacggcgacggcgggcggaaaacattatcctgtttacctggacggggataaaacgctggcacctttcgccagtaaacgttatcccctgcttggtgactcgccgcttttagcgacaggcaacgctgtgcttaacttcaccgcgctggacgaccaagggaatccccaggcgttcacggccaacctgaacctggcttctggctcaccgtgaacccgccacgcgcggatggccgtattggttgccacccgcctgcgtcatcagtaaaccatgacgaccttgccgcgcatatggccttccagcacgcgctggtgggcagcctcaagcgtttccacactcaggccgtgaagcgtttcgttcagcgtgctttgcagcttgccgtcgtccagcaggtcggcgacggcattcaggatttccccctgctgcgccatgtccggcgtgttgtacatgctgcgtgtgtacataaactcaaagtgcagcgcggcgctttttaacttcagttgatccatcgacagtggatgttcgttctcaacaatggtgcagatgtggccctgaggagcaataagctggctcatggtgtcccagtgaccatcggtatcgttgagacaaaaaatataatcaacctgcttaatgccgtgcttttccagctcagcagccatgtctttgtagttgagcaccagatcggctccgcgatcgcggcaccactgggcggaatcctcccgtgacgcggtggcgatcactttggctttactgcgcattttcgccagaggaatcgccagtgaacctacgccgcctgcaccgcccacgatcaacagcgtttgatcctcacgcgccgcagccatatccagccgttcaaacaggccttcccatgcagtcagcgccgtcaacgggatagccgcagaagcagcccagtcgagttttttcggtttatgaccggtgatacgtgaatcgaccaactgctccgtgctgttactgcccggacgagtaatatcgcccgcatagtacacttcatcgcccggcttaaagccgctgactttactgccggtttccagcacgacgccgctggcatcccagccgagaatacgtggtacctgcaaaccatttttgatcgcccctttgtgaactttggtatcgaccggattgaccgaggcggctttcacctgaacgcgcaggtcatactcgcctggcgtgagggtttccgggaaaatttcaacgaagttttttgggttttctggatcaacagcaattgcgcgaacagacataatttctctcctgtagtgttctctaaagtgtagaaccccgaggcgatgctgataagatggacaatagttattacagtgttcgtctgaggtgaacaatggcgtttcgtcagtggcaggatatggcgctgtttgcgttagtggcggagtgcggcagttttaccgccgcggcagaacgggcaggcttaccgaaatccagcgtcagccagcggattagccagcttgaacagcggctgggcatccggttgttaaaccgcaccacgcgccagctcaacctgacctttgcaggggaacgctatctgctgcactgccaggagatgatgcaggccagcgagcgcgccgaacaggccattgccagtctacgggaaaatcccagcggtcgcctgcgcatcaccagcccggcgggcattggcgcaaccttgctggcccgctgcaacgctgcgtttttacgccactatcctgacgtcacgctggatatctctgtctcggatgatattcgcgatctggtgcaggacggctttgatctggccttacgcaccggtcagccgcaggagtcgtccctgattggtcgccgcgtcggctactgccagcgctcgctggtggccgcacaagcttatctggaccagcatccgccgattacccatccccaacagttggccgcgcatcgctgtattgcgcaccgggcctggaacgagtgggtgctgaaacgcgacgatcaatatcatcgttggctgcttccgcctgcgcaccttaccgataatttactctatgcccgtgagtcggcgttgggatgtgccggtattacgctgctgccccgctttttaacggacggcgacaggggcgatgcgcgtctggtaacggtgctgccggaatgggaaatggaggggaatgaactgtggctggtgtatcccagtcgtaaactgaactcgcctgcgctgatgaaatatattgaatttgctttgcagtcgcctgtgttccgcgaattttaccgctgaagaaaagagaagggcggcatcgctgccgccccgcaattacttagtaatacgcttgtacttgatacgtttcggctccagcgcatctgcgcccagcgtgcgtttcttgtactcttcgtattcggtaaagttaccttcaaagaattcgatcttgccctcatcctgataatccagaatgtgggtcgcgatacggtcaaggaaccaacggtcatgcgagatcaccatggcgcagccagggaactcaagcagggcgttttccagcgcgcgcagggtttcaatgtccaggtcgttggtgggctcatcgagcagcagcatgttgccgcccacctgcagcagttttgccagatgcagacgaccacgctcaccaccggacaactcgcccacgcgtttgccctgatccacgcctttaaagttaaagcgtcctacataggcgcgacttggcatttcggtgttgccgatacgcataatgtcctgaccgccagagacttcttcccatacggttttggcattatccatgctgtcgcggaactgatcgacagaggccagcttcacggtttcacccagcacaatctcgccggaatccggttgttcctgaccggacatcatgcggaacagggtcgacttaccggcgccgttcgggccgatgatgccgacgatggcccctttcggtacagagaacgacaggccgtcgatcagtacgcggtcgccgtaagatttacgcaggttgctgacttccagcaccttgtcacccagacgggcacccggcggaataaacagttcgttggtttcgttacgtttctggtagtcggtgttgttcagttcttcaaagcgagccagacgggctttacctttggactgctggccttttggccctttgcgcacccactccagctctttctcgatagatttgcgacgtgcggcttcggaagaggcttcctgcgccagacgggcatctttctgctccagccatgaggagtagttcccttcccacggaatgccttcgccgcggtccagctccagaatccagcctgcaacgttatcaaggaagtaacggtcgtgggtaatcgccaccacggtgccttcgaagtcgtgcaggaaacgctccagccaggcgacagattctgcatccaggtggttcgtcggttcgtccagcagcagcatgtctggtttttccagcaacaggcggcacagggcgacacggcggcgttcaccaccggacaggttcgcaatttttgcgtcccagtcgggcaggcgcagggcgtcggcggcgcgttccaactgggtgttcagattatggccgtcatgcgcctgaatgatctcttccagccgtccctgctcggcagccagcttatcgaaatctgcatcttcttcggcgtataaggcatacacctcgtcgagacgtttcagcgcaccgaccacttcggccagcgcttcttccacggactcgcgcacggtgtgctcaaggttaagctgcggttcctgcggcagatagccgattttaagaccgggctgcgggcgggcttccccttcgatatctttatcgataccggccatgatgcgtagcagcgtagatttacccgcaccgttcaggccgagcacgccaatttttgcgccggggaaaaagctaagggagatgttcttcagaatatgtcgctttggcggaactactttgccgacgcgatgcatgctatagacgaattgagccacgttgtattgagcctctgggtctgtttgtcgtgtggatgatgtcgaagtttagcctttttcgctgcctattcacagccgatgcgccgggataattccgtgccggggcgcagtttggcataactgtttgatttgtgtccgctgtccgaccgggcggcaaaaggccgcttccggtgacgtgcgtatcatgacgagcatatatagcgcaggtgacatgaatccacctgagcgtagcagcaggtcattgccagtgcgtgacaaaacgacgtcagggaaggcggacgggaatgtgttgttgcgttaaccactgactcagtgccggttcaggcgcgctgtcgctgaccagtaaatcaaagcgggacagctcgccaatacgcgcgggcaggactttgccatatttgctgctgtcggcgaccagaatacgctggcgggcgcgcagcatggcatggtgcttcatcggcagttcgttgaggttatagcaggtcgccccctgatctttatccacgcccgccgcagagataaacgccagggtgggacagagatcatccagaatggaatgcccgcccacgggcgtgaacagggcattgtcggcatgaaattcaccgccgctcaggatcacattgcaggccggtttctcttttagcgccagaaaggtattcatggcacagcagatggcggtaaagggcagggcatccggaatcgcatccacgacatagggcagggtggtgccgcagtcaaaaaacaccgtgtcgttttcactaatcaggctggcagcagcctgagcgagtcgctgctttctggctgcattttgtccgtgttggtcggagatgaaatagtgcccgggatggctgcgcggatcgctgacgatataaccgcccagcaataccacgcttgaggtcggttcacttaagtcccgacgtacggtcatttccgatacgtccagcagctgtgccgcatctttcagatgtaatttatcggtgcgcttaagtgccagagccagtttacgaatgcgttcgtcgcggcgggtttccattgtcatctctaaacctgtattccttgaagaagacgtcatacgtcctggcctgtcacatcgctggcgtgccgttaaccttacctgaaaccgccgcgtttttactcagcccataacaaatttcaaaaaatttaaggcgttgcaggcttttcaggcaagatttttatcttacccgcaatgccttcaccccgcaaacccgggctgtggccactgaatgcccgccttcgcgctacaggtgtttgttataatattaacattaaacccgggcgcattccggctttatcgatcagttatgtcacaatatatgtgaaatttatcacataattaacctctgtgaattgttagtgttatttttataacattttagcggtcttttaccgggggaagaatggacattgcggttatcggttcaaacatggtggatttaatcacctataccaacagttttcccaagccaggggaaacgctggaagcgcccgattttgcaatgggttgtggcggtaaaggggccaatcaggccgtggcggcagcaaagctgggtggcaaggtaatgatggtcagcaaagtgggcgacgacctgtttgcgcccaccacgttagccaatctgcaacagcagggcgtggatacacgtttcgtcaccaccgaggccggtgtctccagcggtgtggcccccatctttgttgatgaccaatcgcaaaaccgcatcttgattattaaaggcgcgaatcaacatctcaagcccgcggacatcgatgctgcggctgaggcgctgaagggctgccggttaatcattctgcagctggaaattccgctggaaaccgtttactacgcgatcgattttgctcgccaaaatgctatccgcgtcatcctcaatcctgcccccgccctggctgagctggatatcgcgtatgcctgccagtgtgacttttttatgcccaatgaaacggagctggaaatcctgactggaatgccggtggggacggaggatgaagtgaggcgggcaggcgcgtccttactgaaacgtggcctaaagaatctgatcgtgaccctgggcagccgcggatcgctgtggatgaccggcgatgactgtcatcaggttgaccctgtgccggttaaagcactggataccagcggtgccggtgatgcgtatattggctgttttgcctacgaactggtgaaaaccggtgatatccctgccgccatggcgaaagcctctgcctacgcggcctgtagcgtcacggcacgcggtacgcagcgttcttatcctgactcaaccgcttttcagcgctttctcgaccttcaatgaggtacggccatgcaccagaacattgttcagcaagatgacggttatctaaataagaccccgctgttccagtttattctgctttcctgtctgttcccgttgtggggctgtgcggcaagcctgaatgacattctgattacgcaatttaaaagtgtgttcgccctgagcgattttgccagcgccctggtgcagagcgccttttacggcggctattttttgattgcgattccggcctcgctggtgatccgcaaaaccagttacaagctggcgattttaaccgggctggcgctgtatatcgtcggctgtatgctgttttaccccgcctcgcacatggcaacctataccatgtttctggcagcgatttttgctattgccattgggttaagcttcctggaaacggcggcgaatacctacagctcaatgattggtcatcgccaacatgccacgctgcgtcttaatatcagccagaccttctatccgctaggtgctctgatgggcattgtgttgggaaaatatctggtatttcaggatggggaaagcctgcaaacacagatggcaaacatgacggcggagcaggcccacgcgttccgcttatcgatgctggaacacactttggagccgtataaatatctggtgatggtgctggtggtcgtcatgctgctgtttatgttcacccgttatccgcgctgcaagccgcaaagcaacgaaaaaacgttgccgacgctgggcgaaaccttctgctatctggcaaaaaatcgccattttaaacgcggtattctggcgcagtttctctacgtcggcatgcaggttgcagtgtggtcctttaccattcgtctggccctgacgctgggggcgaccaatgagcgtgaagcgtccagctttatgatttacagctttatctgtttctttattggcaagtttgtcgccaacattttaatgacacgtttccgtccagagaaagtccttatcgtcttttctgttttaggcatgataacgctggcctacgtcatgctggtgcccaatttcaccgctgtttatgccgccgtgtttgttagcgtgctgtttggtccctgctgggccacgatctatgccggtacgctcgcaacggtagacagtaaatacactgaagtcgccggcgcgtttattgtgatgtcgatcgtcggggcggcatttgtgcccgctttgcagggctttgtttccgaccatctgggatcgatgcagctggcatttggcgtgtcgctgctgtgttttgcctgggttggcttctatttttggggcgaactgcgccataaaaagcagccgcgtcatcgcgcaaacctggcggaggagggactatgaaaacccgtttaccgctgcgccgtgaacagttttccgccacgcccacgttgctgctggagagcgaggatttcaggatcgagctgtttcgctatcctgcgggcattgaggccattcgcattcacaaccggcggggcacggtgattgtgttgccctttctgggccagatggtatgggatgtgaattttgacggccgtgccctgaccatggggcaccggtttaaacagccgctgccgggtgacactatcatcgatacgtacggctgttttgcctttcattctggtctgctggcgaatggctgccctggcgcggaagactcgcatccgcttcacggtgaaatggcctgcgcccgcatggattccgcatggatagtgctggaggatgagcgtctttctgtcgaaggcgaaaccgaatacatcaaggggtttggtcaccattatctggcggcaccggcggtacggctaagggccgatcaggcgcggctgatgctggagatgaccgtgacaaatctggctggcgcaccgatgccgttgcaatacatgtgtcacatcaacagcgcatgggtggcgcaagggcagtttaaacagacgattcctgacgaggcgtttcagctgcgccgttctgttccggcacatgtgcggcccactcctcagtggaccgcctttacctactccctggcccgcgatcccaccgcgttccggcagttggatcaacctgcaatgtacgatccggagattgtcttcttcgccgatcatctggcgcaatacggtgagaacgttcagtttgaactccattccccggccggttatgccctgatgacccgcttttccaccgcgcagtttccgcatgcgacgcgctggatactgcataatgcggatcagcaggttgctgcctacgtactgcccgccacctgccgtccagaaggctttgcagcggcacaacgcgccggtacgttgatggcgttgatgcccggtgagcaccgtcatttccaggttgaaaccggcgtgctgtaaatcgcccaggccgacgcgtgatgtgacgaaacgtcaggtgcttttgacgcttctgctgccacgacagcgtcggcgtgagtctcttctgcatcagaacgcgtggggctggcaggatgatcatccatgtggcgaaagcccgtggatagcgcgtcttatacccatctgcctgttcacgtcttctacctgctcgcctgtaagccatttaagccaccgcagcctgttctggctggacacacagcagatcgctatcgccgttttatcgttgagcatcccgctgttaaccctgcgtcggcctggtggaaaacgcgatccacctggcgttctaaggcggcaggaaagtgcgattctgcctaatgcaaccaacatcccttatcttcctcaggtcaatttatgtgacaaagatcacataaattgacattagtcatccttatgagaaaactcgcccttccaaatattgaatgataatgattattatttatattgttattgtcattaacaactgctcatttaatacaaataaaccacataaaatgtagttttttagcttttttgtgaacataaattctcaaaaattttgacctcatgggtgagccgtctcggctaaaggttactgaatctgaattgactcgcgtggtctggcgcaggctgctgccctttttaaacggtggctgggcggcttacgcctttaataaaggaacgggatatggtggtacgtaagcaaaacccgtcggtgcctcaccgacatctgtctgatgcggtccttactgctcaggactttattttcaatgatgcgcaaatttcggcctggcatcagcaaacgcaggaggcgctgacgctgatcacccacaccgttcagcgcgttgagaaacccttcagcggtatcctgcctcacgagctggccccggcttttagcgccgtcgatcttgaccagccgctgggaaataatgaggctgcgctggaagagttaggatcactgtatctgcgtgatgccgtctggttccatcaccccaaatacgtggcgcaccttaactgcccggtggtactgccatcgctgctggcggagcaaatcatggccgcggtcaacagctccgtggacacctgggatcagagcgcgggcggaacgctgattgaacagaaggttattgactggacgctgagccgcatcggtctgccggcgagcgccgacggcatctttaccagcggcggcacgcagtcaaacctgatggcgatgctgctggcacgcgacagctggtgcgccgcacatcatccgggccatctgatcaaacatcagggcctgccagccaatgccgccaaatggcgcgtcctgacctccagactgagccacttcagcattcagaaatcgatggccattctcgggctgggctacgatgcggtcattccggtggattacgacgacgattaccgcatggacagcgtgcagcttgcgcacgagattgcgcgttgccacgagcagggcctgatcccgattgccgtcgtcgccaccagcggcaccaccgatttcggcagcatcgatccgctggaaaccatcgcgacactgtgtcagcagcacggcatctggatgcacgtcgacgcggcgtacggttgcggtctgttggtttcggaagcgcatcgccagcgcctcaacggtattgaaaaagccgactcggtgacggtggattatcacaagtcgttcttccagaccgtgagttgcggcgcgttcttcgtgcgcgacaaacagcacctcagccacgtgacgcaccatgctgattaccttaatccgctcagcgctcagcaggaagggacgccaaacctggtgaataaaagtattcagaccacgcgccgctttgacgcgctgaaaatgtggctgaccttgcgcatcatggggccggcgaagctgggtgaggcgtttgacagccttattacgctaacccaggcaacccatcagttgctgaaagcccatccggtgattgaggtcctgcacgcgcctgaactgaccacccaaatcttccgcttcgtgccgcgccccggcatgaatccggtacagctggacgccatcaatgccggtatccgcaaggccctgttccgttccggtaatgcggtgattgccggtaccaaagtggatggccgccagtacctgaaatttacgctgcttaatcccaccacctcgctagctgacatggaagatgtgattgccttgatcgcccattacggtcgcgaacaggcacgtgacatgacattacaggtggctaaccagtgagaacggcgcgatgaacaacagaatttatgactttatcggtattggtattgggccttttaatctcagcctggcctgtctgagcgagccggttgaggggctgaacggcctctttctggatcaaaatccggggttcgactggcataccggcatgatgctggaaagtgcgcacctgcaaacgccgtttatggccgatctggtgacgctggccgatccaaccaatccttacagcctgctgaattacatgaaacagaaggggaaaatttattcgttctatatccgcgaagactttttcctgatgcgtaaagagtacaaccagtactgtcagtgggcgtgctcacagctgagtaatttgcgctggaatacgcgggtagattacgtgagctacgacgatgcccagcagtgctaccgtattcgtgcggtggatacggtcagcgggcaacagcaggaatggctgacgcgtaaactggtgctgggcaccgggcctgccgcgtggctgccggaatgcagccgatcgcatcagtcgcgctttacccattccagtcagtatctggcggacaaggcggagctgcagaaaaagagcaccatcaccgtgctgggaagcggtcagagtgccgcagagatctattacgacctgctgacggacatcgatcggtttggctaccagcttaactggataacccgcgcaccgcgcttctatcccctggaatacaccaagctgacgctggagatgacctcgccagaatgggtcgactacttccacgcgctgccgggggaaaaacgtgatgcgctgaacgcgcgccacaaaaacctctacaaaggcatcaacagcaccttaatcaatgacatctacgacctgatgtacgtcaagcaactggatggcgcgctgaacgttaacctgttcacccattcggagctcaccggcatgcgctggttgccgagtggggagtttgaactcgccctgcatcagcaggagcaggattgtgcgtatacgcgccgcacccaggggctggtgatggctacgggttatcagtatcgcccgccgatgtttatcgaaggcatcagccagcgtctgcgctgggatgagaagggccgttacgacgtccagcgcaattacagtattgaccagcataaccagatcttcgtgcagaacgcagagctgcatacgcacggctttgtcacgccggatctcggcatggcctgctatcgcaactcggtgctcctgcgtgaactcaccgggcgggaaatttatcccgtcgagcggcagatcgccttccagaccttcccggcccaatcggaacattgatatgtcacagtcaacgcttttcactgcggcccgacctgcgggccagtttaccctccgtgccatgcagcccgacgacgtgacgcttattcaccgctgggtcacgcgcgactacgcccgcttctggggcatgcaggatcactcgcccgaacaggtcgccgaattctatcaacagctgacggcaaaagatccccatgcggccttaatcggctgttgcgatggcgaaccggcgtttctgattgaatgctatcgcgccagcgatgatgaggtcggcaggcattatcccgcacagccagacgactacggcatgcatattctgatcgcgcccgcggtgaacccggtcagccagtttagctggcaggtgttcagtacggtcatggactacctgttcagccgccccgaggtcaaccgcgtggtggtcgagccggacgtgcgcaatgacaaaatccatcgcctgaataaacgtgccggttttcgctatcagcaccagattgatatggaacataaaaccgcctggctggccttctgccagcgcgaagattatcaacaggctctactgcaggattcactgatgaataacaccacaccgctgttgaacggttcacaccttaccggcaatgactggctgcaagccaaccgtttactgattcgcaaagcgattgccgaattcgcgcacgaaaaattgatcacgcctgtcgacatgggcgctggccgttatcaactggccgtaccggggggcgaatcggcatacgttttttctgcacaacgccgggcgcttgaccactgggaaatcgatctggcgtcgctggaaaaacaggaaaacggccgccgtttacccttggatgcgctgcagtttattgaggagtttaatgcgcaaatcggcatttctcaggcgctgctggcgacctacatggaggagatcagcagcaccttgtgcagcagcgtgtttaaactgcagaagaataatccagacagccaggcgctggtaaaggcggactttcagaccgtcgaatccgcgatgacggaaggccatccctgctttgtcgccaataacggccgtatcggttttgatgcgcgcgattatctggcttatgcccccgaagccgccacgccggtgaatctgatctgggtggccgtgcatcgccgtaatgcccacttctccagcatcagcgagctgagctatgagcgcctgctgcaggaagagttaggacagcctgcgcttgaccagttcgctgctcaactggcgagccagggtgtcgtcaccgacgactatatcctgatgccggtccatccctggcagtggcagaataaactgttgacggtgtttgccgcggatattgccagccaggacattatttatctggggatcggggacgatggctatcaggcgcagcaatcgattcgcacctttttcaaccgcagtcagccgggtaaacgctatgtgaaaacggcgctgtcggtgctgaacatgggctttatgcgcggcctttctccttactatatggcgaccacgcccgcgattaatgaatggctggaaaggctggtggcaaaggatgactggctccagcgctgtgatttccgcatcctgcgcgaagtggccgctgtgggctatcacaaccgacactatgaacgcgccattcaaggcgactccgcttacaagaaaatgtttgcggccctgtggcgcgataatccggtcactgatctgcagcccaaccagcgtttaatgaccatggccgcgttgctgcatgtcgatcaccatcagcagccgttactgcccgcgctgatcgctgattccggcctgcctgcggaacagtggattggtcgttacctgaactgttacctcagcccgctgctgcactgcttctatcaatacgatctggtgtttatgcctcatggcgaaaacctgatcctgctgctggaaaacaatgtgccggtcagcgcctatatgaaggacattggggaggagatcgcggtgatgaatccggatgccgttctgcctgaaaaggtgcagcgactggcggtggacgtgcctgagcaccttaaactgctgtcgatctttaccgacgtcttcgactgcatcttccgctttatcagcgcgattttgcatcagtcgaatacgctgtcggaaagccagttctggcagttggtggcgcagtgcgtgaaggactatcagcaggcgcatccgcagcttgccagcaagttcgcccgctacgacatgtttgcgcccgaatttacccgctcctgcctgaatcgcctgcagctggcgaataaccagcagatgattaacctgtccgatcccgcagaaaacctcaagtttgctggcacgctggttaacccaattgccacatggcgctgacccgttagcggtgtcagcacgtcggacagtatcagcgcggtcgctcaggcggccgcgtttttttatcttgttttggaaagtattcacgatggctctttttcaacctgtctcgcgcctcacgcgtcgacatttactgttccccttatcgctggtgttatttgaatttgccacctatctggcgcacgacatgattcagccgggcatgttgcgggtgacgcaggcgtttcatgtcggcccggagtgggtgtccacgtcactgaccgcttacctgatgggcggcatggtgttgcagtggctgttggggccgctgtcggacaagctgggacgccgcccggtcttgctggcgggcgtcgcgtttttcatgctgacctgtctggcaacccactgggtacagagcatggggcagtttatcttgctgcgctttcttcagggcatcagcctgtgtttcatcggcgcggtcggttatgccgctattcaggaagcgtttgacgacgcactcagcgtaaagatgatggcgctgatggctaacgtggccctgctggcaccgctggccgggccgctggcgggcacggcgtttcttgccgtcgcagactggcgcacgctgtttctgttttttgctgcgctgtctgccctggcgctgacggggttgtggttttcgatgccggaaacggcgggcgacagaaacacctctgtgtcgctgacgtcgctggcagcgggctattacgcgttgttaaaagagcggcaggtgataagcggttcgctggccattggcctggtcaccattccctgtctgggctgggtcgccctttctccggtgatcctgattcacgatctggggctgagccgaatggaatatgcgctgctccagttgccggtctttgtggcgatgattgccggaaatctgacgctgggtcggcttgccagccgtctgccggttgagcagccgctgcggctgggtgcctggccgattattaccggtctggcgatagccgctgtcggcacgcttatggatgcaggcagctatgtatggctgacggcgggcctgagcctttacggtttcggcacaggaatggtgaatgccgggctgtaccgactgacgctcttttccagccgggcagggaagggcagcgtggcggcgatgctgggcatgatcagtatggtggtgtttgcgctgggcattgaggcggtcaaagtggcgtatttcagtggcgggatggcctggttcagcctggtgaatctgctgtgcggcttgctgtggttgggactggtgcggtcgtttctgcgcgaaaatctgcgacgacatcgcgtcgtcgcagtatagggtgagacaggcggcagggtttgccgccggttcggtagcgatcagaaatcgtagccgacagtggcaacgacggtccgttccgcgccccagtagcagaaaccggtgccgtagcaggcggacacatagtcgcggtcggtcaggttattggcgttaacctgcacaaaagcccctttcaggttgctgttccaggcgcctaagtcggcacgtaccgaggcatcaaacagcgtggcagacggcagacgggtggtattttcattgtctgcccactgccgaccaatgtaacgcacgcctgcaccgatgctgatcccggcgtcgaactggtatttcgcccacgcggaagccatcgaatcaggcgtgacgtaaggcgtatgaccgttattaccgtcgatggaatctttaaagcgcacgtggttgagcgtaaagctcgccagcgtgctcagtcgcggggttaactgattatgtgcttccagctcaagcccctgcgagtgcactttcccggccggttcataataggaccccaccaccacacgattgccgacgtcattttgggtcagatcgtagatcgccgccgagtagagatcggacgtgcccaccggctggtatttaatgccggtttcgtactgttccgaggtcgtgggtttcagcagattgccatcctgtccggaaagggactgcggcgtaatggcctggctgtagctgacgtacggagagataccgttatcgaatgcatacagcagcgccgcacgaccgctcacgtgatcgtcctgacgacgatactgcgtatcgctgctgtactgtctgttttcagagacgatccgatcgtagcggccggaaagatccagatgccacttgtcccatttcatctcatcctgcaggtacataccggtttgatagtaacggcgctgcgagttctggaacacgtaagccggattcggtcccacggcctggcctgtcagcgcattgagctggctggctaaaccactggcatcgcgcaaatcgttggtgtactgatgatattccgcgcccagcaccaccttatgatccaccgggcccgtgtcaaaatcggcttccagttgattatcgatcgcatacgcctgcagtgaggaacgtgaaccggagtagtagcggttgagcagttcagactgaggggaatcccagccagcctgataaacctgatccaaatccacattggaatgggagtagctggcattggagcggaaggcccaggtttcgttaaagcggtgagcgaactccgcgctgtaaatttgctcacgacgtttgaactgatccagcgtgctgtcgccgtcataaaaaccggtgctgagcttacgtccgttatgctcggtgatgctgccgtcacccggcacggcgctgtggtagccaccggaaggatctttttgcagataggcgcgtaacagcagtgaggtatcctcatccggctgccacagcagcgagggtgaaatcgcatatttttcttcgcgggtatgatcgtactgcgtatcactgttgcgcgtgatgccggtcagacgaaaagcccactgatcgttaatcgcattggtgtaatcaaatgcggcgctgttggtgttgtgagtgccggtggacaggcggaagtgaccggcgggggcatactgtggacgcttagacgtctccatgactaagccacccggtacggtttgcccgtacagggcggaagaaggccctttgatcacatcaatgcgttcgaggaaccagggatcaacctgcagcacgttgtagctgccgggatcgctcatcaggcgcaggccgtcgaggaaaatattatccacatcgccgccgtggaaaccgcgcagcgacaccgtatcgtagcgggtggccgcgccggcgaagttcgtaaaggcacccgcggtatagttcagcgcctgattcacatccattgcgccctgatcgtccatctgctggcgcgtcaccaccgacaccgactgaccggtggtgatcagcgggcgatcggtcttggtcgcgcctttgctgacggtcgtcgtatagccttctgttggggttgtcgacgtttcttcaggctttgccgtcaccaccagcgtgttggcggcaaacgtgactgccggtgtggcaatggcgatggaacacagcaacgctaaccgtttcgggccgaaaggcattctcattgtttatcccttacaaaaggtaaataccctgctcctttcagaggaaaggagcgtaaattttgattacgatcagataatgcgcattgaatgcaaatgagaattattgcctttactgttaatgattacaagacgtgttcaccgttatggctgaagaaattgcaggcagaaggaaaacggcgtggatggcgggtgggctcagggcaatttcagcggggggaaatggcggctcgtgcggcactcgccaggtaaacaagatgggcaggtcagcaagcatttctgacctgctacgtggctgttatctcagatcgcgaccaggctccgcacgttatccgtttccatatcgtcaccccgaccgcgctgaataatttcgccgcgtgacatgaccaggtagctgtcggctaactcagcggcaaaatcatagaattgttcgaccagcagaatcgccatatcgccgcgttgcgccaactgacggatcaccatgccaatctctttgatcaccgatggctgtatcccttcggtgggctcgtcgaggatcagcaactgcggacggcttgccagcgcgcgtccaatcgccagctgttgctgttgtccccccgacaggtcgccgccacgacgtgacttcatgtcgaacagcacggggaaaagctgataaatctcatcaggaacctgtttcgccctggcagcgggaaagcgtgacagccccatcagcagattctcctcgaccgtcagacgcggaaaaatttcgcgtccttgtgggacgtaagcgatgccggactgcacgcgctgataaggctttcgcgcgccaatcgacttgtcctgccagcgtacctcacccgatttggccggaatcaaccccatcaggcatttcaacagggtggtttttcccacgccgttgcggcccagcaggcaggtgatctcaccggtcttaacctcaaaggacaggccacgtagaatatggctgccgccgtaatattgatgcagttccgatacctgtaacatttagcgccccaaataaacgtcgatgacctgctcattggcctgaacgtcgcgcagcgacccttccgccagcaccttgccttgatgcaaaaccgtcacgtggtcggcaatggtttccacaaagcccatatcgtgctcaaccaccatcagtgagtgttttcctgccagaccgcggaacagctcggcggtatagtcggtttccgcatcggtcatgcccgcggcgggctcatccagcagaagcaggtgcggttcctgtaccagcagcatgccgatctccagaaactgtttttgcccgtgtgacaacaagcccgcctggcgctggcgcgaaccggtgagccgcagcaggagcaggacctcgtcaatgcgatcccgctgctcgctgttaagccgtgcacgcaggctggcccagacagttttgctggttttcagggcaagctccagattttcaaacaccgtcagggcttcaaacaccgtgggtttctgaaacttgcgcccgataccacggcgggcaatttccacaggtgactgtgccgtgagatcgtgatcctgatcgtaaatgacccggcctttatctggccgtgttttgccggtaatcacgtccatcagcgtggttttccctgccccgttgggaccaatcacgcagcgcagttcgccaacgccgatcgctaaggaaagatcggtcagcgcgcgaaagccatcaaaggagacggtgacctgttccagttgcaacaccggatcgcgctgaacacgatggcgatccgaaggaaacgattgggtaaacgggtgctcagtcatgttttctccgacgcagcaggccaatcacaccacgcggcagaaacagcgtgaccaggataaacatcattcccaggaagaacagccagtattctggaaaggcgacggtgaaaatgcttttcgcgccgttaacaatcgcggcgccaagcagtgggccaattaacgtgccacgcccgcccagtgcgacccagatggcggcttcgatggagttggtcggggacatttcaccggggttgataatgccgacctgcggcacatagagcgcgcccgccacaccgcacaacacggcggacagcgtccagacaaacagcttaaagccgcggggatcgtaaccgcagaacatcagacggttttccgcgtcgcgaaccgcagtcagcacccgaccaaatttactgcgagccagggcaaaacccaggcccaaactgaccaacagcagcataacggtggcgataaacagcccgatgcgcgtgccggtggcggtgacgttaaagccgagcagggtggtgaaaccggtaaagccgttgttgccaccaaagccggtctcgttgcggaaaaacagcagcataccggcataggtcagcgcctgggtcatgatcgagaaataaacccctttgattttcgagcggaaggcgaaaaaaccaaacaccagcgccagcaggccgggcaccagcacaatcaggcacagcgcccaggcaaaatgctgggtgcccgtccaaaaccacggcaggcgatcccaggagagaaaagccataaaggccggtacgccgtcgcccgccgcctgacgcatcaggtacatgcccatcgcataaccgcccagcgcaaaaaacagaccgtgccccagagagagtaaaccggcatagccccagaccagatccagcgccaccgcgacgacggcatagcacaggattttccccaccagcgttaaggtataggtcgatatcgccaacggatgggcggcaggcagcagcgccagaaacggcatcatcagtagcatcagcgtaaccagtgcgccaatacacagcgtcaggcgcggggcctggcgagtcagacgtaaggtgatcggttgcgtcattagtcagtcacccttcctttcaccgcaaacagcccttgcggacgtttttgaataaacagcacgatcatgaccagaatcaggatcttccccagcaccgcgccgatttgcggctccagcactttattgagaatgcccagccccagcgccgccacgacggttccggccagttgaccgaccccgccgagcaccaccaccaggaaggagtcaataatgtagccctggccgagttccgggccgacattacccaactgggacagggccacgccgcccagcccggcaatgccggagcccaggccaaaagccagcatgtccacgcgtcctgtcggtacgccgcagcagtcggccatggctcgattttgtgttaccgcacgcacgttcattcccaggcgcgtgcggttcagcagcagccaggtcagcatcagcacaaataccacgaacagaatgaccgcgatgcggttccagggcaggaccaggttaggcagcacttgcaaaccgccagacagccaggcggggttagcgacctcaaggttttgcgcgccaaacagcatccgcaccagctgaatcagcatcaggctgatgccccaggtggcgagcagcgtttccagcgggcggccataaagatggcggataatggtgcgttccagcgccataccgatagctgcggtcatcaaaaaggccaccggcagcgccagcagcggataccagtcgatgtagtgcggcgcgaactgctgaaacaggttttgcaccatccaggtggcgtaggcacccaacatcaacatttccccgtgcgccatattgatcacccccagcagaccgtaggtgattgccagacccagcgcggcaagcagcagtatcgaacccagcgataagccgctaaacgcctgacccagcagatcgccccacatcaggcgacttttgatctgtttcaggctgtctgccgccgcttcacggacggtttcatcgggttccgctgtgggctgcgtcagccgttgcaggctggcctgggtattgggatcgctggactcgcccaacagttttaccgcccgcagccgaaccatgggctgagagctggtcagttgcaggttggctgctgtcattgccagcgcagcgtgcactcgcgcatccttttcgacgctcaggcgctgcgtaatcagcggaaggagatcgctggccgcatcattttgtaactgctgagctgcgctcaggcgcacgctggcatcattgctcaccagttgatgggcggcgagggcactggcaaccagcacgcgcagccggttgttcataaacagttttttcacttcacccgtcggctgcagggcggcatccagcggcagcaacctgctatcggttttactgaagggatggcgatcctgatccgtgaccacggtttcggctttcagcgcctgaagcagcggtaggcgactggcatccggcgcagccgcccactgttgcagcaatgccgcctgctgggttcggctggccgcagcgaagtcggctgccggtccggcgctggcaaacagcggcaggagcagcaaaaaactaaagaaacacaggcgaagcgtcatgagtgagcctcattgaataagcgagcatggaaagtcctttttgccgcccttattccgggacaagggcggcacctgttttactgggatgttttcacagggtggtcgggttttttgtcattaccggggatatacgggctccagggttgggcgcgtaccggtttgtcggtctgccagaccacgttgaactgaccgttctcttccacttcgccaatcatcacgggtttatgcagatggtggttggtctggtccatcgtcagggtaaagccatccggcgctttgaaggtctgaccggccatggcggcacgcaccttatccacatcggtggtgcccgctttttctaccgcctgtgcccacatgtgaatgccaacgtaggtggcttccatcggatcgttggtgacaacgctgctggcgttgggcaggttatgggctttggcataagcacgataatcggcgacgaatttggcgttggtggggttatccagtgactcaaagtagttccatgcggcgagctgaccgactaaaggtttagtatcaatcccccggagttcttcttcgcccacagagaacgccactaccggaatatcggtggctttgatgccctgattagccagctctttgtagaacgggacgttggagtcgccattgatggtggagaccaccgccgttttcccgcctgcggcaaactttttgatattcgatacgatggtctggtaatcgctgtagccaaacggcgtgtagacctcttcgatgtctttatcctgtacgcccttggcatgcaggaaggcgcgcaaaatcttattggtggtgcggggataaacataatctgttcccagcaggaagaagcgtttggcactgccgccatcttcgctcatcaggtattccactgcaggaatggcctgctggttaggcgctgccccggtatagaaaacgttgggggacatctcttcgccttcatattgcaccgggtagaagagcaggccgttgagttcttcaaagacgggcagcacggattttcgcgataccgatgtccagcagccgaaaacgacggccgctttatcctgggtcagtagctgacgcgctttttctgcaaacagcggccagtttgatgccgggtccaccaccaccggttcgagctttttacccagcacgccgccttttgcattgatttcatcaatggtcatcagggcgacatctttcagcggcgtttcggaaatcgccatggtgccggaaagcgagtgcataatgcccactttaatcgtgtcagccgcctgagcactccatgagaatcccatacctgcgacggtagcggagagcgcaaaagccttaagcaatgaacgtcttttcatcaatgttaaacccctggttagatggatgcgttattcgatgggttggagcctggcctgctgtaacatatggattgtgatttttctgacctctgccttactggcggcaatgtgcccactcagcatctgctgggcttcaccggtttgctgcaataaaatggcctgtaaaatttgcgcgtgctcgcgatacgtcgccgcgatccggtcttcgcgggtaaaatcgagacgtcggataatgcggatcttctcggtcagttcggcgtggatacgcgcgatttcactgttgcccgcggcggcaaccagcgtcatatgaaaggcttcatcgtgctgggacaccttcttgccctcatccagacgggcggcctcacaccagaactgataaagctcgcgcagccgggcggcgcactgcgccgagggcagctcgcaaaggcgcttcacggcttcgcactccagcaccgttcgcaggtcgtacagctcctcgaaataggcgaaatcaaaggtttttacctgccatccgctgcgaaaccagacgtcgacataaccttcacgctccagccagaacagcgcctggcgcaccggcgtgcggctgaccgccatacgttcagcgatttcactttcgctgaagcggtcaccgggcatcaggcgaaattcaaaaatgtcgtttttcagtgtctgataaacgcgttccgccagcgcttccgggcgacctttatgacgaggggatcgggtggtcatcggctctccttattccagccacagcagtgaatcgccgggattgacggcgcggcctgcctggcagtcgacgcgtttcacccggcccgccgtcggggcgacaattgccagctccattttcatcgcttcaacaatcaccagcgtttgaccggcgctgacgtcgtcaccgggctgcaccaggactttccagatgttgccgttcatatccgcctgtacggacagggcactgtcgtcctcaacggcggcatccggtgcggtatcagaaggggacgcgacctcctgttcctcctgcgaccacagcgtgacctcctggtcgaaagccgcagcctggcgttggcggaaatccgcgatatcttcagcgttatctgtcagaaactgctggtgggcggcaaaatcaaattccgtttcttcgatacgaagcgtggcgcgaccttcgcggaaatcgtcacgcatctgcgttaacgcctcttccgtcaccggatagaagcgcacctgatcgaagaagcgcagcagccacggctcaccggcgctgaactgcgggtttttcaggaaggtgttccagatgggtaaggtgcgaccgaccagttggtagccgccgggcgagtccatgccgtaaatgcacatatacataccgccgatgccgacggtgccttctgccgtaaaggtacgggctgggctgtatttggaactcagcagacgatggcgcggatcgacaggtacggcgcagggcgcgccgaggtacacatcgcccagccccagaatcaggtaactggcgtcaaaaagcgtttcacgcacctgttcgcggtggggtaatccattgatacgttgaataaagtcgacgttgtttggcagccagggcgcactggcccgcacggtttctttatagcgctcaacggccccgagcgtggcgctgtcttcaaatgccatcggcagccagacgatgcgtgacgggactttcagttggctcacatccccaaggagggcttcacgttccagtaactcggccatcaactgcgactggctcaagatcaggctgtcatagcgaatttgtagcgagcgcacgccgggagagagctcttcaataccggcaacgggccggtcacgtagcgtttccattaacaaatgcacgcgcaggcgcaacgccagatcgaggacgttatcgccatattcaatcaggatgtacttatcgccagcctggcgatagaccgcctgtggagaggtctccgtggccgcaacggcggcaagcagcgtgccggaaccaaagcggttttcggccagtgagggcacgggaaaggctggcgcaggctgggggcgcagtgtggcaattgcctgcctctgagcgttttccagcgcggtggcttcttcaacgctgatggggtgaaaacgaatactgtcgccgggtttgacctgacccactttccacagctcggctttcgctatcgtcaccgggcagacaaaaccgccaaggcttgggccgtcatgggtcagaatcaccggaaagtcgccggtaaagttgatcgcgccaatggcgtactcacagtcatgcacgttagacggatgcaggccggcctcaccaccgttggcgcgtgcccaactgggttttggcccgaccaggcgtacgccaagacggttggagttgtagtgaacctgccagtcgctggcaaagaaatcatcgatggcggcctgggtaaagaagtcaggtgcgccgtggggtccgtacagcacgccaatgcgccattcgttggtataaaccggtatcagcgccgggctgagtgcctgaggtgcgctgactggcgctggcgtggtacaggccgccagcaatggctgggaaaccggtagcatatcggcgacccgcagcgtccgccccgcgtgcccgccaaactgcccgagcgagaaggtggcgcggctgccaaggtattccggcacatcaaaaccgttacgaatggccagataacagcgacagccgcgctgagcgcgtcccagcgtgagcgtttgtcctgccctgaccgtaacaggctgccagttagcgacgggttcaccgtccagcgtggcggcacagtcagcgccggtcagggcaatcgtcgccgcgcaatggaaacgcagcgtcgggccttgtaaggtaaattccagcccggcagcggcctcgtgattgccgacgatgcggttggccaggcgaaaagcatagtcatccatcgggcctgacggcggcacaccgatatcccagtagccaaggcggcctggtacatcctgcacggagctaaaggtgccgggctgcaggacttccaccacggctgccgacggcgtgaaattatccagaaaacgtgtccagaccttgccagtgcgaaacgcgtcggtggcgacaatctgtcgcaggtagtcaagattggtggcgatgccgtgcaactgggtggcatccagtgcggcttgcagtttggtgagcgcggcgtcacgggtttcggcgtgtacgatcagtttggcaatcatcggatcgtagtagcttgagacctcgctaccggtgccgatcccgctatcgacgcgcacatcgtcgggaaagctgacgtgggttaacacgccagggctgggctgaaagtttttgagcggatcttcggcgtataaccgaacttcaatcgaggcaccctgaggtgcctgctgcaggcgtggccagtcgatcgcgtcatcggccgcgacgcgcaacatgcactccaccaggtcaagaccggtgacgcattcggtgaccggatgctcaacctgcaggcgagtgttcacttccaggaaatagaaggcgtcctgttgtgcatcgtaaatgtactcgacggttcccgcgctgcggtaattaaccacctcgcccagccgcaccgctgaggccagcagcgcatcacgggttgcggcgggtaaacagggcgcgggcgtttcttctaccactttttggttgcggcgttgcagtgagcagtcgcgctcacccagggcgaccacggtacccttgccatcgccgaagatctgcacttcaacgtgacgggcatgatcgatgcagcgttcaagaaatacgcctgcatcgctgaagaactgttcgccaagccgacggacgctttcccaggcctgacgcagcgcatcggggtcggcacagcgcgtcagcccaatcccaccgccaccggcagtgctttttaacatcaccggataaccgatgttatctgcggcggccagggcgtcatccagtgagtcgagcagcgccgtaccgggcgtcatgggcactccggcgcgcgctgccagctcacgcgcgcgatgttttagcccaaactcaccaatttgctgcgcggtcggtccaacaaacacaatgccggcctgctcacaggcggccgcaaacggcagactttcagagagaaagccgtaacccggccagacagcctgcgccccgctttcctgcgcggcggccagaatcttatcaatgcgcagatagctgtcgctggctttgtcaccgcccagaccgatggcgatatcggcatctttaacatgttgcgcgttgcggtcggcatcggaaaagaccgcgacgcttgtgatgcccagacgtttcagggtacggatagcgcggcaggcaatttcgccacggttggcaatcaggacggtgctgaacataatttattgactctccagagaggcgagccagtgacgccagccgccgaattcggtgatctccagcgcgtgtgtgagcgcggaaccttcacaaataaagcctttcaccacgcgaccatcggcgagcgtcaggctgccaatgcctaatggcgctgggatctcggccacgaactcgccaaagcgcgccagtgggatatcccacaactcgacggtgatggctgcgccttgttccgctcgcatcagaccgggttttttgatggggccatccaacagggcaaacaggcgatactgcgtagcggtctgcgtctcttctacccagactgcctggcgttgcgtgagctgaaagttaagtggcatgccggtcaggtgcgcgcccaccaccgcaatgcgaacgtggtcgctggaaaggggaagtggtgcaggcgcagcaggttgggctctgcctgtcgcccccagcggcagggcgatagcctgctgccagcgcaggccaaactgcgccagagcgcggtcgtgccaggctggtgcaatcagggtaatacctgccggcaggtcatcgtttctgaaaggggcgggcagtgacagcgccgcgagatcggccagattagtgaagttggtgtacgtcccaaaatgcgagttataaagcaccggctcttgctgcatctcctccagggtgtaaatcgtgggggaggtgggcacaaccagcgcatcaaactgcgccagaacctgctggatatggcgggtcaaatcggcgcgcaggtattcggcctgataggcgtcgaccgcgctgtatttcaggccattggagacaatgccgtgcaccaccgggtccatcttctcgggccgggcaagcatctcacccacggcggcggtacgctcggccacccaggggccatggtaaagctgttcagcgagtcggctgaaaggcgtgaaatcaatgggatgcagcgttgcgccgctctcctgtagtgcggccagcgccgcatcccatgccgcttcggcagccgcatcatcaaaaaacggcggtgaagcaggaatggcgaaatcaggatggggtttcatgccggcgggggccgtgcgtgggctaacgcgggagtaagcgtcctgcgcatcgtatccacctgccaggctggccacggtaaaggcttcttctaccctcagtgcaaacaccgagatcgtgtcattcaggcggcaggcagggacgacgccgcgagcggacagccagcctttggtcggtttcaggccgacaatgttgttgaatcctgccggtacccggcctgaacctgcggtatcggtacccagtgagaacgccaccaggccccgtgccagtaccgaggcagagccggaactcgaaccgccactgacaaaatccgggtcaaaggtattacataccgcgccgtagggtgaacgtgtgccgaccaggccggtagcaaactggtcgaggttggtttttcccatcaccaccgcgcccgccgctttgagtcgcgccaccacaaatgcatcatcaacagcggtatagctgaaagcagggcaggcggcggttgtcggccagcctgccacgtcaatgttgtctttcactgcaaagggcacaccaaacagtgggagcgagtccgggtcctgctggtagcgcgccaggagcggctcagtttgcgccattaactgggacggcgtggcaaggtagatccaggcattatcttccggggccagctcagaaaggtgggccgccagcagcgtgtggatctgctcagggtgctgctgagcgcgttgctgccactcttttagggttaagccaaatgtcgaagccatgcagtgaattccaacaggtatacaagatgggattcaacaaagcaaagcctgtgccagaattttaaatatatgaatcaataagataattcagccatccataagtatctgtgatgataaaatgcacagttgtcgcgcaggcattgtgacatcgcggtgcgttgaacgtctgctaaggtaaattttgtgaagaacatggcaagagtggcttcccctggttagcatgaataacgtctggcacgtagccagcgcccagcaacagaggagatttacgtggagaagtggcgtaactggatgatagggatctgcctggtcagcacggcaggcagcgcatgggctgattcgcttgatcaacaacggcaacgatatcaacagattaagcaggcgtgggacagcaatcaaatggcgacagtcgaacagctgttaccgacgctgcaggattatccgctttacccgtatttagaatatcgtctgctggcgcaggatctcgatcaggaaaccagcctggcggtacagaatttcattcaaaagtatcccacgttaccgcccgcccgctcgctgaaaacgcgttttgttaacgtactggcacatcgtcaggactggcaaggcgtgctcaacttcagccccgatgaacccacgccggttcaggcgcgctgtaactggtactatgccaaatggtcaaccggtcagcagcaggtcgcctttgacggtgcaaaagcgatttggctgcgtggtacggccctgccgaatgactgtgacaagttattttctgtctggcaggccagcggtcagctttctcccatcaccattcttgaacgtatccgtctggcgatgaaagcgggcaatgacagcctggtcagctacctggcgaaaacgctgcccgccgattataagacgatgtcggatgcgttgctggcgctgcaaaaagatccccaatccgttacaacctttgccaacagcgtcggtgcgaccgatttcacacggcaggccacgatttttgcgttcacccgcgtcgcgcgtgccgatatggaaaatgcccgtagcatgatcccgcaactggtgcgggcgcaaaaaatgggccccgaagatgagcaggcgctgaaagaaattgtggtctggcgcatgatggggagcgatctgacgtcagagcaggcgcgctggcgcgatgcggtggtgatggacagtgagtctaccgcgttagtagaacggcgggtgcgcctggcgctcactgaaaacgatcgtcgtggtctgaacacctggattgctcgtctgccggttgaggcaaaagagaaagatgagtggcaatactggcaggccgatctgctttattcaaaagatcgaaaagaagaagcggatgaaatactgcataagctgatgaagtcacgcggtttttatcccatggtcgccgcgcaacgtttgggcgtggagtatccacttcaggtggatgccgctccaaaaccggacagtgcaacaatccaggggccggagttggcacgcgtgcgtgagctgatgtactgggggatggacaacctggcacgcagcgaatgggctaacctgattggcagcaaaacccatgtgcagcagcagatgctggcgcgttatgccagcgaacaggactggtgggatctgagcgtacaggcgacgattaccgcgaaaatgtgggacagcctgaaagaacgtttcccgctggcatggcaggatctgtataagcagaacacccaggggaaaaccattccgcaaagttatgcgatggccatttcccgtcaggaaagtgcgtggaaccccaaagcacgttcaccggtgggagccagtgggctgatgcagattatgcccgcgacagcgacgcacaccgtgaagatgttcaacatacccggctatgtcaatccgtctcagctgttcgatccgcaaaccaatatccagatcgggacgcagtatctggagtatgtttaccagcagtttgataagaaccggattttctcgtccgcggcttacaacgccgggccgggccgggtacggacgtggcagggcagtaccgcagggaatctgagcgcggtcgcctttatcgaaaccattccgttttccgaaacccggggttacgtgaagaacgtgctggcttatgatgcctactaccggtatttcatgggccagcctgacaagatcctgtcagatgctgagtggaatcgccgctactagctgtgttaagcttccgtactctttagcgagtacggaagcctttcatgaatcaaccctctgtgccatccaacactgaaccggctgcggacgctgactggctgcgttttgttgacctgatgcaacaggcttttgcggaccatcacgcgctgccgctgttgcaactgatgatgacgcctgatgagcgagaggcttttggtacacgcttgcgtatcattgaatccttgctgaatggcgatatcagccagcgtgagttgaaaaatgaactgggcgtgggaattgccacgataacccgtggttcaaacagcctgaaagaagcccctccagagctgaagcgctggctggaagcgcaacttcatcgccgctgattattgctgatagaacggatgtgtgagcggacagagcgccagaatcaaggcctggtggtagacgctggtgcggctaagcaggccattggtcaaggtaccgatcgcgccacctttgtgtttaatgttttcgaccccggtcaggcgtgtcatctcttcgcccagttcgcgaccttcacgtaatccggccatcacaaccggcggcagggtaaaactggccgaacgcgactcgccacgctgtttctggttttccaccaccatccaggcaaaggcagactcttcttcaataccggcttcaatcgccacccagaagtcggcttccgggcgaacctgacgggcattcatgacacgctgacgtgcgccagttcgcgtttcgtgattggttaatggctgtgcggcaacgccgctctcgacctcgaccccttcaatatggcaggatccctcgccgaaaacgtcgttgaatgcctgagcaattgcacgaatctttgctggattaatggtagctgcgacaacatggtacataatcaattgaaccctcaggtaataaaggcgattttggtcgcagtataacggaaactaagcatgctacaggtctatcttgttcgtcacggtgaaacggtatggaatgcagagcgtcgcattcaagggcactccgacagtccgctgacggaaaaaggtgagcaacaagcccgtcaggtcggtgaacgtatcaaaaatgcaggtatcacacatatcatttccagcgatttagggcgcacccggcgcaccgctgaaatcattgctgatgcctgtggatgtgacattaccttcgacccgcgtttgcgggagctgaatatgggcgtactggaaaagcgtctgcttgacgaactgagcgcggaagaagagcgctggcgcgcttcgctggttaacggaaccgagggtggccgtattcctcagggcgagtcaatgacggagctggcgcaacgtatgcaggctgctctggatgcctgtcttgcgctgccagccggtagccgtccattactggtcagccacggtatggcgctgggggttctggtcagcacgattctggggctgccggcttatgccgagcgtcgtcttcgcctgcgcaactgttcgatctcacgcgtcgatcatcagcagagcgcgtggctggcgcagggttgggtcgtggagactgcgggtgatatcacccacctcgacgcgcctgcgatggacgagcttcagcgttaatcgattatgccgtcatgatgacggcataaccgcaagcgtttaacggcgaatcggaatcagatattcacagtgaatctctgttggcggctcgctgcgctttttgccgccatgggtaataaagcgttcaatatcctgccccatccggcgcgtcaggcccagcgttggcatacaggttccgtacagcaacagaataaattcctgcagttccacgcgcgggccattgtagttgaactgaacgtaatcccccgcttcaagaatcaccttctgccctgaatacatcgtggttgcgctgtcggcaggaacggccgtggtgtacagaatctcctgctcatcatccttttcatgactggcacggacctggtgcaacccataaagcacgggcggaaccgtatccgtttccagcagaaactgtttccagaaatgaacacgcatctcatcacggtagctggagatttgttccagggtacaggtataactctgtgtctgtcccatcagcacggtttccggaagcgtcacgaactgcgattctggctgctgttcattccctaaccgaatcggcgggcggataccaaaggagttccattctgacgaacggcgataccatgcaggtgtttgattaaactgctttttaaaggctcgcgtaaaggtctgttgtgaatcaaaacgatactgcagagcaatatcgagaatcgggcggctggtcaggcgaagtgctaccgctgctttggaaagacgtcgtgcccggatgtaagcgccaatggcgtgtccggtaacgtctttaaacatccgttgtagatgccatttagaataacccgctttaatggaaacattatccagtgaaagtggttgatccaaatggctctccagccaggcaagcaaatcgcgaatgataccggcttggtccataaaacatcctcatactctggtggcgcagctaaatgaagtcgacgaataatagcacttattgcttaaaagacatgttcggttttgacagggattgttgtgctatctacgcgggaatttctaccctttttacgttggttattgcatcaattgacagtacattacatgctcatctattacatttgcaatggtaactcaatgacaacacttcgtcttgtaatcctcaccttcgcaggtttactgttttccggtccgctgctggctgaagagattggctccgtcaacaccgtgtttaagatatttggacctgatcataaaattgtggtggaggcgtttgacgatcctgacgtaaaaaatgtcacttgctacattagccgggctaaaacaggcggcattaagggcgggctgggattagcggaggatacatctgacgcggccatttcgtgccagcaaattggtccgattgaactgagtgaaaaaattgccaaaggcaaagcagaaggggacgtggtgttccgccagcggacgtcgctgatctttaagaaactgcaggttgtgcgtttctttgacagcaagcgtaacgcattagtctatctggcgtactcagacaaagtggtggatggctcacccaaaaatgcgttgagcgccgtaccgattatgccgtggcattaaggccaggacataaaaaacgcccgtgagggcgtttaaaaaacgacagattaatcctgcaggtcgccgcagaaacgatagccttcaccatgaatggtggcgatgatttccggggtatctggcgtggattcaaaatgtttgcggatacgacggatcgtcacgtcaacggtacgatcgtgtggcttgaggtcgcgtccggtcatcttcttcagcaaatcagcacgtgtctgaatcttgcccggattttcgcagaagtgcagcatggcacggaactcactgcgcggcagtttgtactgctcaccgttgggattgatcagcgatcggctgttgatgtccagctcccagccgttgaacttgtagctttcaacctggcggcgctcttcattaggcaaaggcaaattcatggtgcgcaacagcaggttacgggcacgaatagttaattcacgtgggttgaacggtttggtgatgtagtcatctgcaccaatttccagcccaaggatcttatcgacttcattatcgcgtccggtcaggaacatcaatgccacattagcttgctcacgcagttcacgcgccagtaacaggccatttttgcctggcaggttgatgtccatgataaccagattgacatcattgtcggtcaacacctgatgcatttctgcaccgtcggtggcttcatatacgacataaccttccgcctcaaaaatacttttgagggtattacgcgtgaccagttcgtcttcaacgatgagaatgtgcggggtctgcatgtttagctacctaattttgccaactaaattgaaaacagggcgtacagcggttaggtgctctccagtgcggagaacggcaagctttgctgaaccgttgtacgaaagtaaattttgataagcttttatcaaggtcaacaacagtgttagctcagccagccgggataaagattccatgccctgcggaataaataatttgaaacatatactaactgtattaacagcaacctaacagcaataacaacaactggtaagcataaaaacaacgcttcgttgacttatatcaaatgcaattgtagcacgttaacatttctgtgaaaaacatctcaaaaaatagcgtgctggctgacataaagcatcatctttgtgccggtgagacggggttgtcacaaaatatgatgttaggaacttactattacagtggactgaaatgaaaggcttttatttggactattctgataatgtgcactttatgataaaaacacactctccggccttttttaacgtgttttaacatgtatttcagggttttaacctgactgcctatatcccttaataataaggggccatgttacactactggcgtacacattaactgatggaacaatcatgctttttcctcttatcctcgtttcacctgcccgggccgaaaatatcggtgcggctgcccgcgccatgaaaaccatgggattcagcgaattgcggattgttgccagcgatgcatggcaggacccggcagcacggcgcgtggcacatggtgcgggagacattctggatagggtaaaaacctttgagacactgaccgacgcgctggcggatatcaatttttccgtcgccaccactgcgcgaagccgggcccggttccgctattatgcgacgccacaacaggttgaggcccagttgcttgagaaacggcagtgggtgaacagcatggcgttggtgtttggccgtgaagacagcggcctgaccaacgaagagcttgaacaggtcgacctgcttaccggtatcccgatggcaaatgactatccctcactgaacctggggcaggcggtcatggtttactgctaccagctgtcggcgctcaaccaggtggccgcgccggtggcaccgtctgccgatgcacaacagctccatgcgctgcgccagcggtttgaacagctactgttgcagttagaggtcagtgacgacagcaaaatgtcagactggattaaccagcgcattggcctgctggagcagcgcgacagtgccatgctgcatcgtttactgcatgacgtggaaaaaaagctggcagataaatcctcgggttaaacctgactatctagtgacagatgttaatgaagcgcggtatgccaaacgattcgccaggttttttttgtttaacaggatgctaaacattgtggtttatatttgcgcaaaggataaaaccgttgacttgatgtgcgctttgctttacttcttgacgcagacggacaatcaatgacagacagaaaaaaataaatctgaatgcgtaatcacagcctgaacaccacaattattaccaccaccattaccattaccatcggtaaaggggcgggctgacgcatccaggaaaaacagaaaagaagcccgcacctcacgagtgcgggtttttttttgactcaaaatcaggagagttgacatcatgcgagtgctgaaattcggtgggacctcggttgcgaatgcagaacgttttctgcgcgtggccgatattctggaaagtaatgcgcaacaaggacaggttgccaccgtgctttctgcgcctgctaagatcaccaaccatctggtcgcgatgattgaaaaaaccatcagcggccaggatgcgctgccgaatatcagtgacgctacgcgcatctttgctgaactgttgcagggcctggccgaggcccaacccggttttgactatgacggcctcaaaagccgcgtggacagcgagtttgcccaactcaagcaggtgctgcacggtatcagcctgttgggacagtgcccggacagcgtcaatgccgccattatttgtcgtggtgagaagctctctatcgccattatggaaaagctgcttgaggcgcgaggctatggcgtcagcgttatcgatccggtcgagaaactcttagccattggccactatcttgagtcgactgtcgatatcgccgaatcaacccgccgcattgaagccagtaaaattcccgcagaaaatatgatcctgatggccggttttaccgccgggaatgagcggggtgagctggtcgtgctgggacgtaacggttctgactactcggcggcggtgctggctgcctgcctgcgcgccgattgctgtgagatctggaccgatgtggacggggtttatacttgcgatccgcgccaggtgccggatgctcgtctgcttaaatccatgtcttatcaggaagccatggagctgtcctatttcggggctaaagtcctgcatccacgcactatcgcgcctattgcacagtttcaaatcccttgcctgatcaaaaacaccgctaacccgcaagcccccggcacgctgattagcggtcatggcgaacaggacgacttcccggttaagggcatcactaacctgaataatatggcgatgtttaacgtctccggcccgggaatgaaaggcatggtcggcatggcggctcgcgtgttcgccaccatgtcgcgcaccggcatttcggtggtgttaatcacgcagtcgtcctctgaatacagcatcagcttctgcgtgccgcagagcgagcaggcgcgtgcgcgccgcgtgctggaagaggaattctaccttgagttgaaagatggcctactggatgcgctggacgttatcgaaaacctggcggttatctcggtcgtgggtgacgggatgcgcaccctgcgcggaatttcagcgaagttcttctctgcgctggcgcgcgccaacattaatattatcgccattgctcagggatcgtctgaacgctccatttcggtcgtggtcaataatgatgacgtcaccacgggcgtgcgcgtcgtgcaccagatgctgtttgccaccgaccaggtgattgaagtctttgtggtaggcgtcggcggtgtaggcggtgcattgctggatcagttgcatcgtcaacaggcgtggctcaagcaaaagcatattgatctgcgtgtttgcggcatcgccaattcccgtgcgctgttaaccaacgtccacggtatcgatctcagcaactggaaaggcgaaatggcgcaggccaaagagccgtttaatctgggacgcttaatccgcctggtcaaagagtaccatctactgaatccggtgattgtggattgtacatcgagtcaggcggttgccgaccagtacgcggactttctggccgaaggttttcacgtggtcacgccaaataaaaaggccaatacttcgtcgtgggaatactatcagaagatgcgtgttgccgcggccggatcgcgtcgtaagttcctgtatgacacgaacgtcggcgcgggattaccggtgatcgagaacctgcaaaacctgctgaatgcaggcgatgagttgattaagttctccggtattctgtcaggttcactgtcttatatttttggtaagctggacgaaggtgtatcgttgtcagaagcgacgcgcatggcacgcgagatgggctttactgagcccgatccacgtgacgatctttctggtacggacgtagcgcgtaagctactgattctggcacgtgaagccggccattcgctggagatgagcgatgttgatatcgaaccgctactgcccgcgcacctgaacgcgattgctgatgttgaacagtttatgcagcagttacccgaagccgatgcggcgattgcagccagagtggaacaggcgcgtgctgaagggaaagtgttacgtctggttggcgtgatcgaagagggcggagcctgcaaagtgaagatcgatgcggttgacggtaacgatccgcttttcaaagtcaaaaatggcgaaaacgcgctggctttttacagccgctattatcagccgattccgttagtattacgcggatacggtgcaggaaatgatgtgacagccgcaggcgttttcgccgatctgctgcgcacactgtcatggaagttgggagtgtaatgatggtaaaaatttatgcgccagcctcaatcggtaacgtcagcgtggggtttgacgtgttgggcgcgacggtatcgccagccgatggctcgttgctgggggattgcgtgtccgttgaggccgctgacagctttagcctgatcaattcgggccggtttgtcagtaaactgcccagcgaccccaaagagaatatcgtttatcagtgctggcagcgcttctgtgaagcgattggcaaaacggtgccggtgacgatgacgctggaaaaaaatatgccgattggctcgggccttggctccagcgcctgctctgtagtggcaggactgatggcaatgaacgagttttgcggtaaacccctggatgatacccagcttctggacctgatgggcgaactggaagggcgcgtctccggtggcgtccattacgataatgttgcgccctgtttccttggcggcattcagctgattctgcaagaaaacggtattatcagtcagtcagtaccgggatttgacgactggctctgggtgatggcctatccgggcattaaagtctcgaccgctgaagcgcgggcgattttaccggcgcagtatgctaaacaggactgcatcaaacacggtcgtctgctggcaggttttgttcacgcctgtcatacgcgccaacctgcgctggccgctaaactgatgcaggatgtcattgctgagccttatcgtactcagctgttaccgggctttgcccaggctcgtcaggccgctctggacattggggcgctggcctgcgggatttcgggctcaggtcccacgctattcgccatttgcaaccaaatggaaacggcacagcaggtggccgactggctgagccagcactatctgcagaacgatgaaggcttcgtccatatctgccgtcttgatacggctggcgcacgtaaactgggataacgcatgaaactctacaatcttaaggatcataacgagcaggtcagcttcgcccaggcggtgaaacagggtctgggttcacagcaagggctgtttttcccgctcgaactgccggaatttgaactgaccgacatcgatgccatgctggaaatggattttgttacgcgcagtagtaaaatcctgtcggcctatattggtgatgaaatcccggcgcagcatctgaccgaacgtcttaaaaccgcctttaccttcccggccccgctgaaagaagtgagcgacgatatcgcctgtcttgagctgtttcacggtccgacgctggcgttcaaagactttggcggtcgttttatggcgcaaatgctggcctacgtcagcggttcagatgagcagatcaccattctgacagcgacctccggggataccggtgccgccgtggcccacgcgttttacggtatggagaacgtgcgtgtcgttattctctatccgcagggaaaaattagcccgttacaggaaaaattgttctgtacccttggcggcaacatcgaaaccatcgccatagagggtgattttgatgcctgtcagtcgctggttaagcaggcgtttgacgatcaggaactaaagaaggccatcggcctgaactccgccaactcaattaatatcagccgcctgctggcgcagatttgttactacttcgaagcggttgcccaactgccgcaggagaaacgtaatcaactggtcgtgtcagtgccaagcggaaactttggtgatttaacggccggtctgctggcgaagtcactgggcctgccgattaagcgttttatcgccgcgaccaacgccaacgacaccgtgccacgtttccttggcaacggcgaatggcagcctaacgctaccgtcgcgacgctgtcgaatgcgatggacgtcagccagccaaacaactggccgcgtgtggaagagttgttccgccgcaaaacctggcgtttgggcgatctggcttacggcgcggtaacggacgatgtgacgcgggaagccatgcgcgaactggctaaactgggttacgtatctgagccacatgcggcaattgcctggcgtttgttacgtgatcaactgcaggacggggagtttggtttattccttggcacggcgcatccggctaagttcctggagagcgtggaaagcatcctggatcagaaactggccttgcctgcagaactggctgagcgtgcggatttgcccttgctgtcgcacaagatgaacgcggactttgctcaactgcgggcatttttgcttaagtagtgttcaggtcatcacgcagagggggcactcaccccctctgcgtcttgaagaccgatgcgtcgggcagtcttactgctcggcgcgtttgaacaccagttcgttctcacggctttcatcagcggcaaacgcatagccatcaacgtcaaaccgcgttaactgctctggcttcgtcaggcggtgctgaatgatatagcgagtcatcaatccccgggcctttttcgcgtagaaactgatcactttgaacttgccgtttttctcgtccagaaagaccggtttaatcaggcgcgcctgtagcttcttcggcttaatcgctttgaagtattcatcggaagccagattaatcaacacgtcatccccctggcttgccagcgcgtcgttaagtttttccgttaacagatcgccccagaaatggtaaagatcatgacctgccgggttagccagtttgatgcccatctccagccgataaggctgcattaaatccagcggacgcagcaggccatacaggccagacagcatgcgcagatgatcctgagcaaagtcgaagtctttttcactaaaggtttcggcctgcaaaccggtatagacgtcgcctttaaacgccagaatggcctgacgggcattctccaggctgaaatcgggctgccagctgttaaaacgctcagcatttaaatgcgccagcttgtcgctaatactcatcaatgacgcgacctgcgcaggcgacagcttgcgcgcaattttaatcagctgttgtgacttttctaacagcgcaggctgggtaaagcgctgtgtcgccagggggctttcataatccagcgtcttggcgggagagatcaccatcaacatcgtcgcgtcctcaatgagtccctttttttaaggggttagcctgtaattgtcgcccgcagtgtagcaaaaaagccgcaaggatcggcaaatcactcctatttgttcgcgctatcgtaaacggcattccctgaccttgcaccaccgttaccgcgtgatattatcccaacagccttttatcaccctgacagttaactaagagaaaaaacatgacggacaaactgacctccctgcgtcaactgaccaccgtagtggccgacaccggtgatatcgcagcgatgaagctgtatcagccccaggacgcgaccaccaacccttctctgattctcaacgctgctcaaatccctgaataccgcaaactgattgatgaagcgatcgcctgggcgcgccagcagagcagcgacaaagaacagcaactgcagctggtatccgacaagctggccgttaacattggtctggaaatccttaagctggtgccgggccgtgtttccaccgaagtggatgctcgcctttcttatgacaccgacgccagcatcgcgaaagcacgcagcctgatcaaattgtataacgacgccggtatcagcaacgatcgtatcctgatcaagctggcgtcaacctggcagggcattcgcgcggcagaacagctggaaaaagaaggcatcaactgtaacctgactctgctgttctctttcgctcaggcacgtgcctgtgctgaagcgggcgtgtatctgatttcaccctttgtgggccgtatcctcgactggtataaagcgaacacggacaagaaagagtacgcgccacacgaagatccaggcgtggtttccgtgtctgaaatctatgactactacaagcagcatggttatgaaaccgtggtgatgggcgcaagcttccgtaacgtcggcgaaatcattgaactggctggctgtgaccgtttgaccatttcccctgcgctgctgaaagagctggcggaaagtgaagggaccctggagcgtaagctgagctatagcggcgaagtcaaagcgcgtccggccaggatgaccgaatctgagttcctgtggcagcacaaccaggacccaatggccgtcagcaagctggccgaaggcattcgtaattttgccatcgaccaaggcaaactcgagaagatgctggcagaaatgctgtaatctttctaccgtggcggcactgtcgccacggttttccctttccgccaccgtttgttattcttcttagtacgtcctttctcatccaccgccctgcggtaaatcacagcgaatatcatcatgaacacattacgtatcggattgatctcggtttccgatcgcgccgcgaacgggatttatcaggatcaggggattcctgccctggaagcctggctcaacagcgcgatcggcaccccttttgaagtggaaacgcgcctggtccctgatgaacagcccatgatcgaacaggcgatttgtgaactggtcgatgaacgcttttgccatcttgttttgaccaccggcgggaccggcccggcgcgacgtgatgtcacgcccgatgccacgctcgccgtggccgatcgtgagatgccgggttttggtgagcagatgcggcaaatcagcctgcagtttgtgcctaccgccattctgtcgcgtcaggtgggggtgatccgtaagcagtcacttattcttaatctgccaggccagccgaagtcgatcaaggaaaccctggaagggcttaaagacgcgcagggcaaggtgaaggtgccgggtatctttgccgccgtaccttattgtttacagttgctcgaaggtccctatgttgaaacgaacgccgatgtggtagcagcttttcgccccaaaagcgcgatacgtgagataaataactaaatattctgcttttcaggaataagctacaggctcgctggtgtggtgatcaattgacggtatagtaagcgcagctttacaactgctttcactttctctggacgcttatgaccacacttgagacaccgcgcctgaaaccccaggattataaaacgctggccctcgcggcgctgggtggcgcgctggaattttacgacttcatcatcttcgttttttttgccgccgtgattggcgagatcttcttccccagcgacattcctgaatggctccgccagctacagacgtttgccattttcgctgcgggttatctggcacgtccgctgggcgggattatcatggcccactttggcgacaaagtcgggcgcaaaaaaatgtttagcctgagcattttgttaatggcgctgccaacgcttgccatgggcgcgctgccgggttgggacacgattggcctggctgcacctttgttgatgttgctgatgcgcatgttgcagggcgcggccattggcggcgaagttcctggagcatgggtttttgtggcggagcatgtgccttacaaacgaattggcatcgcctgcggtacgctgaccgccggactcactatcggcatcctgttgggctcggtggtggcgactttaattaatacctctatgacccagcaggccattcatgatggtggctggcgcattccgttcttcctgggcggattgtttggcctcggcgcaatgtatttacgccgctggctgcatgaaaccccggtttttgtcgaaatgcagcagcgtaaaaccctggcacaggagctaccgctgaaaaccgtggtgatgaagcatcaaaaatcggtggtgatttcgattctgctgacctggatgctgtcggcctgcatcgtggtggtgattttaatggcgccggtctggctgcagaaacagcatggtatggcccccgcgctcaccttaaaggcgaacagcatggcgattatcatgttgtgtgtgggctgcatcgttgccgggctgctggtggaccgtttcggggccagccggacgctaagcatcggaagcctgctgctggcgttgtgtagctggatgttctattccctggctccccagtatcccgactatctgtttccgctgtatgggctggtgggttttagcgttggcgtggtcgggattgtgccctttatcatggttcgcgcgttcccggcagaggtccgtttcaccggattatccttctcttataacctttcttatgcggtatttggtggcctgacgccgatttgcgtgacactgctgacagcggtctcccctatggcacctggctggtatgtcatggcgcttgcgctggtgggattgctgactggtctctggctcagacaagatatcagtcatgagccagacctctacgacgggataaaacaggcataaatcacacgcggagcctggcttcgcgtgttgctttgacagggcggcttgcgccagtcggcagaagggcgcaagccgccctgtgccctgtagcatggcaaacaacagctcatgccacatcctgttaactctcaggggcagggtagccattgttgttgtcagcgttactcagcgcaattctcctcgttaatcgggtggtcggcttaacgcagaatgagcgcggcgagccgcataatcttcagcgtaatcatcaccgtctttgatcctggtctgacaggtactgaaaattttttttcatttaacccttgatgcgcttctaagcgaccccatttacttgtcatcgagcgttgtgaacgttgtaaaaaaaagcatgtgaggatgggttgaatgtaagcaacccgcccacataaaaggttcacaacccaaactggcaacgaatttaagtgggagatgtttagatgggtaagattattggtattgacctgggtacaaccaactcttgtgttgcggtcatggacggcacgaaagcgcgtgtgcttgaaaacgcggaaggcgatcgcaccacgccttcgatcatcgcttacacccaggacggggaaactctggtcggacaaccggctaaacgtcaggctgtcaccaacccgcagaataccctgtttgcgatcaagcgcctgattggccgtcgcttccaggacgaagaagtacagcgtgatatcaaaatcatgccatacaaaattgtgggtgccgataacggcgacgcatggctggaagtcaaaggccagaaaatggcaccaccgcagatttctgcggaagtcctgaaaaagatgaagaaaacggctgaagattttctgggtgagcccgttactgaagcggttatcactgttccagcctactttaacgatgcgcagcgtcaggcgaccaaagacgccggccgtatcgcaggtctggaagtaaaacgtatcatcaacgaacctaccgccgcggcgctggcctacggtctggataaaggccagggcaaccgcactatcgcggtgtatgacctgggtggtggtacgtttgatatctctatcatcgaaatcgatgaagttgatggcgaaaaaacctttgaagtactggcgaccaacggtgatacccacctgggtggtgaagacttcgacagccgtctgattaactacctggttgcggaattcaagaaagatcagggcattgacctgcacaacgatccgctggcgatgcagcgtctgaaagaagccgcagagaaggccaagatcgagctgtcttctgcgcagcagactgacgttaacctgccgtacatcacggcggatgcaaccggtcctaaacacctgaacattaaagtaacgcgttcgaaactggaatcactggttgaagatctggttgcacgctctatcgagccgctgaaagtcgctctgcaggatgcaggtctgtccgtttctgacatcaacgacgtcatcctggtgggtggtcagacgcgtatgccactggttcaggcaaaagtaacggaattctttggtaaagaaccacgtaaagacgttaacccggacgaagcggttgccgtgggtgctgcggtacagggcggtgtgttaggtggtgatgttaaagacgttctgctgctggacgtaaccccgctgtcgctgggtatcgaaaccatgggcggcgtgatgacctcgctgatcagcaagaacaccaccatcccgactaagcacagccaggtgttctcaacggcagaagacaaccagtctgcggtaacgattcacgtgctgcagggtgagcgtaagcgtgccaatgacaacaagtcactgggccagtttaacctggacggcatccagcctgcgccacgcggcatgccgcaggttgaagtgacctttgacatcgatgcggacggtatcctgcacgtatcggcgaaggacaaaaacagcggtaaagagcagaagatcaccattaaagcctcttcaggtctgaatgaagatgaaattgcgaaaatggtacgtgatgcggaagctaacgctgagtctgaccgtaagttcgaagagctggtgcagacccgtaaccagggcgaccagattgctcacagcacacgtaagcaactggacgaagtgggcgataaactgtcagccgacgacaaagcgcctatcgaagctgcactgagtgcactggaaactgcgctgaaaggcgaagataaagcagaaatcgacgcgaaaatgcaggcgctgatggaagtctccagcaaactgatggaagcagcacagcagtctcaggcgggtgcagcggaagccggcgaagcgtcagcgaaaaaagatgacgacgttgtcgatgctgaattcgaagaagtgaaagacaataagaaataattgcccctgaccgggcgcgacggttgccctgacagccgttgaaaccagcacgggcgtaggagttttctccacgcccgtgcgatcatgttaagggctaaataaatggcgaagagtgattactacgagattttaggcgtcgccaaatctgcagacgagcgtgaaatcaaaaaggcttacaaacgcctggcgatgaaacatcacccggaccgcaatcccggtgataaagaatcggaaaccaaatttaaagaagcgaaagaagcctacgaaattctgaccgacccgcagaagcgtgcggcctacgatcagtacggtcatgctgcctttgaacaaggtggtatgggcggtggcggatacggcggtggcggctttggcggcggcggtgcagatttcagcgatatctttggcgacgttttcggtgacatctttggtggtggccgccgtcagcgtgcatcccgtggtgcagatttgcgctacaacatggagctgacgctggaagaagcggttcgcggcgtgaccaaagagatccgtattccgacgctggaagagtgcgacgtgtgccatggcagcggcgcaaaagcgggcaccaaaccgcaaacctgttcaacctgtcatggtgcaggtcaggtacagatgcgtcagggcttcttcaccgtccagcaggcttgtccgacctgtcacggtcgcggctcggtgattaaagatccctgcaatgcctgtcacggccacggtcgtgtagagaaatcgaaaaccctgtcggtgaaaattcctgctggtgtggatacgggtgaccgtattcgtctgagcggtgaaggcgaagccggtgagcagggcgcgccagcgggcgatctctacgttcaggtgtcggtgaaaaaacacccgatctttgagcgtgaagagaataacctgtactgcgaagtaccgattaactttgcgatggctgccctgggcggtgagattgaagtgcccacgctggatggtcgggtgaagctgaaagtgccggcagaaacccaaaccggcaagctgttccgcatgcgtggacgcggtgtgaaatcggtgcgcggcggtgcggtaggcgatctgctgtgtcgtgtggtggtggaaacccctgtcagcctcaacgacaagcaaaaagcgttactgcgtgagctggaagagagctttggtggacccagcggcgaacataacagcccgcgctccaaaagcttcttcgacggcgtgaagaaattcttcgacgacttaacccgttaatttagcggtctggcgtgataaaaaacggagaggagactctccgtttttttatgcgctctgcgcggctgacacggtttctcgcgcactttatgctgcccctttcaccgatatcgtcctctttccggcctgctctggctcaccctttgatgtaacaaaacgtcagacttaatgtaaaagcggataaataagctttttctcgggttcagtgaatcgttacactgctcggcattgtgttttccgctcaggaggagtgcgttttgtcaaaacctcgtcgtatcaagcatttactgaaaagttttattgagagtgatgccagtaacggcatggtgctcattctggctgcggtcgtcgctatgatcctcgctaatggcgcttccaccgcccagagctaccaggctttgttggacacaccggtacagattcgcttcggcgaactggatatcagtaaaaatctgcttctgtggataaacgatgcgctcatggcgctctttttcctgctgattggtctggaagtgaagcgcgaattgatctctggtgaactcgccagtcgcgatcgggccatctttccggttatcgccgcagtcggtggcatggcagcacctgccattgtgtttttgctgtttaaccatggtgatgagatagcccgaaatggctgggcgattcctactgctactgatatcgcgtttgcgctcggcgtgcttgccctgcttggcagtcgtgttccccccgccctgaaggtgttcctgatggcgctggcgattatcgacgacctgggtgccatcgtcatcatcgcgctgttttacaccagcgacctgtctgtgatgtccctgagcgtggcggcaggcgctatcgtggtgctggccgtgctgaaccgctgtaacgtgcggaacatcgcggtatacatgctggttgggatggtgttgtggaccgcagttctgaagtctggcgtgcatgccacgctggcgggcgtcattgtgggcttcttcgtgccgttggaagagaaaaacggtcattcgccagcggaacaccttgcgcacggtttaatgccgtgggtgaactggttgattctgccgctgtttgcctttgctaacgctggcatttcgctgacgggcatcacctttggcgacgtgttgtcgccggagccgctgggtatcatcctgggcctgttaatcggtaagccactggggattacgctgttttgctggctggcggtgaagctgaggctggcagccttgcctggcggcacgactattcgcgatatcatggcgattggcgtgctgtgcggcattggctttaccatgtcgatatttatcagttcgctagcctttgacgctgcccacgagcagttagtgacgttctctaagctcggtatccttagcggttcactgctctccgccgtgctgggctacaccttattgcgcatcaagctgcgataaaaaagccattgctgcaacacattcatccggtgttgcagcaatgctggttcctgtctcaacatctcaacatctcaatatggcctgtgacccacgatgacatcgcgcgttgactggctgttatcgtgttgctctgcggccggtctgaactcgtaagcacgccgtgattgaccttctctgttaaccctgggcctgataacccgacagagggctcgtgagagaggctgtccggggcgctacgggcctgaacctggggcagcatggttcggcaggttgagaacagtgcagaggcggtgggttgtctggcagggcaggaagataaagtcaggaagagacagtcgcctggcggcgctaaatagcaggcataaaaaaaccggcgtagcgccggttctttcaacaaagcgatgaacaaatggcgattaagccagtttgttgatctgtgcagtcaggtttgctttataacgtgcagctttgtttttgtggatcagacctttagcagcctgacggtccacgattggttgcatttcattaaatgcgttctgcgcagcagctttgtcgcctgaagcgatcgccgcgtatactttcttaacgaaggtacgcatcatagagcgacggcttgcattatgcttgcgacgtttctcagatgttacggcacgtttcttagctgatttgatattagccaaggtccaactcccaaatatgttcgatagagacaaatcaaaggccgaggactatgccttttggaccttctgttgtcaatggatttgtgcaaataagcgtcgttactcgtgataacctgtacgacactcggttacgtatttgatggcgcaagattctaccagcttccgctccctgaatacagtatttcgcaacaaaattctctcaacggctctgcatgtcagtaattacggcctgttacgcatgaaaggcgtgttcacgggttaaccttgacggctttcgagggtataatccgccgatttccacaggtttgagtcagccatgaagtttatccgcggtattcataatcttaatgcgcagcatcacggctgcgttttgaccatcggtaatttcgatggtgtgcaccgcggtcatcaggcgctgatggggcggttgctggaagaaggacgcaaacgtaatttgccagtgatggtcatggtgtttgaaccgcagccgctagaactctttgcgggcgaaagcgcacccgccaggctcacccgcttgcgggaaaagctaaaatacctggcagaaattggcgtggattacgtgctgtgtgtgcgttttgaccatcgctttgccgcgttatcggcacagagttttatcagcgaactgctggtgaacaaactgggcgtcaactatctggctgtcggggatgatttccgctttggcgctggtcgccagggggatttcctgctattacagaaagccggtgcccagtatggttttgatgtggtcagcacagaaacgttttgtgatggcggtaagcgcatcagcagcacagcggtgcgtcaggcactggctgaggacaacttagcgctggcgcagtcgctattgggccatcctttcagtatctcagggcgcgtcgtgcacggtgatgcactgggacggacactggggttccctacggccaatatcccgttacggcgctgcgtatcgccggtcaaaggcgtttatgcggttgaagtcgagggcctggggccaacgccgctgcccggcgtggccaatattggtacgcgcccaacggtaaaaggtttacgccaacagcttgaagttcacctgttggacatcaatatggatctctatggtcgccacattgatgtggtgttgaagcagaaaatacgaaacgagcagcgctttgcttcactggatgcgttgaaagagcaaattgcgaaagatacggtaacggcccgacaattttttggtctgtaacctgagcgaaaaacggaatcgagaatctgatgagtgactataaatcaaccctgaatttgccggaaacggggttccccatgcgtggcgatctggccaagcgcgaaccgggaatgctgcaacgttggtatgatgacaatctgtacggcatcatccgcgaagccaagaaagggaaaaaaacctttatcctgcatgatggccctccttatgcgaacggcagcattcatattggtcactccgttaacaagattctgaaagacattattgtgaagtctaaaggcatggcaggttacgactcgccttatgtgccgggctgggactgtcacggtttgcctatcgagcataaagttgagcagatgatcggcaagccgggcgaaaaagtcagcgccgccgaattccgcgccgcctgccgtcagtatgccgccgaacaggttgaggggcaaaaagccgactttattcgcctgggcgtgctgggtgactgggatcgtccttacctcaccatggacttcaccaccgaagccaatatcattcgtgcgctgggtaaaattatcggcaatggccatctgcataaaggcgcgaagccggtgcactggtgcatggattgccgttctgcgctggccgaagccgaagtggaatactacgacaaaacctcgccgtccatcgacgtgatgttcaatgcccttgatgccgatgcggtgcgtgcagcctttggcgtcaccgcctcagaaggcccggtttcgctggtgatctggaccacaacaccatggaccattccggctaaccgcggcatttcactgcaccctgagttcgaataccagctactgcagattgatggccgcagcctgatcctggcaaaagatctggttgagagcgtgatgaaacgcgcaggcatcagcgactggaccgtgctgggtgagtgccagggcgcggcactggaattgcagctgttccagcatccgttgcttgagcagattcagtccaaagtcgtcttaggcgaacacgtcacgctggatgccggtacgggtgccgttcacactgcccccggtcatggcccggatgactacgtgattggtcagaaatatggtctggagacggcgaatccggtcggccccgatggcgcctacctgccagggacttatcccggtcttgacggcatcaacgtctttaaagccaacgacatgatcgttgaactgctgaaagagaagggtgccctgctgcatgttgaaaaactgctgcacagctacccgcactgctggcgtcataaaaccccgattatattccgtgccacgccgcagtggtttatcagcatggatcagaaaggcctgcgtgctcaatcactgcaggagatcaaaggcgttcagtggattccggactggggccaggcgcgaattgaatccatggttgccaaccgccctgactggtgtatttcccgtcagcgtacctggggcgtgcccatggcgctgttcgtgcataaagagaccgaagcgctgcatcctgaaaccctggcgctgatggaaaaagtggcccagcgtgttgagcaagagggcattcaggcctggtgggatctcgatccgcgcgatctgatgggcgacgatgccgatcactacgttaaagtgccggacaccctggacgtctggtttgattccggttcaaccagctattcggttgtcgatgcccgtccggagtttggcggcaatacaccggatatgtatctggaaggttcggatcagcatcgtggctggtttatgtcttcgctgatgatttccacggcaatgaaaggcaaagcgccttatcgtcaggtgctgacgcacggtttcaccgtcgatggtcagggccgcaagatgtcgaaatccattggcaataccgttgcgccgcaggatgtgatggacaaactgggtgcggacattttacgcctgtgggtcgcctctaccgattactcgggtgagatggcggtatcggacgaaatcctgaaacgttctgcggatgcctaccgtcgcatccgtaatacggcgcgcttcctgttagccaacctgagcggctttaatccgctaaccgatctggttaagccggaagagatggtggtggtcgatcgctgggcagtcggacgtgcgcaggctgcgcaggctgatatcgttgcctcctacgagaactacgatttccacgaggtgattcagcgcctgatgcagttctgctccgtggaaatggggtcgttctacctcgatatcatcaaagaccgccagtacaccgcgaaaggcgacagcctggcgcgtcgcagctgccagtcggcactgtggcacattgttgaggcgctggtgcgctggatggcaccgatcatgtctttcacggccgacgaaatctggggctatctgccaggcgatcgggcgaagtacgtgttcacagaagagtggtataccggcctgtttggtctgccagaaaacgaagcgctgaacgatgcgtactgggcagaactgcttaaagtacgtggtgaagtgaacaaggtgatcgagcaggcgcgtagcgacaaacgtatcggcggcgcgctggaagcgtccgtgacgctgtatgccgatgcggacctggcgacgaaactgcaggcgttaggtaacgaactgcgttttgtgctgctgacctctggcgcacaggttgctgattacgcccaggcaggcggtgacgcgcagcagagcgaactgttaaaaggtctgaaaatcggcctgaataaagcagaaggcgagaaatgccctcgctgctggcactacactactgacgtcggtcagaatcccgagcacgctgcggtgtgcggtcgctgttacaccaacgtagccggaaacggcgaagagcgtaagtttgcctgatgagtaaacctgttttctccaccggattgcgctggctgtggctggtgctgttagttatcgttgttgatttcgtcagcaagcagtgggtaatgaacaacatgatgctgcatgaaacgcagccgctaatgccgttccttaacctgttctatgcgcacaactacggcgcagcgttcagtttccttgctgataaaggcggctggcagcgctggttctttgccggtattgcgctggcaattgtgatctcgttgctggtgatgatgtaccgcaacagcgccagtcagaagatagccaatatcgcctatgcattgatcattggcggcgcagtgggcaatctgtttgaccgttcgtatcatggcttcgtggtggattttatcgatttctatgtcggtaactggcactttgctacatttaatatcgctgactgcggcatctgtatcggtgccgcgttggtggtgctggagggctttttcaacccttccagcaagcaggttaaaaaagggtaaagcatgactgagtctgtacagggcgacagcgcggtgttgttgcatttcgtcatgaagctggaagacggctctgtggcagaatccacccgcgccaacggtaaacctgcgctgtttcggctcggcgacggtagcctgtctggcccgctggagcaggcactgttgggattaaaagcgggtgaaaaacatcatttcacgctggcgccagaagatgcctttggcagcgtcagccccgatcttatccagtacttttcccgtcgtgattttatcgatacgggtgagccggagatcggtgccatcatgctgtttaccggaatgggcggtagtgaaatgccgggcgtgattcgggagatttccggtgattcaatcactgtggatttcaatcatccgctggcaggccaccgcgttcagtttgatattgaggtgctggatatcgatccggtactggaggcgaacaatgcaaattctgctggctaatccacgtggtttttgtgcgggtgtcgatcgtgccatcagcattgttgaaaacgcactcaccctgtttggtgcgccggtttatgtgcgtcatgaagtggtacataaccgctacgtggtggacagcctgcgtcagcgcggggccatttttattgagcagatcgcggaagtgcccgatggcgctatcctgatcttctctgcccacggcgtgtctcaggcggtgcgcaatgaggcgaaggggcgtgagctcaccgtctttgatgccacctgtcccttagtcactaaagttcatatggaagtcgcccgtgccagccgtcggggtgaagagtcggtgctgattggtcacgcaggccatccggaagtggaaggcaccatggggcagtacaataaccccaagggcgggatgtatctggtggagtcgccggacgacgtctggaaactggacgttaaagatgacaaccgcctgtcctttatgacccaaaccacgctgtcggtggatgatacgtcagacgtgattgatgcgctgcgcgcccgtttcccgaaaatcgtggggccacgcaaagacgatatttgctatgccaccaccaaccgtcaggaagccgtaagggcaatgtcgcaacaggccgatgtggtgctggtggtcggatcgaaaaactcgtccaactccaatcgcctggccgagctggcacagcgcatgggtaaagctgcctatctgattgatgatgcggcggacattcagcctgagtgggtagtctctgtaggttgtgttggcgttacggccggtgcgtcagcgcccgatattctggttcagaacgtgattgctcgcctgcaggaactgggcggtggcgaagcgagagtgctggaagggcgggaagaaaacattgtgtttgaagtccccaaagagttgcgggttgacgtccgcaatgtgcagtaaccgcacactcgcagttattaaaaggccgactctgttcggcctttttgcttttcagaccaggcctgcggcagctgaaattgcttttactgataatccgccttgcctggcataaaaattcttattatccctgataaagagtggcgcagttgttatctcatcgttaacctgattgcgcttgcatgcatagttttgttttaggaatgaataaatatgaagaatatccgcattgccatcgtgggtgcgccggggcgcatggggcgcaatctcatccaggcggttgcgcagatggaaggcgttgaactgggcgctgcgctagcccgtcccggatcgtcgttgatcggcagcgacgcaggcgaactggccggtaccggcaacgcgggcgttatcctgggcgatgacttacgcgccgtgatcgatgattttgacgtcttgatcgattttacccgccccgaaggaacgctggagtacatggccctttgtcgtgagcaccgtaaggccatgatcattggtaccacaggatttgacgaagcaggcaaggcagcgattcgtgatgctgcggcagagattggcattgtgtttgccgccaacttcagcattggcgttaacctggtactcaagctgctggagaaagcggccaaagtcatgggcgattatgcggatattgagattatcgaagcccaccatcgccacaaagtcgatgcgccttcagggaccgccctggcgatgggcgaggcgattgcagaggcaatggactggaaactggatgaacatgccgtttacagccgagaaggccataccggcgagcgtcatgcgaacacgattggttttgccaccgtgcgagcaggcgacattgtcggggaacatacggcaatgtttgccgatgacggtgagcgcgttgagataacccacaaggcttccagccgcatgacctttgcaaagggcgcgataaaagcagcgttatgggtgagtgagaagaaaacagggctttatgacatgcgcgacgtgctggatttatcgagtttgtaatgggtttacctgtgtgatgtggtgatttcaatcgctaatgaattgattgaaaagggcaattttttaattgcccttaattttatttaaaataagggctttgcctaattttttcagtgagtggctcaaaagtagggttatcgcgtccctgtttttgtcataaacctgttaattttgaccatttggtcaaaattaatcgtgtgcactatcagaataaacgttgattgcgattggcaaacgattattcggctgtgtttacccctgtttttgccgcttatcctctgcattttcgttctgagcccgaaaagatgttaaaaatgttgcttcagggtggacaagtatcaggacgatcattagaatgcgcgcaatttgccaaaaattgaccactcaggcagtttttgcattgattcagatcactattatgaattaatatgcagatattgtgactgtttattccctggaggatgttttgattaagtcagcgctcttggttctggaagacggaacccaattccacggtcgggccatcggggctacagggtcggcagtgggggaagtcgttttcaatacgtcaatgaccggttatcaagaaatcctcactgatccctcctattctcgccaaatcgttactcttacttatccccatatcggcaatgttggtgcaaacgccgccgacgaagaatccagtcaaattcatgcgcagggcctggtgattcgtgacctgccgctgattgccagtaactatcgcagcgaagagagcttatcggcttatctgcagcgcaataacatcgtcgcgattgccgatattgatacccgcaagctgacgcgtctgctgcgggaaaaaggggcgcagaacggctgtatcatcgcgggcgacaacctggatgccgcactggccttacaaaaagcgcaggctttccccggcctgaaaggtatggatctggcgaaagaagtgacaacggcggaaacctacgcctggcagcaggggagctggacactggaaggggatttaccggaacagacaccggcggaagccctgccttaccatgttgtggcttacgattacggtgcgaagcgcaatatcctgcgtatgctggtagaccgtggctgccgcctgacggttgtgccggccaaaacaccagccgaaacggtactggcgatgaatccggatggcatcttcctgtctaacggccctggcgatcctgaaccctgtgattatgcgattgaagccattcaggcctttctgaaaacggatattccggtattcggtatttgccttggccatcagttgctggctctggccagcggtgcgaaaaccgtcaagatgaagctgggccaccatggtggtaaccacccggtgaaagatctggataacaaccgcgtaatgattaccgcgcagaaccacggttttgccgttgatgaaaccgatctgcccgcgaccctgcgtgttacccatatctccctgtttgataagaccgtgcagggcattcaccgcaccgataagccagcgtttagcttccagggtcacccggaagccagcccgggaccgggtgatgccgcaccgctgtttgaccattttattgagttgattgacgcattccgttcgaaagcaaagtaatcaggagctaatcatgccaaaacgtacagacataaaatccatcctgattcttggtgccggtccgattgtgatcggtcaggcctgcgaattcgactattccggtgcccaggcttgtaaagccctgcgtgaagagggttaccgggttattctggtcaactcaaacccggcaaccattatgaccgacccggaaatggccgatgcgacctacatcgagccgattcactgggaagtggtgcgtaaaatcattgaaaaagagcgcccggatgcggtgctgcccaccatgggcggccagacagcgctgaactgtgcgctggaactggaacgtcagggcgtactggaagagttcggcgtcaccatgatcggtgcgaccgccgatgccattgataaagcagaagaccgtcgtcgcttcgatgtggcgatgaaaagcattggcctgggtacggcgcgctccggtattgcgcacaccatggatgaagcgctggcggtggctgcagacgtcggctttccctgcattatccgtccgtctttcaccatgggcggcaccggcggcggtatcgcctataaccgcgaagagtttgaagagatctgcgaacgcggcctcgacctttctcctaccaacgagttgttaattgacgaatcgctgattggctggaaagagtacgagatggaagtggtacgtgacaaaaacgacaactgcattatcgtctgctccatcgaaaactttgacgccatgggcattcacaccggtgattccattacggttgcgccagcacagacgctgaccgataaggaataccagattatgcgtaacgcctcgctggcggtactgcgtgagattggtgtcgaaaccggcggttccaacgtacagtttgcggtgaacccaaaaaatggtcgcctgatcgttatcgagatgaacccccgtgtgtcgcgctcctcggcactggcctctaaagcgaccggcttcccgattgcgaaagtggcagcgaaactggcggttggctatacgctggatgaactgatgaacgacattaccggtggacgcacgccggcctcgtttgagccttcaatcgattacgtcgtcacgaagatccctcgcttcaactttgaaaaatttgccggtgcgaatgaccgcctgaccacgcagatgaaatccgtgggtgaagtcatggcgatcggtcgtaccttccaggagtcgatgcagaaagcgctgcgcggcctggaagtcggggcgaatggcttcgacccgaaagttcacctggacgacgctgaggcgttaacccgtatccgccgtgagctgaaagatgccggttcggatcgtatctggtacatcgccgatgccttccgcgcggggatgtcggtagacggcgtatttaacctcaccaacattgaccgctggttcctggtgcagattgaagagctggtgcgcctggaagagcaggttgcgcgtgaaggcatgaacggcctcaacgtggatttcctgcgtgcactgaagcgtaaaggttttgcggatgcgcgtctggcttcactggcgggcgtagcggaaggtgaaattcgtaaattgcgtcagcaacataatctgcacccggtttataagcgtgtcgatacctgtgcggcagaattctctaccgatacggcttacatgtactccacctatgaagaagagtgcgaagcgaatcctaatcaggatcgtgacaaaatcatggtgctgggtggcggaccaaaccgtattggccagggcattgagtttgactactgctgcgttcatgcggcgctggcgctgcgtgaagatggttttgaaaccatcatggtgaactgtaacccggaaaccgtctcgacggattatgacacctctgaccgtctctactttgagccggttacgcttgaagacgtgctggaaatcgtacgcatcgaaaaaccgaaaggggtgatcgtgcagtacggcggtcagacgccgctgaaactggctcgcgcactggaagcggcaggcgtaccggtaatcggtaccagcccggacgctatcgaccgggcagaagatcgcgaacgcttccagcaggccgttgaccgtctgaacctgaagcagccggctaacgccaccgttgccacgctggagcaggccgtagagaaagccgccggcattggttatccgctggtggtgcgtccttcctacgtgctgggcggacgcgcgatggaaatcgtctatgacgaaatcgatctgaagcgttacttccagacggcggtgtcggtttccaacgatgcacccgtcttgctggatcgtttccttgatgacgccgtagaagttgatgtcgatgccatttgcgacggcgaacgcgtgctgattggcggcatcatggagcatatcgagcaggctggcgtccactcgggtgactccgcgtgttctctgccggcctatacgctgagcgaagagattcaaaacgtgatgcgccagcaggtcgaaaaactggcgtttgagctgagcgtgcgcggtttgatgaacgtgcagttcgcggtgaaagacaacgaagtctacctgatcgaagtgaacccacgtgccgcgcgtaccgtgcctttcgtgtcaaaagcgacaggcgtcccgctggcgaaggttgccgcgcgcgtgatggcaggcaaaacgctggcagagcagggcgtaaccaaagaggtgatcccaccttattactctgttaaagaagtcgtgctgccctttaacaagttccagggtgttgacccgattctcggtccggaaatgcgttcaaccggtgaagtcatgggcgtgggccggaccttcgctgaagcctttgccaaagcgatgctgggcgcgcagagcaacatgaagaaaaccggacgtgccctgttgtccgtgcgtgagggcgataagaaacgtatcgtcgatttggccgctaagctgcagaagtttggcttcgagctggatgctacccacggtacggctgtggtgctgggcgaggcgggcattaatcctcgtctggttaacaaggttcacgaaggtcgcccacatattcaggaccgcctgaagaacggcgaatatgcctacatcgtgaataccacagcaggtcgccaggcgattgaagactccaagctgattcgtcgcagtgctctgcaatataaagtgcattacgacaccacgttgaacgggggttttgcaacggcgatggcgctcaatgcggacccaacggaaaaagtgatttcagtccaggagatgcacgcacaaatccttgcgcagaaatagcgcgggctgatcgcgcgtcatcgcccctgtggggggatcgtctgtcagtagtctgacagaccgtcctgcctgcaggggcttttttgtgtttaatcccaggaagcctgtcgggacaacatcggccagcaggccgttgcattgcgcgcaaagagcggcgtcagcgactgttttacagatggcggaaatacggttgctgctatcggcggtcagtggcaagcgaagacttcatcaaggtgaggtgccgcaggcattattgctggggctgggttttatcagaccgctgttcatagccgatcagacaaactctgttaaaccctatttaaattttgcgcaatacaggctgttaatcatgatggctggtgctgaataacacgctgttctgtatttggttttacctgttcttttcaaaattatgacaaattacgaataaaaagatgtttaaacctgctttgcgaaacgtggcgcactaaatagggatatgttgtcatttaaatacttgttaataatatcaactcattccctgttgattcctctttctctgccttctcctgaccatttgactgttattaaacggattttaaacgaacctgtattgctgccgatcacgcttgataatcaactgttcagttgttccgcttaactttaagatgccctgtgttttgcaaggttttacgttttcagagaacagcctcgtttttctgaagtttaaagacttaattaagagctcgtgtttaatatgtttattcccaaatttttcaggtggggacagtgctcttttgacgattatcaaatagcctgtaatagttttggttacaactgcgagtcagcgccgggatttattgcatttaaaatgcgacatgagcagtcctttgagttttatgcttataaacgtaaaggcaaaatagtggggagcgtttgcgtcgaaaatggctggcttgccaacgacggcagacaccggcaacgttctcttcccgcactgcttacaccgtcaacatccgtctatgtgcctttttgcaacgaggttccgcaaaaggtgcttttacctttccgttgtaagtcgctgcatcacttgcagagtcagcggtttcttaatacgtcttatggcctgttgagtaaaagccatgctgcttttaccaagaaccctgctgccgacttttcccggaaaaccgtctccacgcgggaacgtgagttacgaaagtttcttaatgacgggggcagttttctcaacgtcagccagcttgatggcgaacacatttttgacgtatttgagaccctttaccaggcgagacgaaatcaggctatcgctgacagggaaatcaataaagcgttcttccgggaatttcagccttgtttcaaaggctacatcatgttcctgaataatgaacctgttgcgctgcagctgttgttatctgtatccagctgcgccgggatgttcgttgattttattaatatcggctaccggatggacagcaacgcaggcgctgtgggtacgatgttgatgtggaagaacctgacgtctgtgtatcaggacgctgccgatacgcagctcccgctctattactcctatggatcgatgtccggggactataaaaaccggtggtgccattcggtcaataatggtcgtgtcattatctgattgctcagatcggcaaggccgcattgttgcccgtctgagtcagtcgatgatattgggaatgcgactgcgcgaggcgaaacgccctttattcatgcccgcgccatcgggcgttgcccgccaaacaggcctttttcgcattattctgcacactttcccctgccagcgcggtggcagcggaaacgtgcctgctacatctgtcaggggataatcttcgccgttctgaactgagtaaagagacggataaacatctcatcggtcgcacgaaaacccgtaaaccccgcccgccgcagtttgctgccatcaccaaacatgtcgtaatcccagctaaacacaaagtctgcgaactgaccgttactcaacttcatgatatcaggctcgaccaacagcgttttttcagccagagcctgccaggtcttgcggtaatcgctaaagagttgctgaaacgacagctggaccggcggggccatctccagttcaaaccagcccgcaatgaccggccagagttcactccaccgccagatgtcaccgttgttaacattgaatgcctgatttctggctgcaggggcggtcgaggcccatagcgtggcggcagaaagtaagccgtcatccgtatgatcgacaatgctatgccaggctgtttgtgacccgggaaagcgtaggggcaggctctgcgctttgcacagtgaggcatatatcgcgatactcagcgcaagattcatggtattgccgggtaatgcgctgccaaccacgccggggcgaagcgcatgccagttccaggttttattgcgctgaaagtcgcttagccaggcctgttgcgccgtattgaattccgcgccgggaatggcagcatcattttctctggcgggcgttttaaagggcccaaggtgagcgccgtaaattttgtagccctgcatcaggctcaccgtttccagcggggcaactttctcaacctgggtgaccagattacgcagcagggtcacgttgggttcaaccatctcctgccagttggcggcattaagccaggcgctatagaaaatatgtgtcacgttactcagtggcgtaagggcacgcgcgctgtctttctcatccagcagatcgacttttacaaacgggaccgcgccgtgccgatcggtgcctgaacgtgacagtccgataacctgccacgcattctgcaacaacgttttgaccaactggctgccgacaataccgcttgcgccagccaccagtgcaactttagattgaggcttctgtgacattttctttcctccggttaggttgcagacagcgtgatataaatttcttttcgccgatatccccgcaagctgatgtcacttataagagaaatgcgtaaatgaataacaagctcaatgccattcgcacctttttacgtgtagccgaggccggttccttctctgccgccgcgcgccagttgggtatcaagcagtcagcggtcagtcagcagatcgtcgcacttgaggccgagctgggcgtcgtcttgctgcaccgaacgacgcgcgtgatggtactgacggcgcaaggggaatattaccgtggccagatgcggccgatacttgaggcgatgctggcagtcgagagccagttgtcttctgccactcagcagtggcaaggcaaggtaaacatccagttgcccggcgggttagggcggctttttcttccccacctgctcgcgctgcaaaaggcgaatccggggttgaatctgacgctgtcgctcgacgatcggatatctgacctggccagagaaggcgtggatattgccttccgactgacccatgacgcaccggatgtgtttccggcacggaagatcgcccgaattgaaacgccgcttttcgcgtcaccgcgttttccgccaatcgcttcgctggatgcgctggcgcttcacccgcatgttcgctttagcagcatcgacgagtctgcgccattacggcttgtcagagatgatgaaaccgtagagctggcggtgaatacggtcttcagggccaacagcagtgagggattattgcaggcattgcaggcggacatcggtgtcggtggtatgcagctaccgcttgcaatggaggcactgaaatccggcgcgcttgtcaggattttacccgcttatcgccatcctgaccgctttctgtatgccgtttttccggatgcacgctttattcctgtcagggtaagaggcatcgccacgttaatcgaaaaggtgctggccgacctgcccggggtaaactgaacgcctctgtacggacggcatgaagcggtgagagataagagcggcctgagggggtgaatcgcacaggacaaacccggtatgcgtggcgtcctgccagcttgacgttaatatgcttaagttaatttgatttaatttttagccaatcatgcctaatccgctgattcgcacaaatctataatataaaaaactaccaggctgacattcaccgttgtaatatccggctcgctcattaatagagcctaaacaggatattaataacaatgaaagcgcgttttttttcactgagtgcagtggctgcactgttggccctggtgtctttttccagccaggctgaaatcactcttcttaaacaagacccacaagcaggcgatccccttagccgtctcgattttaaattcggtggcagcattcgtcctcagttcaaccatcaaaccggcgggaaggatcagtcctacaagcgtaacggctttgacggtggttcccgtttccgctttagcgcggattactacctgttcgacgatatcagctggaccagctactacgagctgggcgttaacattccggctgtattcaactgggataatcactacgctgaaggggcgcatgaaaccacgcgtcgccagctctatacgggcctgaaaagtaaaacctggggccagttgaccttcggtcagcagaacagcgtgtattacgacgttgtgggtgccaagacggatatctgggattacgacatgctggcccaggcaccgggtaacggcattaacggtgattacgacggttcataccgttctcgcaagcagctgaaatacaaaaacagttatggtgcatttgatgtttatgcctcttacctgtttagcgataacgaatatttgccgggcaacggactgcgctataagcgtcagggtggcggctcgctgggtgtgaattacaacatcacgaacaatctggcctggggcaccgcgtggaactacacccgcgccaccatgcgtaatcctgtcaccggcgacaataaagattacgaccagaacatctttggtaccgcattaagctggacgccaggcaactggaccctgtcagcaggaggcggctggtaccagaatttcctgacgaccagacagcgcgatgtgaataactattttgctgatgatgcctggggcattgaatattatgccggttataaaattccggttgcgcagtatggcgtcaaagccgttcagccttatgtcatgggtgaccgcttagaatatgtgaatggccgcaattaccagcgcattgataacggtctgggcgtaaccctgttcctggactatggtttccgtgttgattacgaacatgtcttcacgtcgagcacggacaatcagggcgatatgaatctggttcgtttccgctacgatttctgatgacctgccacggctcccacgggagccgttttattctctctgtttatcgcgacgtggcaccattatctggcgacttttggggcgcgtggcccgtcttacggagtaaaaccctgcacaaagtctgaaatacggtggcaatgccgctttatgcaataaccccctttcgcctatcgacgaaggtttaacctttacgtatcatggcgcctgtttttttcagcgagccttttaacatgattagtcttatcgcggcattagcagcagatcgcattattggaatggaaaacgccatgccgtgggacctgcctgcagatctggcgtggtttaagcgtaacaccctgaaaaaacctgtgattatgggccgactgacctttgaatcgattggtcgtccattgcctggcaggctgaatattgtggtcagcagcaagccgggtaaagcggaaggcgtcacctgggtgacatcgctggatgatgcgatcaacgcggcgggtgacgctgaagagatcatggtaattggcggtggtcgtatctatgcgcaaatgctggcgcgcgccgaccgtctttatctgacgcacattgatgcggaagtcgaaggtgatacgcaattcccggattacgaaccggatgagtggcactcgacgttcagtgagtttcatgatgcggatgcgcagaactcccacagttactgcttcgagattcttgaacgccgccgttaatgaatacgcagtaaaaaaacgccttgtcataacaaggcgttttttatggctgcgggttagcgggctgactgctgcggagcaaggtcgtccggtaaggataactggcggttcgatggctgaacgtaatagcgttgcgtttcccagtgcaggagcgtcaggttaccgccccagcagcaaccggtatccagaccgataatacctgccggcgtgcctttaccctcaagtgacgcccagtgaccaaagacaatcgtgtgatcgcgtgcgaccgggccttcaatcataaaccagggctttaaaggcggcggcgcggattccggcgcatccttacagatcatatccaactgaccattgggaaagcagaagcgcatccgggtcagggcgttggtggagaaacgcaggcgtgccagaccggtcagggagtcgttccagttgttaggcatgtcaccatacatcgcatcaagaaacagcggatagctgtcgctggacagcacggcttccacttcgcgtgcacagcgttgcgctgtatccaaatcccactgcggggtaatcccggcatggcccatcaccagctttttctcttcgtccacctgaagcagcggctgacggcgcagccagttaatcagctcatcagcatcttccgcttccagcagcggcgtcaggcgatctttaggcttattacggctgataccggcatagacagccagcagatgcagatcgtgattacccagcaccagacgaacactgtcacccagtgacttgacgtagcgcagaacgtccagcgagccagggccccgcgcgaccagatcacccgtcagccataatgtatcctgactgggatcatagttaacctggtttagcagagcacgtaattcatcgtaacaaccgtgaacgtcgccaatcaggtaagtattcatagaggattatccaactaaaacagtcgcccgagatacgggcgagagacatcaaaatcaatgaatatgggtttgaatcgcgaggcggaataccgggatttcaacgtggaattcgtcgccttgctcatcgaccatcacatagtgaccttgcatggtgcccattggggtttcaagaacagcaccactggtgtactgatattcatttcccggcgcaatatgcggctgttcgccgatcacgccttcaccctgaacttctgtttcacggccgttaccgttcgtaattagccagtaacgcctgagcagctgcacagaagaccggcctacgttgcgaatcgtgacggtataagcaaagacatagcgctcttcgtccggtgaggactgagaggcgacatacagactttgtacgtgtagcgatacgcgggccggttcactcatgggttactcctgggttttatccagatggtctgccagccagtttgctaactggcaatactgtgcaaccgaaacattctcggcacgtaagccggtatcgatcgccagcgcgtccagcgcgcctgcctccaccatatggctcaggctgttgcgcagtgttttacggcgtttaccgaatgcttcagtggttatacggctcagaatacgcacgtctttaaccggatgaggcggtgccatataaggcactaaccgcacgaccgccgaatccactttcggtggcggggtaaaggagtgcggcggaacttccagcaccggaatgatctgacaatagtactgagccatgacgctcagacgaccataggctttactgccaggaccggcaaccagacgattaaccacctctttctgcagcataaagtgcatatctttaatcgaaccagtatagctgaacagatggaacatcagcggggtcgagatattgtagggcaggttaccaaagacacgcagcggctggcctttctctttggccagcgcggcgaaatcaaacgtcatagcatcctgctgaaaaatcgtcagcttggggcccaaaaacggatgggtttgcaggcgtgcagcaagatcgcgatctaactccaccaccgttaaactgtcgaggcgttcgcctaccggttcagtgagtgcaccaaggccggggccaatttccactatcgcctgatcgcgttgtgggtgaatggcggagacgatactgtcgataatatattgatcgttcaggaagttctgcccgaaacgtttacgggcatagtgcccctgatggacgcgattattcattactgctcttgatcatagtgatggcgaggttaagcgccgtgataaagctgcccgcgtcagcctgacccaggccggctaattcaagcgcggtgccgtggtcaactgaggtgcggataaacggcaggccgagggtaatattgaccgcccgaccaaatccctgaaacttgagtaccggtaaaccctgatcgtggtacatcgccagcactgcatcggcacgttgcagatatttcggctggaacagggtatccgcaggcagcggaccggtcagttgtatgccttgctgacgaagttcattcaatgccgggatgatcgtatctatctcttcccgccccatgtggccgccttctcccgcatgaggattcagtccgcagacaaaaatatgcggctgggcaatggcaaacttatttctgagatcctgatgcaggatcgtgatcacttcatgcagacaatcacgggtaacggcggcggcaacatcttttaacggcagatgggtggtggccagagccacacggagctgctcagtcgccaacatcatcaccacgcgctgagcacctgcacgatcggcaaaaaattcagtatggccggtaaacggaatgcccgcgtcgttaatcacgcctttgtgcacggggccggtaattaaggccgaaaactccccggataagcacccgtcacaggcgcgggccagggtttccagcacgtagttgctgttggcgacgcatagcgtgcctggcgtgaccggctgcggtagctcaacgggaaggacggtaagcgtgccggcctgttgcggttcggctgtgcgggcgggatcgtaaacgcgcaacgtcaacggcaaccccagctgtgcggcacgttgcagcaacagctgaggggacgcacagacaaccagttcaacgggccaggcctgctgggccagttgaacggcaagatcgggaccaatcccggcgggttcgccgggcgtgatcaccacacgaaaatcactgcgcattgttatccagaattttcacgtaagccccggcgcgctgttcctgcatccaggtctgcgcttcttccgcaaacttacggttaaacagcatgcgataggcgcgctctttctgggccgcatcggttttatcaacctggcgagtatccagcagttgaatcaggtgccaaccaaaagaggagtgaaccggctggctggtttcgccttttttcagacgtagcaacgcatcgcggaaagccggatcgtacgcttctggtgaggtccagcccagatcgccaccctgattcgcggaacctggatcgtcagagaattgcttggctgccgcggcaaaggtggttttaccactgcgaatatcggcagcaatctgctccagcctggcgcgagcctgatcgtcggtcatgatcggagaaggcttcaacagaatgtgacgcgcatgtacttcggtcacagagacgtttttgctctcgccgcgcaggtcgttcactttcaaaatatggaaacctacacctgagcggatagggccaacaatatcgcctttcttcgccgtggtcagcgcctgagcaaacagggtaggcagctcttcgattttcgcccagcccatattaccgcctttcagcgcctgagagtcggcggagtaggttacggccagcttgccaaagtccgcaccacctttcagttcagtcatcagctgttttgccagcttttcctgatcgtcaacctgctgctgcgtcgggttttccggcagtggcagcagaatgtgactgatgttcatttccgtgccctgggtgttctgcgcgccaacctgctgcgccagcgtatccacttcctgcggcaggatcgtgacccgacggcgtacttcattattccgcacttccgagatcagcatctctttacgaatctgagcccgataggtgttgtagttcattccatcataagccaggcggctacgcagttgatcaacgctcatgcggttttgcgcggcaatattctggatagcctgatccagttgctgatcgctgatttgcaaaccggctttatcgcccagttgcataataatcgcgtccatgatctcacgttcgaggatctgatggcgcaacgttttgtcatcgggcaactgctgacctgcttgcttcgcctgagatttaacggtgctcatcatgctgtccacatcactctccaggaccacaccgttattcactacagctgcaactttatcaaccacttgtggtgctgcgaacacggtgttggcacttatcgccacaccaagaatcagcattctccagttcttcatactttatccattattggttccgcactgcgggattgcctgtcaaacatcacaacatcagaatgcatgctgataagggatgattccctgagccagcatctggccggtgcccagcccataatttgaactcaggccacgtaactcaatgttgaatgagatttggttgtcatacttactgtcgttgttttgccaaccgttgattttgcgttcatagcccagacgaaccgcgtaacaacaagagctgtactgcaggccaaccaactgtgatgcaggacgattattacgcgtatcatagtaatacgcgccaaccaccgaccaggcgtcatggatcggccagctcgccgtcgtaccaacttgtgaaatcccgtttttataaatcgggttattcaccagtgagctgtcatttagcgcagaagcaacatactccgggctactgtaacggtagctcaactgcaccatacggtcagcgtcacgacggtattccagcacggtattaccctgcgcgacgttattcaggcgggtatcgtattgcagcccgccacgcacgccccaacgatcgcttatcttccagtagctgtcacctgcccacaggagactgccggtatcatcttctttgttgacctggttaacgcccgtacgagaaggcgtaaacgaatagatttgacccacagaaacgttaaaacgttcaaccagatcggtatcataaattcgcgtcgtcacaccggttgcaacctggttggccgatgcgatgcgatccagaccgctgtatgagcgatcgcggaacaggccggtatagtcggtttgcaacagggtggagtcgtaaggatagatatcactctggtcacgatacgggatatagaggtactgaacccggggttccagcgtctgggtataaccctgcgcccagtccatatcacggtcaaacaccatgcgaccatcgaccttaaactgaggcaaggtgcggttgacggagtctttcagcacaccactggtggtgctgctcggtgcaaagttagtgttgtagtaatcaacatctttttgctggtagtgcgtcgccagaaacttggcttcggtatccaggctggcccagccgtttgataacggcagattgatggtgggctcaacatgtaaacgtgtggtttcagggaaactactgtttacgttggtgaacttcacagcctgcgcataaatgcgcgtgtcaaacgggccgacatcgttctgataccagttcacatccagttgcgggaaggcgcgatagacgttgctgttgctggtattaccaaaaatctggaagtctttggtcgacagggtcgcgtcccagttggtatccgcgtagcccacgctaaatttctgcgaggcgtaaccgtcagtcgagctgtaataaggtgaggtcagatcgttgaaataatactgatcgctgactttggtgtagtcagcgctaaaacgccagtgctggtcataaacacctgaatggcgccagtaaaataaccagcggtcggaactgtcattttgggcgatgccgcgcgcggctttatcgttgtcgtactgcttatccgatgccagatagtcgaactcaacgatgcctgcacccgcctgggtcaggtagcggaattcattctgcaattgcagcccgcgcttactcatgtaatgcggcgtaatggtggcatccgcctgcggcgcgatgttccagtaataaggcagaatgaattcaaaaccgttgctgctgccgtatttggcgttggggatcaggaagcctgaacggcggcggtcgcccagcggcagctgcatatagggactgtagaatacgggaaccgaaccgagcttaaagcgcgcattccagatttcagcaacctcttcctgacgatcctgaataatctcagaaccggcaacgctccagctgttactgccaggcagacaggaggtgaaggttccgttttccataatggtgtaacggttttctccgcgcagcttcatttgatcgccagtgcctcgcccctggcggtctaccatctgataatcgccgttccagacgttcgtatctttggtattaagatttgaccaggctttcggacctttcaggatgacctgattgtcatcgtagtgcacattacctagcgcatccacagtacggacgggaaccgtctgcccttcgggctggcgttgatgaagctggacttcgtctgccagcatgcggctgttgccttgcttaacatccacatcacctgtgaataccgcatcgtcagggtagttgcctttcagtgaatccgagtgaatagtaacgggcagctgattaggatcgccgttaaccaggggacgattgtaactgggtacgcccaacatacactgcgacattaaatcgtcggcgaaggcttgctggctaatggctgcgccgatcatggtggccagcagagtaggtatatgttttttcatacgcggtatcgaaaattccatgaaaactggcatcatgccgacaatcgggtcagagactaacgcactgcctggcgttgtgccagtgttaatccttttctgtccgcgctgccgttaggcgctgagataaatgacaggtatgataatgcaattttcagccgtaagcatggcgaattgaggagtttatgcgctactggggaaaagttataggtttagtgcttggattgctgtccggcgcaggcttttggggaattgtaattggtctgatcgttgggcatggatttgataaggttcgcggtgcgcagagcaaggcttacttctcaaataatcagacccggcagtcactgtttttcagtacgacttttcaggtcatggggcacttaaccaagtccaaagggcgcgtaaccgaagcggatatccagattgcctcgctgtttatggatcgcatgcagttgcacggagaggcccgaacggctgctcagcgtgcttttcgtgaaggcaaacagggcgagtatccgttacgtaataaattgcgtgaattacgcagcgcctgcttcggccgttttgatctgattaggatgtttctggaaattcagattcaggcggcctttgccgatggctcactgcatcccaatgaacgtcaggtgctgtatgtgattggtgaagaactggggatttcacgcagccagttcgaccagtttctgcgcatgatggaagggggccagcagttcggtggcggccgcagctactcgcaacagggtggctttcaacaggcgcaacgtggcccgacgctctcggatgcctgcaatgtgttgggcgtgaaaacgacggatgatgccaccaccattaaacgcgcctatcgcaagctgatgagtgaacatcacccggataagctggtggcgaaaggcctgccgccagaaatgatggaaatggccaaacagaaagcgcaggacattcagtcagcttacgatctgattcgcaaagaaaaagggtttaagtaagcggttgatgcgcgcccgggcgaatggccagggcgcgcgaatacccggcatggcgcgcgggttaaaaatcggcaggctgcctgaaggtcatggcattaccaaacgctgggtgcgtaatggttaatgattcggcatgcagcagaaggcgctctgccatggcttttgcttccggatgggcataaaaaccgtcccccagaatcggatggcccagcgccagcatatgcacgcgcagctggtgcgaccgcccggtaatcggcttcagtacaacgcgggcgctgttatcttcgcgatattcaatcacctgatagtcggtttgtgccgacttgccggtctcgaaacacactttttgttttgggcgatttggccagtcgcaaatcagcggtaaatccaccacgcctttctcgtgggccggatggccccagatccgggccacataggtcttcgcgggttcgcgctcgcgaaactggcgtttaagctcgcgttcggcggctttcgtcagggcaaccactatcacgccactggtcgccatatccagccggtgcacggactcagcctcgggataatcgcgttgaatccgcgtcatcacgctgtctttgtgctcttcaagccggccgggtaccgaaagcaggccgctgggcttattcaccaccatgatgtgggcatcctgatacaggatgtgcagccagggctcctgcggcggattatagggttccataggttattccaaaaaagagggccttgcggccctgaacttattgatgcgtaaccacaatcagacgcagtgcgtccagtcgccagttggcctcatccagactctccagcacctgctggcgattgctttctaacgcctcgacttcatcgtcacggatgttggggttcacggctctcagggcttcaagacgggataactcggcccccagcttttcgcctgcctcacgccgcgccgcgtcaatgacggcgcgcgcttcactgacgacttctttttcggccagcgtaagaatcgcgtgaacatcctgctgtacggcattcaccagcttactgccggtatggcggttaaccgcattcaactgacggttgaaactctcgaactccactttaccggccagattcgtaccgttgcgatctaacagcagacgcacgggcgttggcggcagaaaacgggtgagttgcagatgtttcggcgcctgcgcttccaccacatagatcatttcgaccaacagcgttcccacgggtaaggccttattcttcaacaatgacagcgcacagctcccggtgtcacccgacaggatcagatccaacccattacggattaacggatgttcccaggtgataaactgcgtatcttcacgagatagggcctgatcgcgattgaaggtgatcgtgcagccatcttctggcaggcccgggaaatccggcaccagcatatgatccgatggcgtcagcactatcaggttatcgctgcggtcttcctgattgattcccacgatgtcgaacaggttgagggcaaagttaaccagctcagtatcattgtcctgctcggcgatggtattcgccagcgcctgagcggcgtcgccaccgttagagttcagttccagcagacgatcgcggccctgttccaactgggatttcagcgcgtcatgctgcttgcggcattcaatgatgaaatcatcaaaaccgtcgctgttttccggcgcagccagatagttgatcagctctgcgtgaacgctgtcatagattgctctgccggtcggacaggtgtgctcaaacgcatccagcccttcgtgataccagcgcagcagcacggcctgcgccgttttctccagccacggcaccagaatctggatatcgtgtgcctgaccaatacgatccagacgaccaatacgctgttccagcagatccgggttaaacggcagatcgaacatgaccagacggctggcgaactggaagttacggccttcggagccaatttcggaacacagcagcacttgcgcaccgttctcgtctgaagcaaaccaggcagcggcccgatcgcgttcaataatcgacaagccttcgtggaacaccgcagcgcgaatcccttcccgttcacgcaagacctgttccaactgcagcgccgtcgcggcctgagcgcagatcaccagcaccttctctttacggttactggtgagataacccataagccattcaacgcgtggatcgaagttccaccaggtgccggtatcgccttcgaattcctgatagatctgctccgggtagagcaggtcgcgcgcacgcgcctctgcgcttttgcgcgttcccataataccggacactttaatggcggtttgatactgcgcaggcagcggcagacggatctggtgcagctcacgtttagggaagcctttcacaccgttacgcgtattacggaacagaacgcggctggtgccgtggcgatccatcagcatagaaatgagttctttgcgcgcgtcctgcttgccttcacggtcgctgtttgccacctgcagcagcggttcaatgtcctgctcgccgaccagctcattgatcatattcatctcgctttgtgagatggcatgatcggccagcagcgaggtgaccgcgtccgcaatcggacggaagtgctgctgctcttcaacgaaggcggcaaaatcatgaaaacgattaggatcgagcaggcgcagacgcgcaaagtggctctccatgcccaactgttctggcgttgccgtcagtaacaggacgcccggcgttttttcggccagtttttcgataacctgatattcacggctgggttcgccttcggaccaggccaggtgatgggcttcatcgaccaccattaaatcccagtcggcctccgccagcttatccagacgctgtttattacgacggacaaagtccagcgagcagataatcaactgctcggtgtcaaaggcattatcactgtcatgctgtgcttcggcatagcgatcgtcatcgaacagggcaaaccgcaggttgaagcggcgcagcatttctaccagccactgatgttgcagggtttccggcaccacaataagcacgcgctcagcccggcccgctaacagctgctgctggataatcatgccggcttcaatggttttacctaagcccacttcatccgccagcagaacgcgcggcgcatggcgacgacccacatcgtgagcaatgtgcaactgatgtggaatcaggttggtgcgcatgccgcgcaggccgctgacaggcagacgatactgctcactttggtatttacgtgcacgaaaacgcagggcgaagcgatccatacgatcaagctggcctgcgaataaccggtcctgaggcttactgaacaccagtttgctgtcgagcatcacttcgcgcagcataacgtcggtttcctgggtatcaaggcgcgtaccgatataggtaatcaggtcattgtcattgcggacttcatcgacctgcatctgccagccttcgtggctggtaacggtatcacccggattaaaaatcacgcgagtgaccggcgagtcgttgcgagcgtagaggcgattttcccctgtggccggaaaaatcaacgtgatcatgcgagtatcaatcgccaccacggtgcctaatcccagttcactttctgtatcactgatccaacgctgacctaatgtaaaaaccatataatttttgctcgaatttttaacgtttttgaaggtgttccccattctcaggcaatagcatgtcaaccaggcaaaagggcctggtacgtcatgtcagagcagtgagttttgaggaagggcattatggtactggatggcagggcattcgtcacctgtcaaaaaagccctaactgcccggtaatgagtgtagcaaagtcaccctcgacgaagggcagaatgccttcggctacgggttgcagctgttttgtgacgtaatgatcgtagtccagcggcgtggttcgggcctccacgggctcaggaccgccggtggcaatcacatagcgaatgcggccgccggtctggtattgcagcggcctgcccagtttacggttctgttcatcagccaggcgggcggcgcgaacgtgcggcggcacgttccgttcatactcgttcagcgggcggcgcaggcgctttttgtaaatcagctgatcgtccagctcgcccgccagtaattgcgccacggtggtacggacatattcctcccacggctggcgatgaaatatccggctgtaaagcgcctgctgaaactgctgcgccagcggcgtccagtcggtacgtaccgattccagccctttaaacaccatacgttcaccttcggcctcccgaattaagccggcataacgtttcttactgccctgttcggcaccgcgaatggtgggcatcaggaagcggcaaaagtgattttcatactccagctccagtgcgctggtcaggccgtattgctgttgcagatgcgtgcgccaccagtgattaaccttcaccgccagcgagcggccaatggcttctgcatcggcttcactgtgggcggatttgagccagacaaaagttgagtcggtatcgccataaatcacatcatagccttcggcttcaatgagctcgcgggtttgctgcatgatggcgtgaccgcgcagggtgatggaggaagccagccgtgggtcaaaaaagcgacaggcgctggtgcccagcacgccgtaaaacgcattcatgatgattttcagcgcttgcgacagcggtttattaccctgctgttttgcggtttcacgtccctgccaaatctgttcaacgatagccggcaggcagtgcgttgtgcgggagaaacgtgcctcgcggaaaccggtgacggagtcagcgtcagcagggtgcgccaggccgtcaatcaggccgacgggatcgatcaggaaagtgcggataatcgacgggtacaggcttttataatccagcaccagcaccgaatcatacaggccgggacgggaatccattacgtaaccaccggggctggcctctggtgcaacatcgccaggattaggcgcaacaaaaccgacccgatgcatgcgggggatatacagatgactgaaggctgcgacggagccgccgtggcgatcgactgccagcccgttgacggctgcgcgctccagcaaaaacggcataatctcggttttgtggaagatgcgcgtcaccagctcacagtctttcaggttatagcgcgccagcgccggtttatcgttggcaaaacgccagttgatctcttccatgcgctgccacggattatcaatggctttgccttcaccaagcagctgctgcgagacggcctccagactaaaagagggaaagtcccagaaggcggatttcagcgcatcaatgccatcgataatcaggcgtccgctggcctgggcaaaaaaaacgccgggtttaaaaccgtgctctcgccactccagcacggcctgctgtcggccaagacgcaacggaatgccgtagcggtcggcgtgtttttgcagcacacgcaggtcaaactgcaccacgttccagccgatgatcacatctgggtcgttgtcggcaaaccagcgattaagcgcgtccagcaactgcgggcggctttcaaggtagatgagttcgaaatccagtgcgctggcatcaccgttaggcggccccagcatgtaaacctggcgctgaccgcagccctccaggccgatgcagtaaagctccccgtgctgagtggtttcgatatccagcgatacccactttagtggcgggcggtaatcaggatgaggtttaagacgagcgttaaccaccgaatcgccctgaatatctccatcgaaccacacgggcgcggtaataaaccgttccatcagatagcgctcggggggacggatatcggattcatagagaggaataccgttttcacgcagttttttttcaatccactgcaactgacggtgctggcggcagtaaaggccaaataccggacggcggcgaaaatcttttaactgcaaaggttggatgcgcagctgacgctcgtcctgcaacagcgattccgcctgggcctgatattcaacgggaataaaggccaccgattcctgcgcgggcagcacgacgcgctgagcacctgaatcggtggccagccagagcgtaatttcagtgccttgcggcgtatcgcgccagtgacggctgagcagaaaccctgcgcggggcttattcacgtattctccaggcagacagcgagtcggaagtgtaggttaaaaagtataacatggatatttatacagtgtctgccggtgcgttttgtcaatattgacctacaattcttgccttgacgctgtgatgtctgctctggacaatccagccttctgcttttactgaggattgatatggaagcctgggttgaacacctgattacacagtcgctggagtgggcgttgtttgccgtggcgctggtgacatttctggagtcattagcgttcgtggggctgttactccctggaaccgtgatgatggcaagcctgggcgcgctggtcggtagtgggcagataggattatatccggcctgggcggcgggcttcgtcggctgcctgttgggcgactgggtgtcttatggcatcggctggaagtttcaggggccgctccatcgctggaaatacctgcaaaagtacaaagggttactggataagaccgaacatgcgctgtatcagcacagcatgtttacaattctggtcgggcgctttgtgggcccaacccgaccgttaatcccgctggtggcgggcatgctggaactgccggtgcgtaagtttctgccccccaacctgatcggctgcattttatggccaccgctctatttattgccgggtattctggcaggcgtcgcgattgatgtaccgaaagaagccaggggcggtcatttcatctggctgttattgggcgttgctattctggtgtggctgggatgctggctgtgctggcgctggtggcgcagcggtaaaacccgcgactgggcgacggcgtatttgccgccacaacgcctgcgctggctggcaccgctgagctttgtcgtcgccgttgcagcctttgtcggcatccagtttcacccgatgatgccgattttccgccatctgttgtggcaggtctttattggctaacgaagcgggatgccgagcacatcggcttcccgtatttcgcctgacaacagcctgtccgtcgcgccatcccagtaaacccgtccgtccaccacgacaacactgcgtggtgcaatctgctgcgcatcttcaaggctgtgcgacaccatcagcaacgtgatcgcgcgggtttcgcagacgctacgcaccagatgaagcatctcaccgcgcagggccgggtcaagcgccgaaaaaggttcatccagtagcagcagcgggcgatcgcggagtaaacagcgcgccagcgcaacgcgctggcgttgtccacccgagagctgacccggcaggcgcgtcagcatatcgcttaaccccacctggtgggcgatagccgcgacctgctgacgttgcgctgaattaagcttcaatcctggatgtaagcccagccccagattttgttcaacgttaagatgtggaaacaggttgttttcctgaaacagcatcgacaccggtcgctgagcgggtacgctgtgggtgtgatcgacaccgtcaatcgtcaggctgccctggctaacaggcagaaagccggctatcagatttaacagcgtgcttttacccgcgccgctgggaccgagaatagccagccgttcgccgcgaatggcgttcagagaaaaacgcatcggcaaatgctgatacaggtaagtcagattattcagtgtcagcatggcgacccggtaatttttccatcagagtgaacagagacaggcagagtaacagcagtatcagcgcagtcacggccccatctgcgccgcgataggaacctatctgctgataaaggtagaacggcagcgtgcggaaatccgcgttgccaaacagcgcgacaatgccgaagtcaccaattgacaggatgcaggcaaatgccagcgcctgcgccagtggacgctttagcgctcgccgttcaatcagccacagacggttccagccgctgatgcccagtgcgccgcaaaggcgggtgtaacgttcagcgatatctcgcatggggttttccagcactttcagcgcgtagggaatggcgattaacgcattggcaaaaatgaccacgccatccggggcgtcgggcaaaccgaccgtcgcgttcagcagcaggaaaaagcctgttgccagtacaataccgggcatcgccagaatcaacataccgctgctgtccatggcttgtgcggcgacattacgctgccgcaggcgcagctcccggctgctccacagcaacatcgtggtcagcactacacataacagcccggcaccgagcgcgatccgcaacgaggtcagggtggcctgccacagggccggttgctgtaacgcgccctgaatcccgccctccagaccattcacaatcaccgccagcagcggaggcagcagcagcagcagcgcgaaaacaatcatcacggcgtcactgacgcgtgacagcgtggagtcctgaggatcgcgccagccctgcagctgtggactgccagccggaatggctttactgaagcgttggctgaggatcaccagcatcaggcaacagcagagctgaataagcgccagcaacgcagcccggccaggatcgtagtcataacttaacgcctggaagatggccagttcgatagtggttgcctgggggccaccgcccaacgagagtacggtggcaaaactggcaaagcagagcatgaagatcagtgcgcccgtgggcagcagctggcggcgcagccagggccactcaagcagccggaactgatgccagccacgtatgttcaactgggcagccagctgccgctgttcggcaggaatgctttccagtgactgaagcatcaggcgcgtagccaacggcagattaaaaaatacgtgcgccagtaaaatgccctgcagcccgtaaggtgagaagtgatagtccacaccaagccacgcgcaaagctgtgccagccagcccacccggccataaacggtaagcaggccaaacaccgcgaccagcacgggcagtaccagggtcatggcgcacaggcgcagcaaccactggcggccaggaaagcggcgtcgataaagggctcgggatagcggaatggccggaagcagagagagcagggcagagagcagggcctgacccaatgaaaagaccatcacatggtgcagataatcatcctgcagtaccttcagccagttggtcgccggtgccgccatccacaatgacgcaaatgccaacagcgccacgctgcaaagcagtagcgtggcgagggaacccggaatcagccagcacggaattaacggctgacggcgcgttgccattggctaacccattgcgaacggtggctggcgacttcttcgggcgagaactgtaatgcggtttttggcacgctgagtgaggcaaagccagcaggcaggtcggttttgatcacgggatacatccagttgccggtcggaatagtgttctggaaagcaggcgtcaccataaattgcataaactgctgcgccagttttggctgtttactgttggccagtctggccgccacttctacctgcagataatggccttcggcaaacggcgcagcggcatagttatcttttttctcttcgatgatgtggtaagccggcgatgtggtatagctcagcaccagatcgctttcgcctttcaggaacagaccataggcttcactccagcccttggtgaccgtgacagtttttttcgccagcttttgccaggcttcaggggccttatcgccatagactttttgcatccagagtaacaagcccaggcccggcgtgctggtgcgcggatcttcataaatcacgcgccacttctccgggctttccaccagttctttcaggcttgtagggggattcttcagggtgtttttgttgtagacgaacgcaaagtaaccgtaatcgaagggcacaaaagtggtgtctttccagccgtccggcaactgcagtttgctggtatccacgtcgcttttggcgaaaaggccggtttgtgccgccgcctgcacgagattgttgtccaggcctaataccacatcggccttgctgtttttgccttccatgcgcacgcggttcagcagagataccccgtcttccagggcaacaaatttcagttcgcaatcgcactgggcttcaaacgctttttttacggccgggccggggccccagtcagcggaaaaggagtcgtaggtgtaaaccgtcaggacaggtttggcggcgaataccggggtagaaagtaacagcagcacgggcaggacgttttttaacactttgcgctcctaatggcggcagggttgagtcgcaaaggatctgagcaaagtagcctctcaaatccctacgtcggtattaaccgattcaggttcgacgggtatttctcagcgctctgacactgtggaaagaggcaccccgttgagaacgtgacattctagtcatttaacggtcaggggggaaggctcacagcgtgggcggggcaaaccaggcggatttaaaatcaaaccagcccagcgtattcattcggacgccgcgcatgcttcgctggccctccagcagtagccagtggtgaaacaacggatggagccagttattctcaaccaggtgtttaccccattcggcaaggggaagcgttttttcccgccagcgcgcggcatcctgcagccagttaaccggcaggcagtgctgcatcaacggcgtttcgtataacaacgcaaacagtgaatactcaagtggcagagtaaaattgacgctgcccagccagatatcgctttcaccctcgccctgatgccagctctcgtaactgacctctcgggttgccaaagcaacgccatgttctgccagcagtggacgtagggcatccgtaatgctgacatgctcaatatgctgattataccaggtcagcgtcagcgtcgtgaggccggcaggtttttccaccggggtcagatcgcggcgatggtgccagcggggcagcaggccgtaagccgggaaccagtagcgctgataacccatgcccgccttattgaggagtgcaatcggattaagcaggtagcttacccagcgccggatgtcccgatcggcggctttttctgaacgctgatcgaacagtaaatagtagcaaccctcttcaaggcggctctcttcctgtttctcatcggcattttcgccctgcagacgaacgccggcatacaccagctcatcgctgatctcgggcaggacccaaaccgacacatcatcgatcaacgcgcgatagccaaaataatcatcaaacgcttcgatcttcagctggctttgctgattgcgtatcacccgataggggccggttcccacaggctggcgggcaaaatcgcggatttcaggccattcacgcggcagaatcatggcgctgacgctgcccagtagccagggcagccagctgtcgggctggtctaaataaatatccagcgtccagggggcaggggaatcgatccggtggatatgggaaaacagaggatgctggcgctgacgttcaagactggcgataacgtcggccatgtccagttcccggccatggtgaaaacggatggccggccgtatatagaagcgccagtgacgatccgaggtctgctgccagtgatgggcgatatcggcttcgatttcccccttttcctcatttatacgggtcaggccgctaaagatctggcgggcaatatgggtttcggaacggcgcagtggcgatccgggcaacagattgagcagagggcggtagtaaaggacgcgcaaaatatgtttgccctggcgaaaactacgccccaggtgcgcgctaatcatctgcctgacctggtttttatcccccaccagttgaactaactgatcgatacgatcctgctccagcaggtcttcggcacgctgctgctgcagtgccagcccggtatagcagaaggtgagcagggagcgttttccccgtccggcttcggcctgccaggtcagccagccagcctcctgcattctgtttagcaggtttcgcatatggcgacgcgaacagtgcagcaaatcagccagttcgcccagggttgtttcctgcgattgcccctggcaactttgccacagacgaatgaactgctgcttcagacgtgatgaagacataaaaggggaactccgtgaggaacgtgctctgtttttcttacctcattttagaggcaagctttcctgtaatggaagagcgggaggcattcagtcatgaatggcgctctgacatggactggcagcgatgtctgtcccttctgagtcgtgtgttaccatttcgccagcagcgttattctgctggcttttttcgcttagggtaacggttctttaccggagacgggcgtcagcaccttattcatattgatgcccgtcacctgaaaaccggcggtgtcgtaaagctgacgtgcagaggggttatctgccgcgacgcgcagcctgatttgcgtgaaaccctgctcaatgagccgcttttctaacgccgccatggacgcccggccgaggccttgtccgcggaaggccgggaacaggtaaaagtcattgataaagacggatctaaacgtcaggtccggtttgtaccacaggtaaccgacaggttgtgcgttatccttactggtgtcagtgatagacaaaataacgtgcccggtcgttttttcgccgtcagggaagctggacaggatagtctgacgagcctgtcgcagcgcatcctcttgtgaaatgcggtcattgctgactatctctgcggcataatcagcaatgaaataaactgtaaacgcagcgaattcgtcagcggttagcggcctgaaagtaatcatgtctcgttctcgtcgtgaaggtggcagtcataaaacagtgtactggcgatgaaacgcgaggcaattttgttgatgattacctactaaaaaccttatccgggcagcctgagccgcgccaccaggtacgaaaggtttcgcaggcagaaggccataagaaagcggcaacacgcgcggtataacctgacatgcagtaggctatgagcatcatccgtttgttattttacgttgagtataatcaggcaaaatgaagggctgacgcccatcagtcatgcaacctgtttatcactttcatcctgtaagggacctggcatgaaatcgttgttctcgctcttcaaacgctttaatcctgtcttttttgcctttatggtaaccgcatttatcctcggtattgccggtgctttgcaggcacccacgctaagcctgtttttatcacgggaagtgcaggtgccgccgctgtgggtaggactgttttttaccatcaatgccattgcaggcattgtggtgagcatgatgatcgcaaagcgctccgacagcgtcggcgatcgacgtaatatcatcttactatgctgcgtccttgccctggcaaacgccatactgttcgcgtttacccgccattatctgacgctgataaccttaggtgtgctgctctcatcgctggcgaatgtcgccatgccacagctctttgcgctggcgcgagaatatgccgacagtgcttcgcgcgaagtggtgatgttcagctccattatgcgtgcgcaggtgtcgctggcatgggtgattgggccacctttgtcgtttgcgctggcgttgaattttggtttcgtgacgctgttcagcgtggcggccgggctgttttttatctgttttctgctggtctggttcacggtgccctcggtgccgcgcaccgcttccctgatgcagtcgggcggtattcctctgagcggctggcgtattcgtgacgtgcgcgtcctgtttgctgcatcgaccctgatgtggacctgcaacaccatgtacatcatcgacatgccgctgtggatcagcaatgatttgggcttgcccgaaaaccttgccggtctcttaatgggcacggccgccgggctggaaatcccggtcatgatcctggcgggcttctatgccaaacgcttgggcaaacgcaatatgatggtggcagcggttgcctcagccgtggtgttttacagcggactgattctgtttcacagccatctggcattgctgatcctgcaggtgtttaacgccctgtttatcggcgtagtcgcaggcatcgggatgttgtggtttcaggatctgatgcccggacgggctggagcggccacaaccctgtttaccaacagcatttcgaccggcatcatcctggcggggttatttcagggcatgctggttgaacattttggtcacggcagcgtgtactgggtaattgccgcgattgctgtgctgacgctggtgatgatcagaaaagttaaagacgtttaatacgcgcgttcccccggaataacagtgcctggggaacggtactttaaagaacaatccgcttaatatcgcctatgataaaggtataggcgactaagccaataaccgccgtaatgccgatatacactaacgcataaaaaaagctgctcgtcattgaaataataatgccaataatcaggggtgccaaaatcgaggccatattggcgcaaaaattaaatataccgccagtgagacctgccattgaagcaggcgcaatatccgcgataattgtccagcccaatccgaccataccttgaccaaaaaaggcaatggacataataatgatcacggcgctatctgaactcatccagttagcagcaatgatcatgccggaaagaattaagccgctaatgactgggagttttcggctcagattaatagagcccgttttacttaataatttatcagacagccaaccgccaaagaaaacgcctactgcggcagccataaacggccacactgagaaaaaacccacctgaagccattcaagttgccgttctttcgctaaataggtggggaaccatgtcaggaaaaagaccagtgtcgtatttccagcgaattgtccgaggctggcaccgatgatttgccgacagcatattaaacgtttagcatcgggccagttaaaaggcgtgtttttgattttttcgataggttcattgttgagaatatattcaatttcttccttgttggctttttttgatacttcaggttcatgataaaaacgccaccaaataaacgtgaaaataataccggccccgccggtgatcaaaaaaaaggctgcgccagctatgatgctccagaatgatatagagtaagggcgaaaatgccgccaggccaatatattccccgacagaataggttgcggtggcgcgagcacgttcatgacgaggaaaccattttgctactacgcggctattgaccggaaaacacggagcttcgcttagccccagtcccagcctcagtaagatcaatgatttgagtccaaaagtaaaggtttgcagtagggtgaaaatcgaccaaaacataatagaaagcgcataggtcagtttgttaccaaagcgatctaaaaacatcccaccggggatttgtgccaacgtatacgtccaggcgaaagcagaaaaggcaacgcccatcatggcaggatcgatgtcaagttcactggtgatttttggcgcaacgatgcccaggattgtgcgatcaagatagttaatcattgtaccaatggatattaatagcagaataaccattctgactttcgtgggtttctttttctgcatgtacctgccagtctgttcctcttggtatgactttttcatggtgtattcctgaagtttaaactattttttgatgttttttttacattaaaaaatagtctgacattgctaatcttttttgcttgtttatagcatttttttagtgccattaattttgacctgagtacataattagttcttttgacgatgataaagtagggatagatgatttactttttatttaaaggcaaatgccatgaacctgaagcaactttattattttaaacgcctgtcagaaactgagcattacacagaagcagcatccagcctttttatcacccagccatcgttgagtcatgctatcgcagagttagaaaaggagttaggcgtatcactcttttcccgtcagggcagaaatgtgaggattagcgaaagtggtaaatgctttttaccctatgttgagacggcactttcagcattggaaaatggcaaggaggtgctaaaaaataatcaatttctgtgccgggaaaatatccggattgcgtttatctatactatgggggaatatgttgttccgcaaattatcaacaagtattcccaacacttgtgtcataacgatgtgacattctcttttaaacagggaacgtcagttgtgttgttgcagtcactaaaagcggatagggttgatatggtcatttgttctcgcattggcgacgatcctgatattgaatttatcccggtgattgaacaagaattagtggtggtggcggcgaaagatcatccgttagcgcgtttatacgacagtgaagttgatttagcagagaccatccgttatccctatgtctatttttcagaaagtagtgggctacgtccatttattgatggaatctttcaacagcaaaagctgtcaccggacattgcctgctatgtggaagaggatttggcaatggccggattggtcagtatcggttatggtatcgccatcatgccaaggattgcggcactcgcgtactacaatattcatatcctgacgatcaaaaattcgctcccaccccgttatatttgtctggcgacgattaaaaccaaaaagctttcacccgctgtgcttaggctaaaaaactttattatcgcgaacagccaggtcgcccagaaacatgcccaaagcacggctttgggcatgtcagcatctaggaaagcgtctccatcatctcccgcaactgtgtaacagcgatttgccctggtgctgaggactggcccagggtgccaaaagtcattgctgaaccgaacaggcgtccggttacccgactgacaccgcccatttttcccatcgacatagtgataagcggccgcgttgcgtagcactctttcattaacagggtggcagacagcagcgtcagcacatcctgtggtgtctgaggcattacggcgatcttcggcaggtctgcacctaaatcctgcatgcggcgcagccggtaaatgatctcttccttcgccggtgtttggtggaaatcatgattactcataatgaccttaacaccgacgttatgggcctcgcttaccagcgaacggatgcgtgactcatcattaaacaactcaatatcaatcacatcagccagtccgcttaaggcggctgcacggttgagcgcgaagtattcgtcatcactgatttccgcctcgccgccttcttttttactgcggaaggtgaagatcagcggtgtttctcccagttgctgacgaatgtcggccagcgccagtaagacttcactcacgtctttcccatcgatgaagtggtcgacgcgccattcaataatgtctgcctttgctgtggccagtaactgcgctccggcctgaaggtcagcgcgagtacggcctgtcaagggcacacatagcagcgtttgtccctgttggaatatgatgtttttaaccctaaccgtttgagtcatagtcattcctgttttaactgttcaacggcttgctgaggcagtttggctgcgtttttccgcacaatgaaattgaagctggcgggaaccgatataaagcgcaaggataaaacctgccaccgcaataatcagatcaaaccacatgatgctggcgatactgattcgtgaaagatgtgctgtaaataaagggatggtaaaactggccagactgccggcggtgtaaaagacccctgtcgcaaagcctttcgcatggggaaaactcatcgccatgatcgttgcccccagttgcataacgccgcctgcggccgcaaacccaaagacgaatgcaaaaccagtaaccatttgtggcgtcggatagaggcagacgatcagcactgagagggccgacaagaaagtgtaaatgatcatcgcaatggctgagctcaacacttttttcaccatgaccgccgtgacgaatacgcaggtcagcgatcctgccgtgtagatactgagtaatttcaccgatgcggtataggacataccagcgacaaactgcccatactgtgccaaccattggctcaccagataaaaggtcgccatactgatatagccgtataaggtgaacacaaccatatccaactgatacagacgactacgcggtggggttgccaccgtggctgatccttccgcgatgttctgtacccgatgatcgggaaacggcatcttgatcaggtagattccgctcatcatcattaaggctgctgccagcacgaatgaccaaccaaaccacaaatccgcccagataagcagactaatgataaacggcaataaaaattgcccggcggagacaaacgctttaatcagcacgttagcgcggctggccgagtccgggaaagcctccatcagcgtcggataggtggctgaatcaaggaaactgtttgccatacctgccagcacgccaaagatataagccgtataaatatctcgggtaaacagaataccgatgaaaaacgccacgtaactcatgatgcccaaaaagacaaaaggcttgcggccaaaacgatccgacagaaaaccggtaatgatggtaatcagtttgccaatgcccagtgaggaaatcacaatcgatacgcccgccgcatcggtgttccattgcacctgcaggttagccatattgagagtgatgaccagcacgcccatgccatgaatgagataattgagatacagcccagcggcggtgggaatatatttgtttttcatctctgtcatcctcaaaaaaggatttttttgaggtgatcaacaggcatcggttttcctgtccagatttcaaacgcgcttgcgccttgccacagcatcatgccgagaccattaataatacggcagccttttttctctgcgatctcaagcagatgtgttttacgtgggatatatacaacatccgagacaatgagctcaggacgcaggaagctgtcgtcggggagcaacatctgtccttcaaacggtttcatgcccacgccggtcgcattggtgagaataacgctgtcgttaatctcagcgcgtaaacggtcatggtcgtcgagatcaaaaagctgaatctcacagtcagtatgggcacgaattttcgccacggtttcctgcgcattggcaaagaacttatcgcgttggttaaataccgagatcgcctttaccccatccagcgcggcctgaacgcaaatggccgttgccgcaccgccagcgcccagaacagtcatctttttgcccaggatatctatgcgctcttcagcgagggcgcgcatgtaacctgtaccatcagtgatgtgcccggttagcacgccattatcattcacgatggtgttcaccgcgccaacaagctgcgcagcgggagacagcttatccagataacgacaaacctccgttttattgggcatggaaacattgcatccgcgcagcttcagtgcacgaaaaccttgcaccacctccttcagttcctcagtgccgacctcaaaagccaggtaagcatagtccagcccaagatgcgcgaaggcttcgttgtgcatggttggcgacatactgtggcgaataggggtggctattagcccaatcagctcggtatgcccggtaatacgttctgccatgatagtgtcctcagtaagttaaaagtggaatgcttgtcgcttcgcggttacccagtgcgccaatctcttcaagggcatccagtacgttgcgtccttcgcgtacaccatcaataattcgccgcgctttcaggctgtcgccgatgttcattattttgatctggttggcggtggcccagtgctctatggcctcgaaaccggtgcggttaggacgcatccccagacagataaagccgtagtcaaaggtgatgtcgaaggtgcggtgggcgtttttaacgcggaagcgatcgggttggacttcaacgagttgcgtgtccatatgttgttctacctgatgttgttcaagcagagctaacatggctctctttgtgatgatgtcgaggtcgcgtcctggtgaatgctgcatttcaatcagtacagcttcagcgcctcggctggcaaaatactcaacaacatcgagtccaacggcaccgccgccgaccacggcaatacgcttgccttgcagatcgctaaagctattcaggtgttgaatcatgccagtaatcgtgaacaccccgctgccggggcggtcgatcgtctcatgtaaccctgcaattggcggcagcagggggacagagcccgtggcattcacaattaagtcgggacgcagcacttcgagggagtcgggctgaatgtgttgccccagctgcaattgcaaattctccagccgggcaatacggttgttcaggaattgcggaaaatcggcaatacgttttttttcgggcaaccgtgcaatctcgacagccaggcctccgatatggtctttggcttcgagcagccatgtcttgcatcccacctcggcggccgtgcaggcggcttcgatacctgcggtcccagccccgatgacgacgacacgcgttggacgatttacccgccgctttttataagcatcaccatggataatatcggggttaattgagcagcgaaggggaagcgagcgggcaatgcgatggtcggcgcacccgatgttgcaggagatgcacttacgcatcatctcttcatgcccactctgtaccttttgcacccagtctggttcggcaatcagcccgcgaccaatggcaatgaggtcggcgtcaccctgggcaagaatgtcttcagcaagctgaggcgtgcgaatattgccagcgacaacggtgggtttattaaatttgtcgcgaacggcacgtgacagatagcgtttccagccatcctcttgagacatttggtctatttgtaaaaacaggttgtcattctgcgccgccgacacattgatgatgtcgactttttcctgacagtattcaaggatgcgcagcgaatccgcgagcgtgttaccgccctgtaaaaaatcatccgcgctgatacgcagactgatgggaaacgtcggtccaacgcaggcccgaactttgtcgacaatcagggttaaaaagcgtgaccggttctcgatacttccgccaaattcgtcattgcgctgattgaacagtggcgataaaaactgactaattaaataagagtgcccggcatgaatctctacgcagtcaaaattggcgcgtctgacgcgttctgcagcgtcaccaaatttgtcaaccgcccgatatatttcctcatgcgtcatcggacgtggaatagtccccttcttttttgacggtaccgcggaggctgaaatgggcatctccccattgaggcgataggtataagctgatgcacctgcatgatttaactggatggcgacacaggctccgtgtttatgcaacgtctcggtgagtttgtataaaccgggaatatactggtcattatcgatgcgtagttgtgtggtgccgttcgacgcaaatgggaaatccacacaaatattctcaatcgtaatgagcccggtgccaccctttgctctaagtgaatagtaatcaagctgttcctgagagacttcgccattcagactggccagattggtgcccattggcggcatgatgatacggttttttaatgtcatcccgttgattgttaacggggtaaacaggtgagggtaagcgtgcatacattgtctccacaaaagatctgacaggcaggctgagacgatcccgatgtgctttgcgttgaattttctctgcggcgatgatagcgagggggaatttacggaaataatggtttttttttcagaagctataggcaggttctatgggattaactatcaaataacaaaagaagggcattgatgttaattaaaatagcaaacgatttacttcttgtgataacagagaggaaaaagtgaggagaagatgatgcgagtcaaaatataaacgtcatcggtgaataaataacgcgatttctgcaagaaaataaattgcgattaattgttttagcgcagttttcgttaaaaaaaaagcccggactgcagagcagagcgggctgattaagaggtgtaccagttaacgcataaaggccggctggttgttttcgtaagccgagatcgcgctttcgtgctgcagcgtcaggccgatactgtccagcccgttcagcatgcaatggcgacggaagtcatcaatcttaaagctgtaagactggtcgccagctttcacgacctgggattccaggtccacttcaaacctgatccccggattggctttcaccagcgtgaataacgcttccacctgctcgtcgctcaacgtcactggcagcagctggttgttgaagctgttaccataaaaaatatcggcaaagctgggggcaatcacgactttgaaaccgtaatcggtcagcgcccagggggcatgttcacgagatgaaccgcaaccaaagttctcgcgcgtaagcagaatcgaggcacctttatactcaggaaagttgagtacgaagtccggattgggctctaaaccgtgatcgtccagaaaacgccagtcattgaacagatgggcaccgaagcccacgcgggtcactttctgcagaaactgcttcggaatgatggcatcggtgtcgacgttagcggcatccaaaggaaccaccagaccagtatgttgagtgaatttttctgccatgatggtttccttatgtcaggctgcgaatgtcggcaaaatggccattaatggcggcagcggcggccattgccgggctgactaaatgcgtgcgtccgccacggccctggcgaccttcgaagttacggttactggtggatgcacagcgctcgccggggttcaggcggtcattgttcattgccagacacatggagcagccaggcaggcgccactcaaaaccggcctcaataaaaattttatccaatccttctgcttcagcctgagccttaaccgggccagagccgggtaccacaagtgcctgtacacctggcgcgactttacgccctttggcaatcgcggcggcggcgcgcagatcttcaatgcgcgagttagtgcaggagccaataaagactttatcaatgctgacgtcggtcagtttgatgccgggttgcaggttcatgtaagccagtgctttttcagcggaggctcgctctaccggatcggcaaatgatgcgggatcagggatgttggcatcaaccgcgatcacctggccggggttggttccccatgtcacctgcggtgcaatctcttccgcatgcagcgtaacgacgcgatcaaatttagcctcgggatcgctcttcagcgtgcgccagtatgcaacggcctgctcccacttttcgccttcaggggagaactggcggcctttcagataactgaatgttgtgtcatccggcgcaaccagaccggctttcgcacccatttcaatcgccatattacacagtgtcatgcggccttccatgctcagcgcttcaatcgcggaaccacagaattcaaccacgtgaccggtaccgccggcgctgccggttttaccaataatcgccagcacaatatcttttgccgtaatgcccggcgcgacggtgcctgtcacttcaatcttcatggttttggcacggccctgcttcagggtttgcgtggcaaaaacatgttccacctctgacgtaccgataccgaatgccagtgaaccaaaggcaccgtgggtcgccgtgtgcgagtcgccgcagacaatcgtcatgccgggtaaagtcatgccttgctctgggccaataacatgcacgatgccctggaacgggtgatccaggtcatacagctgcacgccaaattcggcacagttcttcatcagttcctgcatctggatgcgcgccatctcacccgaagcattgatgtccttggtctgggtggacacgttgtgatccatggtggcaaacgtcttcgacggctgacgaactttacgaccgtgtgctcgcaagccatcaaaagcctgtggtgaggtcacctcatgaatcagatggcggtcaatatagagcaagggtgtttcattcggtgcttcgtgaacgacatgtgcatcaaataacttctggtataaggttttcattttattatttttcctcggcgataaagcgggcaatgatgctgcccatctcatctgtgctgatcgcatggccgtcacccgctaaatctttagtgcgatagccttccgctaaggcccggctaatggcgcgctcgatgcaggcagcggcgtcatcggcattcaggctgtagcgcagcagcagcgacagagacaggatctgggcaatgggattcgcaatgttctgacctgcgatatcaggcgctgagccgccagccggttcatacaggccaaaaccgtcttcgctcaggctggctgaaggcaacatgcccatcgagccggtgatcatcgcgcactcgtctgacaaaatgtcgccaaacaggttggaacacagcagcacgtcgaactgagagggatctttaatcaactgcatggtggcgttatcaatgtacatgtggctcagctgtacatctgggtaatctttcgcgatttcgttcacgatttcgcgccacatcacggacgtttgcagcacgttagctttatcgaccgaggtgactttgttgcgacgcttacgagccgattcaaaagcctggcgcgcaatgcgttcgatttcaaagcgatgataaacttcagtatcaaaagcccgctcgtgtgggccgctgccttcgcgtcctttcggctgaccaaaataaattccaccggtcagctcacgtacgcagagaatatcgaaaccgcgggcagcgatatcgctgcgcagtgggcaaaaggcttccagaccactgtacagcgccgcaggacgcaggttgctgaacagcttaaagtgtttgcgtaacggcagcagcgcgccgcgctcaggctgagaggctggcggtaagtgctcccacttagggccgcctaccgatccaaacagaatcgcgttagcctgctcacaacctgcaacggtagccggtggcaaaggttcgccatgacgatcgatggcgataccgccgacatcgtattcactggtggtaatacgcaaattaaaacgctgacgaaccgcatccaatactttgatagcctgggccatcacttccgggccaattccgtcgcccgccagtactgcgatatgtgaagagtttgacatgattacaccgtttccttctgatctttagacttgcgctgtaactctttctcgacctgtttggctcgccagatgttgtttagtgcgttcaccatcgcttttgcagaagattcgacaatatctgtcgccagaccgacgccgtggaacttacgattgttgtagctcaccacgatatcaacctgacccagcgcattctcgccatgaccttttgccgtcagcttgtaattaaccagttctgcattgaactgggtaatacggttaatcgcctgataaaccgcatcaaccggaccgttaccggtcgccgcttctgatttcgtttgttcgccgcagcccagattcaccgacgcggtggccgtaatgctggagcctgactgcacattgaaatcattcagttggaaaaattcaggctcttcgttttgtttattaatgaaagccagcgcttccagatcgtaatcaaatacctgacctttcttgtccgccagtttcaggaaagcgtcatacagggaatccaggttgtattcgctttctgtgtagcccatctcttccatacgatgttttaccgctgcgcggccggagcgggatgtcagattaagctgaattttgtgcaggccgatggattcaggtgtcaggatttcatagttttcacgatttttgatgacaccgtcctgatgaataccggaagagtgggcaaaggcgttagaaccgaccaccgctttgttggccggaattggcatattgcagatctggctaatcatctggctggtacggtaaatttcctgatgatgaatattggtatgaacattcatgatctgctggcgggttttgatcgccatgatcacttcttccagcgcacagttaccggcgcgttcacctaatccgttcaacgtgccttcgacctgacgggctccagcctgaaccgcagcaatcgcattgcccgttgccatgcccaaatcatcatgcgtatggacagacaggatcgctttatcaatgtttggtacgcgttgaatcaactggctaatgatgttggcgtattcgttcggcaaggtgtagccgacggtgtccgggatgttaatggtggtcgcaccggcgttaatcgcggcttcaaccatacggcacaggtcgtcaattggggtacggccaccgtcttcgcaggaaaactcgacatcatccgtatagttacgggcgcgcttcaccatacggacggcgcgttcgatcacctcaggcagggtgctgcgcagcttcgtggcaatatgcattggtgacgtcgcgataaaggtatggatacggaacgcttcggcgacgcgcaacgactcgtaagcggcatcaatatcctgttcaacacagcgagccagaccgcaaacccggctgtttttgatggtgcgcgcaatggtttgcacggattcaaaatcacctggtgaagacacagggaaaccgacttccatcacatcaacgcccatacgttccagcgctaatgcaatttgcagtttttctttcacactcaggctggcctgtaatgcctgttcaccatcgcgcagagtggtatcgaaaataataacttgctggctcatcgtgttcatccttttgcgtttcttgccttgcaacgagcataaaaaaacccgcgacaggcgcgggtttttaacttttagcaggttcgaatcagtgtttgatttcgcccacaagtctaccgcgcacataagttgcgtttagtagtagacctgatagacgaaaagaacgtgacatgtttcaaacctcgtgaattttttgctgcatctattggtactggaatcacccatcgatgtcaaccataagcaaagggttattttttgcagcggcaaagaaaaatgttctgccattttcggccctcgcagagtattaaacgagagagacacttcgcgtcacgcttattgccgctgacgttagcctgctggtcgatggttgtgtgctaattcaatgaattataatgataaattaaagacgttatatcattttatccacgagggtgtgatgaaaggcagcataatccatcgcgcctgaagactttataagagcgttacgccgtaaaaaggcccggctgaaagacggctggctgaaccggtctgtcatctgttttttttatttcttagatacgactgcaaaaaataccattaccagcattttcctctgctattaactggcgtatttagtttaataatcgtaagccaaagttggcgagcagaggctttgtatcctgcctcctttaataaaaggcgtttggcgtttgccagcccgtttttctgcggttatggtaatcgacctactcttagaaaaaataacccagcagaattctctgtatctggacagcagaaatgagttctgctgtcttagcaaaaacataaggttttgatcttaattggcgaaaacagggctggatgcatgtggctagcgggaaagcagtcgtcagtagattcagttcctcaagccgggaggcagaaaatggagatgttgtcaggagccgaaatggtcgtccggtcgttaatcgatcagggcgttaagcaggtattcggctatccgggtggcgcagtgctggatatttatgatgcgctgcaaaccgtaggtgggatagatcacgttctggttcgtcacgagcagggcgcggtgcatatggcagatggtctggcgcgcgcaaccggtgaagtgggcgtggtgctggtaacgtcggggccgggcgcaaccaatgcgattaccggcatagcgacggcctatatggattctattccgttggtcattctgtcaggtcaggttccttcgtctctgattggctatgatgccttccaggaatgtgacatggtcggtatttctcgtccggtggtgaaacacagtttcctggtgaaaaataccgaagagatcccgatggtgctgaaaaaagccttctggctggcctctacgggtcgtcctgggccggtggtcatcgatctgccaaaagatatccttaatcctgcgaataagctgccttaccattatccgcaggacgtgagtatgcgctcttataaccccacgattcaggggcacaaaggccagattaaacgcgccttgcaaaccttgctggcggcgcataagcccgttatctatgccggcggcggtgccatcacgtcctcttgcgaagcggaactgctgcagttggccgaacgtctgaatattccggtcaccacctcactgatggggctgggcgcgtttcccggcagtcatcgccagtgtgtcggcatgctgggcatgcatggaacctacgaagcgaacatgaccatgcataacgccgatttgatcttcggggttggcgtacgttttgatgaccgcaccaccaacaatctggctaaatattgtcccaatgccaccgtgatgcatattgatatcgacccgacctccatttcaaaaacggtagcggcagatatcccaattgtcggagatgccaaacagaccttacagcaaatgctggaactgttggatcagagtgaggcaaagcagccattcgacagcctgcgtgactggtggcagtcgattgaaacctggcgcagtcgccagtgcctggcgttcgatcgcaccagtgacaaaatcaaaccccaggcggttatcgaaaccatttgtcgcctgacgaacggggatgcctacgtcacttcggacgtgggacagcatcagatgttcgccgccctttattacaccttcgataaaccgcgtcgctggattaactccggtggcctcggcaccatgggctttggcctgcctgccgcgctgggcgttaaaatggccctgcctgacgagacggttatctgtgtaaccggtgatggcagtattcagatgaatattcaggagctctcgaccgcgctgcagtacgatttgccggtgttggtgctgaatctgaacaaccgtttcctgggcatggtgaaacagtggcaggacatgatttattccggtcgccattctcagtcttatatggaatcgctgcctgattttgttcgcctggctgaagcctatggtcacgtgggtattgccattgatcatcctgcagagctggaagaaaagctggcgctggcgctggaaaccctggccacagggcggctggtctttgtagacgtcaacgttgacggcagtgagcatgtttacccgatgcagattcgcggtggcagcatggacgagatgtggttgagcaaaacggagaggacttaattatgcgtcgcattttatcagttttgctggaaaacgaatccggcgcattgtctcgcgtagtggggctgttttcacaacgcggctataacattgagagcctgaccgtcgcaccgacggatgatcccacgctgtcacgcatgaccattcagaccgtcggcgaccagaaagtgctggagcagatcgagaagcagctccacaaactggtcgacgtactgcgcgtgaccgagttagggcagggcgcgtatgtcgaacgtgaaattatgctggtgaaaattcaggcgacgggttatggccgcgaagaggtgaagcgtagcgctgaaatcttccgtgggcagattattgacgtcacgccatcgctttacacggttcagctggcaggtaccagcgacaagctggatgcctttttaagcaccgttcgtgaagtcgctgaaattgtcgaagtggctcgctcaggaatcgtgggcgtgtctcgtggtgagcgcattatgcgttaatcacgctccgttaccatcagcaatgtttgtaacccggcgaaatgccgggttttttctttttaatgcgcaagattgacgaccatcagaaaagcggttgctacgcgcacttttctgctgttagatgtgctaaaaaggatgtccatagcttatctgcgggttaacaatcagcttaagcctgtttaatggtggggttacagtgaaactggatgaaattgcgcgtctggcgggtgtatcgcgcaccacggccagttacgttataaatgggaaagcacggcagtatcgtgtcagcgacaaaaccgttgagaaagtcatggcggtggtgcgcgagcataattaccatcccaatgcggtagcggcagggctgcgcgccggacgcacgcgatcgattggattggtcatccccgatttagaaaataccagttacacgcgcattgctaactaccttgaacgtcaggctcgccagcgtggctatcagttgctgatcgcctgttctgaagatcagcctgataacgagatgcgctgtatcgagcatctgctgcaacgccaggtcgatgcgattatcgtatcgacgtcgcttccacccgagcatcctttttatcaacgctggatcaataacccattaccgatcatcgcgctggaccgtgcgctggatcgtgagcacttcaccagcgttgtcggcgccgaccaggatgatgcctttacgctggcggctgaattgcgtcagctcaaaattaataacgtgctgtttatgggcgcgttacctgaactctccgtcagtttcctgcgtgaattgggcttcagagaggcctggaaagatgatgagcgcccgattgattacatttactgtaatagttttgaacgcacggcctctgctgcgttgtttgaaacttatctggagaatcaccccatgccagatgcgcttttcacgacctcttttggtctgctgcagggcgtcatggatgtcacgctgaaacgtaacgggcgcttgccagccgatctcgccattgccacctttggcgatcacgagctgttggactttcttgaatgtccggtattgtctgttggccagcgtcatcgtgacgtcgccgaacgggtgctggaattagttttagcctctttggatgaacccagaaaacccaaacccggtttaacccgaattcgtcgtaatttattgcgtcgtggacaattaagcagaatttctaattaaattaagggcagcaataagtctgccctgtctattacatgctgtttttaaactctttcttcttaaagtaaaaaagcgtaagcgttattcattcatgctcacaaattaagttaacggactattcttgtttacttacaacttagcgcctgttttaaacgctgtttgtcgctatgtggctgtgcatcccttaagaaatcccctaaaatgcgtcccctgtctcaaaacggctcaacgctattcaacctgaataaacgtgtaattttaagccactcttttttgcgtcagatttttttattcagttattcattagtttaattttgattaatcatcttttggcgttttgaaaccctctcagtgttaattcccgccttggtaaatagtcatattcaactgccgctccggcttgacaatgatttcctacgatccttaaactcgttttgtggtaaaaagtgggataaagtggtgcaaatgggtaattgaggggtgaggctggcatgttccgtggagcaacgttagtcaatctcgacagcaaaggacgcctggcggtaccaacgcgctatcgcaatttgctgagcgaggaatcacaggggcagatggtttgtaccatcgacctccaccagccatgcctgttgctctacaccttgcccgcatgggaaatcattgagaagaagctggcgagtctttccagcatgaatcctctggagcgccgggtacagcgcttgctgctgggacatgccagtgaatgtcagatggacaatgcaggccgcttgttgttggcgaatacgcttcgtcagcatgcaaatttaagcaaagaagtgatgctggttgggcagttcaacaagtttgaactgtgggatgaacagacctggtatcaacaagtcagggaagatattgacgcagaacagtcagctcaggagcctttatctgagcggttgcaggatttatcgctatagctatgcaggaaaattacaaacacaccaccgtgctgttggatgaggcggttaatggcctcaacatcaaggaagacggcatctacatcgacggcacctttggtcgtggcggccactcgcgcttaattctggcgcagcttggcgctggcggaaagctcatcgccattgaccgtgacccgcaagctatcgccgcagcggctgagataaaggacccacgtttttcgattgttcatggtcctttttccgcactggcagagtacatggccgagcgggaactggttggccgtatcgacggcatattgctggatctgggggtttcgtccccccaactggatgatgccgaacgaggcttttcattcatgcgtgacggaccactggatatgcgcatggaccccacgcggggtcactctgccgccgaatggttattgcaggcagaagaagcggatattgcgtttgtgctgaaaacttacggtgaagagcgttttgcgaaacgcattgcccgcgccatcgtcgaacgtaatcgtgaagaaccgatgacgcgcacgaaagagctggctgcggtaattgccgcagccacaccgataaaagataagtttaaacatccggccacgcgcagcttccaggcgatcaggatctggattaacagcgaactggaagagattgatatcgcgttgaaaggtgcggttgaggtacttgccccacaagggcgtttatccgttatcagcttccattcgctggaagaccgactggtaaaacgttttatgcgcgatcagagtcggggtccgcaggtgccacatggactccctatgaccgaacagcagctcaatgcgctgggtggccgtcagttaaagctactgggaaaaatggtaccgggtgacgttgaggtgaaagagaaccctcgtgcacgcagttccgttttacgcatcgcggagagaactgacgcatgatcggcaacgaacggcacagcttacccggcgttatcgccggggacattttgcgcaaaggcaaaattcccctgctgttgctgatagccgtactggtttctgccgtattggtggtgaccactacgcacaaaacgcgcctgttaaccgcccagcgagagcaactggtgctggagcgtgatgcgctggacattgaatggcgcaatttaattctggaagagaacgcccttggcgatcacagccgcgttgagcggatcgccaccgaaaagctgcagatgcagcacgttgatccttcgcaggaaaacatcgtggtgcaaaaataaggatctgttactgctaatgaacggcgtaaaaagaacgctgaagttaaaaaaaccggaagataaagccagctttgtaagctggcgttttgcgttgttatgcggttgcattttgctggcgttaggtgggctgttgtcccgggttgcatggctgcaggtgatcaacccagacaagctggttaaagaaggcgatttacgctcattacgcgttcaggcggtgccgaccgcgcgcggcatgatcagcgatcgtggtggacgcccgctggcggtcagcgtgccggtaaatgcgatctgggccgatcctaaagagctgcatgatgctggcggggtcacgcttgacagccgctggaaagccttatccgatgccctttctatccccattgatcaactggccgcacgcgtgaatgcgaatcccaaagggcgctttatttacctggcgcgtcaggtcaatcccgccatcggtgaatacgttaaaaaactcaagctgccaggcattcatttgcgtgaagagtcccgacgctactatccggctggtcaggtgacgtcacatctcatcggctttaccaatatcgacggccagggcattgaaggcatcgaaaagagcttcgataaatggctgaccggtgaaccgggcgagcgaaccgtgcgtaaagatcgctacggacgtgtgattgaagatatctcttcggttgacagccgtgccgcgcataacctgacgctgagcatcgacgaacgcctgcaggcgctggtctaccgcgaactcaacaacgcagtggcgtttaacaaagcggaatcgggcacggcggtgctggtggacgtgaacaccggcgaagtactggcaatggccaacagcccggcctataacccgaataacctgagcaacacggcaaaagacctgatgcgtaaccgcgccatcaccgacattttcgagcctggctcaacggtgaagccgatggtggtgatgacggccctgcaacgcggtgtggtgaaagagaacagcgtactgaataccgttccctatcgcgtcaacggccatgaaatcaaagatgtggcgcgctacagcgaactgactttgacaggtgttttacagaaatcgagtaacgtcggtgtttcacgactggcgttagcgatgccctcctcagcgcttgtagatacttacgcgcgctttggactgggtaaaccgaccaatttggggctggtcggggaaagtagtggcttataccctaaaaaacaacggtggtctgacatagagagggccaccttctctttcggctacgggctaatggtaacgccgttacagttagcgcgagtctacgcaacgattggcagcttcggcattgctcgtccgctgtcgataaccaaagttgatccgccggttggtggtgagcgcgtgtttcctgaagccctggtgaaaaccgtggtgcacatgatggaaagcgtggcgttaccgggcggaggcggcgtgaaagccgccatcaaaggctatcgcgtggcgatcaaaaccggtaccgcgaaaaaggtcgggccggatggtcgttacgtgaataaatacattgcctataccgcaggcgttgcgcctgccagtcgccctcgttttgcgctggtggtggtcattaacgatccccaggccggtaaatattatggtggtgcggtttctgcaccggtgttcggtgccatcatgggcggcgttctgcgtaccatgaatatcgaaccggatgccctgccgaccaatgacaaaaacgagttggtgacaaacagaagtgaggaatcaagtgacagatcgtaacctgcgcgacttactcggaccgtgggtgcctgacgcacctgcgcgcccgttgcgtgacatgactctggacagccgcagtgcggcggcgggcgatctgtttgtggccattgccggccatcaggttgatggtcgacggtttattcctcaggcgattgcgcagggcgtggctgccgttatcgcggaagcagaaggggaagcgaccgacggcgaaattcgtgagatgcacggcgtgccggtcatttatctggcgcagctgcatcaacgtctttctgctctggcaggccgtttttaccagcagccgggcgaaaagcaaaagctgattggcgtaaccggtaccaatggtaaaacgaccaccacgcagttactggcgcagtgggccagcctgctgggcgaaaccagtgcggtgatgggcacggtaggcaatgggctggtcgggcaactggtgccagcggaaaataccacgggttcagccgtagatgtgcagcacaacctggatgaactggtccggaaaggcgcatcgctgacggcaatggaaatttcgtcacacgggctggtgcagcatcgtgtttcagcactgccttttgccgctgcggtgtttaccaacctcagccgtgaccatctcgattaccacggtgatatgcagcagtatgcgtcggcaaaatggttgttattttccgagcatcaggtcggtgtggccgtgcttaatgctgacgatgacgtcggtcgccgctggctggcaaatctgcctgacgccgtggcagtcacgatggaaaataacctgcagcccggtaatcatggtcgctggcttcgtgcgaccgacgtgaactatcacgataatggtgccgacattcgcttcgactcaagctggggcgagggcgagataaacagccgcctgatgggggccttcaacgtcagtaacttactgttggctctggcaacgctgctggcgctgggttatgcgctggatgatctactgcgggttgcggcaagactgcagccggtgaacgggcgaatggaagtcttcagcgccccgggtaagcctaccgtcgtggtggattatgcccacacgccggatgccttagagaaagcactggaagccgcgcgcctgcattgcaaaggcaaactgtggtgcctgttcggatgtggcggcgatcgcgacaaaggtaagcgcccactaatgggagcaattgctgagcagtttgccgacgtggtggtggtgacggatgataatccgcgcagtgaagatcctcaggcgattgtgcaggacattctgagtgggctgctcgatcctggccgtgcccgtgtggtttccggacgcgcgcaggccgtgaccagcaccatcatgcaggctcatcccgatgacatcgtattggtggccgggaaaggccatgaagactatcaaattgttggcaatcaacgtctggattactccgatcgtgcgacggtcgccacattgctaggaggcgtagcatgattccggtttcattgagcacgttagcacagatcaccagcggcaccctgcacggcgacgacctgacattaaatgatgtcacaacggatacccgcaaggtcaccgcaggtagcctgtttgtggccatcgtgggtgagcgttttgatgcccatgactttgtagaagatgctatcgccaagggggccaaagccttgctggtaagtaagcgtttacctgtatctgtgcctcaggttgtggttgaggatacgcgcctggcgtttggcaagctgggagcatgggtgcgtcaacaggccagcgctcgggtagtcgccctgaccggctcttccggtaagacctcggtgaaagagatgacggctgcgattttacgtcaatgtggtgaaacacttcataccgccggtaacctgaacaacgattttggcgtgccgatgaccttattgcgcctcacgcctgaacatcagttcgcggtcattgagctgggtgcaaatcatcagggcgaaatcgcctacaccaccgatctggtccgtccggaaagcgcgctggtcaataaccttgccgcggctcatcttgaagggtttggttcgctggctggtgtggcaaaagccaaaggtgaaatttttaacggtttgcccgcgaagggaacggcgatattaaacgctgacagcaatgactggccgcactggcaggagaacctgcacggtaaaacggtatggcgtttctccccccaggatgctgactgcgattttcacgcgcgcgatattcgtatcagtcaggatggcacgcactttgttatgcacacgccgcatggcgaagcagacattaccttaccggtgccgggacggcataatattgcgaatgcgctcgccgctgccgcgctcgcgctgtcggtggatgccccgctcagcgcagtgcagagtggcctgaaaaaccttcagtccgtacccggacgcctgttccccatccgcctctccgcgcagcaactgctgctcgatgacagctataacgcaaacgtcggctcgatgatcgcagcagcccaggtgctgtctgagatgccgggttaccgcgtcatggtggtgggcgatatggctgaattaggcgacgaaagcgaacagtgccatcgtgaagtgggcctggccgccaaagccgcaggcattgatagtgtgttaagcaccggtcagataagccatttaattagcgaaagcagtggcgttggcgaacatttcagcgataaaaccgcgctgactgaacgtttacaccagttactgtccgaacacaaagaaatgaccgtattgattaagggttcacgtagtgccgccatggagcaggtagtacagagcttacaggagaaaggaacatgttagtttggctggccgaacatctggtcgcattttattccggcttcaacgtcttttcgtatctgacgtttcgcgccattgtcagcctgctgaccgcgttatttatctccctgtggatggggccacgcctgattgcgtggctgcagaaactgcaaatcggtcaggtggtgcgtaacgacggcccggagtcgcactttagcaagcgtgggacgccgaccatgggcggcatcatgattctgacttcgatcaccctgtcggtattgatgtgggcttacccatccaacccctatgtctggtgtgtgctggtggtgctggtgggctttggcgtgattggctttgtcgatgattaccgcaaagtagtacgcaaagatacgaaagggttgatcgcgcgctggaaatacttctggatgtcggtgatttccctgggcgttgcctttgcgctttacctggccggtaaagatacgccagccacagagctggttgtgcctttcttcaaagacgtgatgccacagctgggtctgttttacatcgtgctggcttacttcgtcattgtgggtaccggtaatgccgtcaacctgaccgacggtctggatggcctggccattatgccaactgtctttgtggcggcaggttttgcactggtcgcctgggcaacaggtaacgtgaaattcgccgagtatctgcatattccttatttacggcatgccggtgaactggtgatcgtctgtaccgccatcgtgggggcaggattagggttcctctggttcaatacctatccggcccaggttttcatgggcgatgtcggatcgctggcgctgggcggcgcattagggaccatcgccgtgctgctgcgtcaggaatttttattagtgatcatgggcggcgtgtttgttgttgaaacgctgtcggtgattctgcaggtggggtcattcaagctacgcgggcaacgtattttccgaatggcgccgattcaccatcactacgaactgaaaggctggccagagccgcgcgtcattgtgcgcttctggattatttcgctcatgctggtgctgattggcctggcgacgctgaaggtacggtaatcatggctgactatcgcgggagaaaagtcgtcatcatcggattaggcctgaccgggctgtcctgtgttgatttctttgtagcgcagggcgtaacgccacgcgtgatggatacccgtatgtcaccgccagggctggataagttgcctgagcaggtagagcgttacgtgggcggtatcaacagtgactggctgttagcggcagaccttatcattgccagccccggtattgcgctggcgcatccggcgttgtgtgaagctgcggacgcgggcatcgaaatcgtcggtgacattgagctgttttgtcgtgaagcacaggcaccgattgtggcgattaccggctcgaacggaaaaagtacggtcaccaccctggtcggcgaaatggctaaggcggcaggctggcaggtaggtgtgggtggcaatattggtttgcccgcgctcagcctgctgaaagcgtctgcgcagctgtatgtgctggagctctccagctttcagttggaaaccacgcacagcctgaaagctgccgccgccaccattcttaacgtgacggaagatcatatggatcgctatccgttaggtatgcagcagtatcgggcagccaaactgcgtatttacgagaacgccctggtttgtgtggtgaacgctgatgatggcatgacgatgccggtgcgcggcgctgactcgcgctgtgtgagttttggcatcgatatcggggattatcatctcaataagcagcagggcagtatatggctccgggccaaaggcgagaaggtgctaaacaccgatgaaatgacgctggtggggcaacataattacaccaatgcgctggcggcattagcgttggcagatgcggtggggttaccacgatccaccagcctgtctgcgcttgcagcctattccggcctgccacaccgttttcaactggttcatgagagtcgcggcgtacgctggattaatgattcaaaagcgaccaacgtcggcagtacagaagccgcattaaaaggcttgcaggttaacggcacgctctggctgctgcttggtggggatggcaaatcagcagacttctcgccgttggcgtcttatgttcagggcgatcgtatccggttgttctgctttggtcgcgatggtgatgcgctggccgcgctgcggcccgacgtcgcggtacgcactgaaacgctgcagcaggctatggaacagattgccaggcaggtccagccgggcgatatggtactgctttcgccagcctgtgccagcctcgatcagtttcgcagttttgagcagcgcggtgacgtcttcgcgcaactggccagggagctaagctgatgcgtattcctggttcgggcattgcgagttacctgtccagtcggttgagtaactgggtaatggggtcgcgcgaaagcgatgatacctcgctggtgctctatgaccgtacgttgctctggttaacgctgggcttagccgccatcggctttgtgatggtgacctcggcatcgatgccggtaggtcagcgtctgaatgacgatccgttctattttgccaagcgtgatgcgttttatatcgccctggcattcggtatggcgctggttaccctgcgcgtcccgatggatttctggcagcgttacagcaacgtgatgctgatggtgtctgtcgccatgctgttgattgttttagtcgtgggtagctcggtcaatggtgcttcacgctggattgcgttaggcccgctacgtatccagccagccgaattatctaaactcacgctcttctgctatctcgccagttacctggtgcgtaaagtcgaagaggtgcgaaataacttctggggcttctgtaagccgatgggcgtgatggtcgtgctggctgtactgctgctggctcaaccggacctcggcacggtggtggtgctgtttgttaccacgctggcgatgctgtttctggcgggggccaagctgtggcagtttctggccatcatcggctccggcatttttgccgtggtgctgttgattatcgccgagccataccgtatgcgccgcgtcacgtcattctgggacccatgggaagatcctttcggcagcggctaccagcttacacaatcgctgatggcgtttggccgcggtgaattctggggccaggggctggggaattcggttcagaaactggaatatctgcccgaagcgcataccgactttattttctccattatcggagaagaactgggttacatcggtgtggttttagcgctgttaatggtattcttcgtcgcttttcgcgcaatgtcgatcggtcgacgcgcgcttgaacttgaccaacgtttttcgggcttcttagcctgttcaatcggcgtatggtttagctttcaggcactggtcaacgtgggcgccgcggcgggtatgttaccgaccaaagggctgacgttaccgttaattagttacggtggttcgagtctcatcattatgtctacggccatcgtatttttgttacgtattgattatgaaacgcgtctggctaaagcgcaggcgtttacccgaggtggtcgatgagtggtaaacgattgatggtcatggcaggtggcactggcggacatgtgttcccggggctggccgtggcccatcatctgaaagcgcagggctgggaagttcgctggttaggcaccgcagatcgtatggaagccgacctggtacccaagcacggtatcgacatcgacttcatccgtatcagcggattacgcggcaagggcatcaaagccctgttgctagcgccggtgcgtatttttaacgcctggcgtcaggctcgcaagattattaaagcctggaagccggacgtcgtgctgggcatggggggctatgtatcgggcccgggtggcctggctgcctggagttgtggtgtccctgtcgtgctgcatgagcaaaacggtattgccggactcaccaacaagtggctggcaaaaattgccaccaaagttatgcaggcatttcccggtgcgtttccccacgcagaagtggtaggaaacccggtgcgtacggacgtgctggccctgccatcaccgactcagcgcctggccgggcgcagtggtgccatccgtattctggtggtgggcggcagtcagggcgcgcgcattcttaaccagacggtgcccctggttgcggcaaaactgggtgagcagatcaccgtctggcatcagaccggtaaaggtgcattgcaggatgtagagcatgcctatcagcaggcaggtcagcagcacaaggtgaccgaatttattgatgatatggcggcggcatatgcctgggctgatgtagtgatttgtcgctcaggtgcactgacggtgagtgaaattgctgccgcgggattaccggccatcttcgtgccttttcagcacaaagatcgtcagcagtactggaatgccttgccgcttgagggcgcaggtgcagccaaaatttttgagcagccgcagtttacagcggaggcggtagcggaaacgttgcgtcactgggatcgcccgacattactcgcgatggctgaaaaagcccatgaggtggcggtacccgatgcgactgaacgggtcgcgcaggcagtggctcacgccgcacattaacgcatcaggtcagcctggctgacccgtgctcaaactgagcacaaactgaatgagtaggtaggtaataaagcgtaatgaatacacaacaactggcgaaactgcgttcaatcgtgcccgagatgcgtcgcgtccggcacattcactttgtcggcatcggcggtgctggcatgggcggtattgccgaagtgttagcaaatgaaggctaccatatcagcggttctgatctggcaccgaatccggtaacacaaaatctgatcaaactgggcgcaacgatttactttaaccatcgcccggaaaacgtaaccgatgccagcgtagtcgtggtgtccagcgccgttgcgcaggacaatcctgaactggtggcggcacgcgagcaacgtatcccggtgattcgtcgcgcggagatgctggcagaactgatgcgctttcgtcacggtattgcgattgccggcacgcacggcaaaaccacgacaacagcaatggtgtcgagcatttacgcagaaggtggcctggacccgactttcgttaacggggggctggttaaagcggcgggcacgcatgcgcgtctgggcagcagccgctatctgatcgccgaagcggatgagagcgatgcgtcattcctccatctgcagccaatggtcgctgtcgtcaccaatattgaagcggatcatatggacacctatcagggagattttgaaaacctgaagcagacgttcattaatttcctgcacaatttaccgttctacggccgcgcagtcatgtgcgtcgatgatgccgtgattcgtgacctgcttcctcgcgtaggccgccagattacgacctatggcttcagtgacgatgctgacttccgcatcgaagactttgaacagcgtggtgcacaggtgcactttagcctgattcgtcaggacaaggcgccgttacagatcaccctgaacgcaccgggtcggcacaatgcattaaacgcagcagcggccgtagccgttgccagcgaagaagggattgaagacagcgccattctggcggcgctggaaaactttcagggaaccggtcgtcgtttcgaccagttgggcgagttttctaccgaaccggtcaacggtcagcctggcaccgccatgctggtggatgattatggtcatcatcccacggaagtggacgctaccatcaaagcggcgcgcgcgggttggcctgataaaaaactggcgatggtgtttcagccgcaccgttacacgcgaacccgtgacctgtttgatgattttgccaacgtgctgtctcaggttgacgttttgctgatgctggatgtgtacgcggcaggtgaaacgcccattcctggcgcggacagccgtgcactgtgccgtgccattcgtaaccgtggcaaggtcgatcctattctggtgccggaacatgattcgctcgttgaaatgctggcacctttgctgtcaggtaacgatctgattctggttcagggtgcagggaacgtaggtaaagtggcgcgtaaactggccgactgcaaattgcagccagagcgcaaagtggagggccgtcatgcctaaagttgccgttttaatgggcggcacgtcagccgagcgcgacgtgtccctgatgtccggcggggccgtgctggccggcttacgcgaagcaggtattgacgcacagggtattgatacccgcgacgtttcagtgctggatttaactgcacaaggttttgaaaaggtgtttatcgccctgcacggtcgtggcggtgaagacggcacgcttcaggcggtgctggagttcctgcagttgccctataccggcagcggcgtgatggcatcggccgtgaccatggacaaactgcgcaccaagctgctgtggcagggcaggggactgccggcaggtaaatttgtctggatcacgcgtgaacagatgcaggccggtctggatacggccaccaagacagcgattagcgcgctaggtttaccgctgttcgttaaaccgagcagcgaagggtccagtgttgggatcagccgcgtgaatcagcagagcgatctgaccgcagcactggaagaagcatttcgccacgacgataacgtgctggttgaggcgtttctgagcggtgaggaatataccgttggcattctgggcgagcagattctgccagccataaaaataaagaccgtcagcgagttctatgactatgaagctaaatacatttctgacgatactcagtacttctgtccagccggactgagtgcagagcgtgaggcagaattacaacagctggtttggtctgcctggcgtgcactgggatgcagtggctggggacgcgttgatgtcatgaccgatggagaaggacatttccagctgttggaagcaaacacgtcacccggtatgaccagccacagcttggtgccgatggcagcaaagcaggctggcctgacgttttctcagttggttgtacgcattctggaactggccgactgatatgtcacaggcggcgatgaacgtacgtaaccgtgaggcgcaggagcgggcacgcaacggtcgcagtaacggtgcccggctcttcggcatcgtgtttctgctgatggtgatgggcgtaatgattgcgggtggcttagtggtgctgaagtggatgaacgatgcctctcggttaccgctgtcaaagctggtagtgacgggacaactgcattacaccactcacgacgatattcgccaggcgattttgtcgttaggttcacctggcacctttatgtcgcaggatgtgaacatcatccagcagcagatagaaagattgccatggataaagcaggttagcgtgcgtaagcagtggccggatgaactgaaaatccatctggtggaatatacgccggtggcgcgctggaacgactctcacatggttgacagcgacggcgtgtcattcagcgtaccggctaaccatatgggtaaagaaacgctgccgatgttatacggtccagaaggcagtgaaaaagaggtgctggcgggttatcacagtatggatgacgtgctgaaagccaggaagtttaccctgaaggtggcgtcgatgacggcgcggcgttcatggcagttagtgaccagcgatgatgtacgtattgagctgggtcgtactgataccatgaagcgtctgaatcgttttattgagctctatccggtgctgctgcagcaaggtcagaatgaacacaagcgcatcaactcggttgatttacgctatgactctggcgcttctgttggctggacaccgatagtgatggagccacaggacagtaatcagcaacaaaaccaggcacaggctaaacaacaatgatcaaggcaacggacagaaaactggtagttggactcgaaatcggcactgcgaaggtcgccgccctggttggggaaattctgcctgatggtatggtcaatattattggggtcggcagttgcccgtcccgcggtatggataaaggtggcgtaaacgatcttgagtcggtggtgaaatgcgtacagcgcgccatcgatcaggctgagttgatggcggattgccagatctcctccgtttaccttgcattatcgggcaaacatatcagttgtcagaacgaaatcgggatggttccgatttccgaagaggaagtgactcaggatgatgtagagaacgtggtgcatacggccaagtcagtgcgcgttcgtgacgagcatcgcattctgcacgttattcctcaggaatatgccatcgactatcaggaaggcattaaaaatccggttggtctgtcgggtgtgcgcatgcaggcaaaggtgcatttgatcacctgtcacaacgacatggcaaaaaatattgtcaaagccgttgaacgttgtggcctcaaagttgaccaactgatttttgccggtctggcatccagctttgcggtcctgaccgaagacgaacgcgaactgggcgtttgtgtggtggatattggtggcggcacaatggatatcgccgtctacacgggcggcgcattacgtcatactaaggttattccttatgctggcaatgtggtcaccagtgatatcgcctacgcatttggtacgccgcccaccgatgcggaagccatcaaagtacgacacggctgtgcattagggtcgatcgtcggaaaagacgaaaacgttgaagtgccaagcgtgggcggacgtccgccacgtagcctgcaacgtcagacgctggccgaggtgatcgagccgcgttacaccgagcttttaaatctggtcaacgacgagattttgcagttacaagagcagcttcgccagcagggcgttaaacaccatcttgcagcagggattgtgttaaccggcggcgcggcgcagattgaaggattggccgcctgtgcgcagcgcgtattccatacgcaggtacgcattggacagccgctaaacatcacgggtctgacggactacgcgcaggagtcttactattccactgcggtggggctgttgcactacggtaaagagtcacacctgaacggtgacgcagaggctgaaaagcgcgtttccgtgggtaactggtttaaacgtattaatagttggttaaaaaaagagttttaatttttgtaaaaggggatcatgctgttttctttagtgatctccaggcgacaggcacataacggagagaaatcatgtttgaacctatggaattaaccaatgacgcggtgattaaagtcatcggcgtcggcggtggcggtggcaacgccgtagagcacatggtacgcgagcgtatcgaaggtgtggaattcttcgctgtgaataccgacgctcaggcgttgcgtaagacagcggtcggccagaccatccagattggtaataacattaccaaggggctgggcgcgggtgctaacccggaagtaggccgtaactctgcagaagaagatcgcgaagcactgcgttctgcgctggaaggggcagacatggtgttcatcgcagcaggtatgggtggcggtaccggtaccggcgcagcgcctgttgtggctgaagtggccaaagatttaggtattttgaccgtcgcggtcgtgaccaagccttttaactttgaaggcaagaagcgcatggcgtttgctgagcagggtatcgctgagctgtccaagcacgtggattcactgattaccattcctaacgacaagctgttaaaagtccttggacgtggtatttccctgctcgatgcttttggcgcggctaacgacgtgctgaaaggcgcagtacagggtatcgccgagctgattactcgtcctggcttgatgaacgtggacttcgctgacgtgcgtaccgtaatgtcagaaatgggttacgcaatgatgggttctggcgtggcctgtggtgaagaccgtgcagaagaagccgctgagatggcgatctccagcccactgctggaagatatcgatctctctggtgcgcgcggcgtgctggtcaacattactgcgggctttgacctgcgtctggatgagtttgaaaccgtgggtaacactattcgcgccttcgcctcagacaacgcaaccgtcgtgattggtacctcgctggacccagaaatgaatgacgaactgcgcgtcactgtggtggcaaccggtattggcatggataagcgtccagagatcaccctggtcactaacaaaccagccagtcagcctgtgatggatcatcgttaccagcagcacggtatgtctccgctgccgcaggagcaaaaacctgccgctaaagtggtgaacgatcagagcgcacagtctaacaaagagccagattaccttgatattccggcatttttgcgtaagcaggccgactaggaataaccttataattgggatttcccgctctttgtgctaaagtgttcgcccgctggtaacgtatactggcggtcggaaagcgatattgcgagataataacgatgatcaaacaaaggacattaaaacgtattgttcaggcgacaggtgtcggtttacataccggcaagaaagtcagtctgaccctgcgccctgcgccggctaataccggggtcatctatcgtcgcactgacttgaatccaccggttgattttccggctgatgcaaaatacgtgcgcgacaccatgctgagcacctgcctggtgaacgatgaaggcgtgcgtatttcgacagttgaacacttaaatgccgcactggcaggtctgggcatcgataacatcattgtcgaagttgatgcgccagaaatcccgattatggacggcagtgcagcgcctttcatctatctgctgatggatgcaggtatcgagcagctcagcagcgccaagaaatttgtgcgtgttaagcagactgtgcgtgttgaagacggtgacaaatgggcagagatcaaaccttataacggtttctcgcttgatttcactatcgatttcaaacacccggctatcgattccagctctcagcgctaccagatgaaattctctgccgaagcgtttgttcgtcagattagccgtgcacgtacttttggcttcatgcgtgaaatcgaatatctgcagtctaaaggcctgtgcctgggcggtagtttagattgtgcgattggccttgatgatttccgcgtgcttaatgaagaaggcctgcgttttgaagacgagttcgtgcgtcacaaaatgctggatgctatcggcgatctgtttatgtgcggccacaatattattggcgcgttcaccgcgttcaaatcaggccatgcgctgaacaacaaactgctgcaggccgttttggctaagcaggaagcctgggaatgggcaaccttcgaagacgaagctgaattgccactggcgttcaaagcaccaaatttggttctggcttaaatccgttcagaacgtgaaacggctggctgtgctgacactctctccggtcagtggcaccagccgttttttattgcctcgctgttaatctccgcctgttgcgatagcattcctacgtcaaagcaaacaattgctgaattgctgcacaatcgcgcgcgatttctcccgttgttgcgctaatcccaggtgtcgccgcgccacattagtgttactatctctggcgcttttacaggctgcatgctgctgaaaaccgcggtgaataattaaaatgttatgcgcaatggaacaattgtgatcggaatccttctacgctggcgacaattaggtagacgctatttctggcctcatttccttctcggaatggtggcggccagtcttggcttgccagcgtgtgcgcaaacggctgaactcaataccgcatcagaatcttccgccagtagcctgtttatcggcaatgccgttcgttttgaccatttgattcgtcttcaggaagcctcgcgacgtcccagtttctcggttgactactggcaccagcacgccatccgcacggttatccgccatctctctttcacgttaacgccgcaggcgcaggcggaagagcaggtgcatccgctggccgcacaaaagctggcgttgattgattcacttcatgcattattaacctcccaggcggcacaacccagcatcccggttcgtgtctcctcgcaacctcttcctgccgctccgacacagacgcgttctgacggacatggcaaagtgcacggtatccgtgccggacccgctttattgttctgctaatctctttgtttttaatcccatttagatttcgcagtccggactctccggctgaattgagaatatatttattatgttaatcaaaatgttgaccaaggtttttggtagcagcaacgatcgtactttgcgccgcatgcgtaaaaacgttgatatcatcaacaagatggagcccgagttcgaggtgctctccgatgacgagctgaaagccaaaacggtactcttccgtgagcgcctgaaaaaaggtgaatcactggaaagccttatccccgaagcctttgcaaccgtacgtgaagccagtaaacgtgtgtttggcatgcgtcactttgacgtgcagctgattggcggcatggtgctgaataaccgctgtatcgcagagatgcgtaccggtgaaggtaaaaccctgacggccaccctgccagcctatttgaatgccttaaccggccagggcgtacacgtcgtcaccgtcaacgactatctggcccagcgtgatgcggaaaataaccgtccgttgtttgagtttcttggcctgagcgtcgggatcaacatgtctggcctgccttctgtcgccaaacgcgaagcctatgcagcagacatcacctacggtaccaacaacgagtacggctttgactatctgcgtgacaacatggcgttcagtccagaagagcgcgtacagcgtaagctgcactatgcgctggtggatgaagttgactccatcctgattgatgaagcgcgtacgccgctgatcatttctggtccggccgaagacagctcagaactttacaccaaagtgaataaaatcattcctcatttgattcgccaggaaaaggaagattcagacaacttccagggcgaaggcgactattgggtcgatgagaaggcgcgtcaggcgcacatgagcgagcgcggtctggtaaaagtagaagaactgctggtaagtcagggcattatggtggaaggcgaatcactttattcaccgaccaatatcatgctgatgcaccatgttactgcggcacttcgcgcccatgcgctgttcacgcgcgatgtcgactacattgtaaaagatgatgaagtcgtcattgtcgacgaacatacaggtcgtacgatgcaggggcgtcgctggtctgacggtctgcatcaggcgattgaagccaaagaaggcgttgagattcagaacgaaaaccagaccctggcttctatcaccttccagaactacttccgcctttatgacaagctggcggggatgaccggtacagctgataccgaagcgtttgaattcagctccatctacaaactcgataccattgttgtgccgaccaaccgtcctatggtgcgtaaagatcttgccgatctggtttatatgaccgagaaagagaagatcgatgccatcattgaagacattcgcgagcgtacggccaacggacagccggtgttggtcggtacgatttcgattgaaaaatcagaagtggtatcaaacgaactgacgcgcgccggcattaaacacaatgtcctgaatgcgaagttccatgcccgcgaagcggatatcgtggcgcaggccggtcaaccgggtgctgtcactatcgccactaacatggcgggccgtggtacggatatcatgctgggcggtagctggcacgcagaagttgccgagcttgaaaacccatcagatgcgcaaatcgaagagattaaagccgcctggcagattcgccatgatgcggtgctggcttcgggcggtctgcatatcgtgggtactgaacgtcacgaatcgcgtcgtattgataaccagctacgtggtcgtgcgggtcgtcagggtgacgccggttcttcacgcttctacctgtccatggaagatgcgctgatgcgtatctttgcctcggatcgtgtttccaacatgatgcgcaaactgggaatgaaacctggcgaggccattgagcatccgtgggtgaccaaagccattgccaacgcgcagcgtaaggtggaaagccgtaacttcgatattcgtaagcaactgctggaatatgatgacgtggccaacgatcagcgtcgtgctatctatagccagcgtaatgaactccttgatgtgtctgatgtgtcagaaaccatcaacagtattcgcgaagacgtctataaatccattatcgacagctatattccgcctcagtcgctggaagaaatgtgggatgtgccgggccttgaagagcgcctgcgtaacgatttcgatctggatctgccgattagcgaatggctggacaaagaaccggatctgcatgaagagacgctgcgtgaacgtatcatgacgcacgccgccgagagttatgcggaaaaagaagagatcgtcggcgcggaaatgatgcgcaactttgagaaaggcgtcatgctgcaaacgctggactcgttgtggaaagagcacctggccgcaatggattatctgcgccagggcatccacttacgtggatatgcacaaaaagatcctaagcaggaatataagcgtgaatcgttcgccatgtttgccgcgatgctggaaacgctcaagtacgaagtgatcagtaccctgagcaaagtacaggttcgtatgccggaagaagtcgaagcgatggagcaacaacgtcgtgaagaggccgagcgcctggcacaacaacagcagttgagccatgccagcgaagaaatcctggcggcggagtccgttgcgcagcagggcggcgagcgtaaagtgggccgtaacgatccttgcccgtgcggttcaggtaaaaaatacaaacagtgtcacggtcgtctggcctgatcacgttgtggaactaaaaaggagccaatggctcctttttttgcctttcagtttgctattcgaacgcctgagcggttaacaacctgcttaacatgttttagaatcagccctctttcactcactctccgggatattttcatgaagcacctgcaggttgcggtcggcatcattcgcaatgccagtaaacagatttttcttgcccagcgtgcggcgtcctcgtatatggccaataagtgggaattccccggcggaaaaattgaagcaggtgagagcgccgagcaaggattagtgcgcgaactgttagaagaaaccggtattgaagtgacgcaggcgcgcgctattggcacgaaagatcatacctacgacgatctgcgcgtaacgctgcattttttcctggtggaaggctggaaaggtgagccctggggcaaagagggacaaccgcaacgttgggtcgaacaacatgcgctggtcgccgaagagtttccggcagcgaatcatgagctgatagcgcgtctggtggcggacgaactgtaatacggtggggcaatcacgccccaccgtattactcagcggtcttcttcgctccagttatcactgtcattcaaatcatcgctgctgggaatgcgcttttcttctgcagcccactcgcccaaatcgattaactgacagcgtttactacaaaatggccgccacgggctgagttcatcccagatcactgttttaccgcactgcgggcattccaccgtcattatctcttcctgcattttcacctctaacaacaggccagttggaagttaaggcgcgctggcacttcgccatgctcgctgtccaatggcataaaacgtatcgcaaaacggcttttatggcccgaaacctgaggatacagtgcatcctccatttccagctgcagtcgcaataaatccgcgccttcagcattatcctgataaaacccattcaaactggtttgtaaacggtaggttcccgactggcgaatcaaatcaagcagcatcgccagggtactgtgcaacgggataagggtttccatccagcgtgtcacctgcgcgtcgcgcgtcgcctggggcaaatgcagccaaatatgcaggccgggtaaatcaaagctacagcatccgccgggaatgctgagtcgttggcgaaccagggcgataagacgatcttctcgcaatggctgtcccatacgaggggcgctgttaagcagaacagactgcgctttcagcttgtcacgtaatgcatccaccacggacatatctacgccgggcacatcggcccatgcacgcagtttcgcttgctggcgttcaagctctttcagcaattcggtgcgcatatcgccacgctcgaagatatccagcagttctccaatcaggcggaaaaaagtcagtgccgtcgcggtgttttccaacggcataatgtcatgcaactggtcgatcaaaaattccacgcgcagccaggtacgcattttttcattcagtggatgttcaaacagaacgactgtactcatgggttaatcctgtttcgctgccgcaagcttcagataaagctgatggagttgggcaacctggggcagcgcattttcaggtgcgccactgttatcaataatatcgtccgcacaggcgagacgctgttgacgcgtggcctgtgccgcaagaatacgtttagcctgatcgagagagacattgtcgcgctgcagcgtgcgtttaagctgcgtctcttcatcggtatcgacgaccagcacgcgatcggcctgccgctgcagctgattttcaaccagcaaaggcaccacccacaaaacatagggcgaaacggcctgcgctttaagctgctgggtgcgtgcattgatcagagggtgaagcagcgcgtctaaccagcgtttttcatcgggcgtggcaaaaatgatctctcttaaacgtgagcgatgtagtgcgtcctgttcgttcacaatagcgtcgccatagcgagcgataatagcctgaagagcgggcgtgcctggctcgacgacttcacgagcaatgacatccgcatcaatgatatcgacacctgacgcagcaaaatactcggcaatggtacttttgccgctgccaattccgccagtcagcgccacagtgtagggggaatctctcacacaaactctcttagtcgctcagtatcacgccggtcacgcgtcatcacaggataaatatgcgcgctgggtcacaacaaaaatacgcagttgaatttaatggattgtagcgtaaataaagtgaaattcgcagtcttgttgcggctggaatggcgcgtatcatgagatcgcgggaaccgtgatggcttcatgcacgacagtttataacctcttaccaggacaggatgtatgcgcattgaagaagatttgaaactgggatttaaagatgtattgattcgccccaagcgctcaacgctgaaaagccgttctcaggttgagctggatcgcagctttacctttaagcattccggtcttagctggagcggtgtgccggttatcgccgccaatatggataccgttggcacctttctgatggcggaggcgctggccggttttaatattctgacggctgtgcacaagcattacagcgtagaggaatggcggacattcgtgcaacgcgtaccgagtgcagtgctgaagtatgtgatggtttctaccgggacctcggatgccgatctcaataaactgatcgcgattatggcgatctccgacgagttgcagttcatctgcatcgacgtcgccaatggctattctgaacactttgtcgatttcctgaagcgcgcccgggaaaccttccctggtaaaacgatctgtgcagggaacgtggtgaccggcgagatggtggaagagttaatcctgtctggtgcagacatcgttaaggtcggcattgggcccggctcggtgtgcaccacgcgcgtcaaaaccggcgtaggctatccacagctctctgcggtcattgagtgcgccgatgcggcccatggcctgagcgggcaaattgtcagcgacgggggttgtagcgtaccgggcgatatcgcgaaagcctttggcggcggagcagatttcgtcatgctgggtggtatgctggccgcgcatgatgagtgtgagggccggatcgtcgaagaaaatggcgagcgtttcatgctgttttacggcatgagctcagagtcggcaatgaaacgtcatgccggtagcgtcgcagaataccgcgcggcagagggaaaaacggtgaagctgccgttacgcgggccggtggaggaaacccttcgtgacattctcggcggtctccgttctgcctgtacgtatgttggcgctgagcgtctgaaagagttaaccaaacgcacgacctttatccgggtagccgagcaggaaaaccgaacctttacccgttaaggcaacctgttgtgcatgcagtaagggtgaggctgcgcctttactgcatcgcttctcctaatccaaacacgggtaagtacatggcaatcaccaatgtgcccacaatgccgccaatcaccaccatcatgatgggctccagcgaggccgcaagattatcagcacgcgtcagcgtctgtccttcatgccattcagccagacgtaccagcatcacatccagtgcgcctgcttcttcacctacgcgaatcaactgactgcagagtgggctaaataagggatgattgttcagcgcctggtgcagaggattgccctgagcaatatgatgctgaagtgcctcgatagcttcccgccacagcagcgaggagagcgtgacctttgccgcctcaagcccttgcagcagcgtcagtcctgcctgctgcgtcaactgcaaaacactgtagatttgtgtcagttgacttccccgccatagtccggcgatcacgggaatgcgcagcaaagctcgctgctcgcgacgctgccagttttcagcgtgccgacgccactgttgccctcccacggccagcagaataaccaacccagttaacggtaatccccatgcctgcaatatctcagagagcgtaataacagcagcggtgaaagcaggcaagggggcgtcaaaggaggcatacaccgaaacaaactccggcaagacaaacagcagcatgccgcaggtgacagccagcgcgacggccaggataaacagcggataacgcagcgctttaatcaccttgtcccgtaaatgttgctggcgcgtttgctgctgtgccagttgttcgcagcagatgtccaactgaccggtcagctcaccaacctccatcagggcgggataaagcggcggaaatatttgcggccactgacgcaaggcgtgggaaaagggctcgcctgctaacacgtgatgttgcaaagccagcatcagggcgcgccaggctgcctgaggatgcccttcagcaaggaggctcaggctctgtgacagaggaaggcccgccttaagcagcgtggcgagctggcgaatcaaatcgattttatgctgccacttccagtcacttcggcgtatcactttttcccgtttccagctcacgggcagtaaatgacgttgcgccagatcagaaaacagcctgtcgcagtcaggtgcaaggtggtggcctgtttgcaaccttccgctgctgtctaccgcatgccagcgatacaaacagaggctagtcattatccagtccgatcacgcgctgcatctcttccagcgaggtttcaccgcggctgacggcttccagaccggatgtcatcagggtgcgcatgccctgctgtttggccaggtccagtaagccttcgaccggcatttcggcggcgatggcgttttgtaactttgccgtaacgggcagtaattcaaataaggccagccgaccaaaataacccgaaaagcagtgatcgcaacccggtgctcgccaggtttgtaaggtaccaggccagagtgacgcaggaaagtgggccaccgcctgcgccggttcgcggcagcgagggcacaagcgtcttaccagccgttgtgcaacgatcaggcggagtgccgaacccagcagatagcccggaatgcccatttgacgtaagcgagtcaacgtttccgccgtcgagttggtgtgcagggtcgagagaaccagatgaccggtttgcgctgccttaacggcaatttccgccgtctcaccatcacgtatttcacccaccatgatgacgtcaggatcctggcgaagcagagcgcgtaacacgcggttgaaatcaaggccatactttggattaatctgggtctggttgatacccggaagcgggatctcaacaggatcttccacgctgcaaaggttcttatccggctggttgatggcgctcagcccgctataaagcgtaaaggttttgccgctaccggttgggcctgttaccagaatcagcccttgcggctgcatcagtgatgaggtcagcaggcgtagctgcgcggcaggcagtcccagcttatccagtgacaacgcggcaccttcactctgcagcaggcgtaccacggctttttcgccgccctgaatgggcaaggttgagagccgaaaagaggccgacctgccgtcaatatcacaactaaattgcccatcctgaggcaggcgccgttcggcaatatccagaccggccagaattttcagccgcgccagcagtgcagccggttgcgtatcaaactgcgggggcaggggatgcaggaccccgtcaatgcgcaggcgaatacgcaagccgttctggtaaggttcgatatgaatatccgacgcacgacgcagtgtagcctggcgcaaaagctgactggcggcatcaatcgtcgattcccctggcgctttttcttttgccattagtggtttattcgtcgattcaaactgttccagtcgggcctgtggccagcattccacttcggttttacacgggctggcaaactgtaaggcttcaagcaggcccgccggaatgctttcggcaacggcaaggcgtaagtgggtcgtattgtgatcgaggacaatcgctctgtagcgctggcagatcagcctaatcgcatcatcaggtttttgcatatgcgcctccccgatcggcaaagcggaattgttcctgacagttatcacgcagagtcgtgttattgctggtacaggtgcgctgccacacgatggtgccctgggtgctgtcccatacggggagcatctcaacgcttaatccgttaaggctttcctgcccggtcagggtaatcatgccgttgaccacggtgatggccgacacataacgcgatgtggttccctgcggaataccgcgttgcccggcctggcactgatcaggaccgccgcgctcaatggcacacagttcaacggctgtcttaaagggcaccatcgtttgcaacatgtcggttagcgcggcgcgctgcagatagttttgataagcaggcagcccaatagcgctgagaattgccacgatgccaaccacaatcattaattcaaccagcgtgaaaccacgttgatagatcattccattgcctcctgtgtaagaaggccgcagtgtaaaaagcctgtggcggcgataacagcagcagatcaggagagtggaaaagcgcaggcaggaaagaaagcggattacagcaatacagcttaaacagtggaagaaactgcacaaaacaggccgtgccagcggcacggcgaaaaccattagctcgcttgaaagcgcatggaaagatcgagggcacgcacatgtttggtcagtgcaccgacggaaatatagtccacaccggtctgggcgatttggcggagtgtcgtatcagtgacattgccggagacctccagcagcgcgcgacctgccgttaccgtcaccgcttcgcgcatctcatccagcgtaaagttgtccagcatgatgatatcggctgccgcctcaagggcttcctgtagctcctttaacgactcgacttccacttccaccgggacatccggatagagccaaaaggctttttccaccgcctggcgaatcgatccactggcaataatatggttctctttaattaaaaaagcatcagacagcccaaggcggtgattgctgcccccgccgcacagtacggcatactttaaggccgtacgtagccccggtacggttttacgcgtatccagaagctgtgtctgtgtgccttccagcagcgcgacatagcggctgacttcagtggccacgcccgacagcgtttgcacaaagtttagggcagtacgctcggcagtgagcagcaggcgagcggggccctcaatgtcaaacaaccgctgatccgcgataacgggttgtccatcttcaacatgccaggtcagtgcgtcataggtacccaactggttaaagacctcttccacccagcgtttaccacaaaaaacaccggcttctcgggtaatgacctgggcatgggcccggctttcggcaggcaacagctgcgcggtaatatcccgatcgctgtctatctcaccgccaagatcttcctgtaatgcgcgtgcaaccgtttcaggaatatcattttcaatacgttcaagcagcgccttgtggcgactgtcaggatcatagcgacgcacagacatagcgttcagctccagcaaaagtcagataacagtgtgattaccatatcctgaataatacagcggtgccagtcctgaacggtgttttgtttagtatacttaacaaaacagtttcggtgcgtaggtcgcggcgcattttggcgcaataatcccttagaattcatgttattctcaaaccgattccgcgatgagaaaccagtatgaaattagaaaaaggatggctgaccggtgtgcgacaggtgccgtcaccgcactataatgcgcggccgcataacgaagcaccttctcttctggttattcataatattagcctgccgccgggtgaatatggcggcccgtggatcgataaactgttcacgggcacactgccttcagacgcccatccttactttgctgatatcgcccatttacgcgtcgccgcacactgcttaattcggcgtgatggcgagattgtgcagtatgtgccctttgaccagcgcgcctggcacgcggggatatcgcagtttgcaggacgggaaaactgcaacgatttttccattggcattgagctggaaggaacggatgttgaaccctataccgaagcgcaataccaggctctgcatcagatcacgcaaatcttgatgcagcactatccgataacgcctgcccgcattaccggacacagtgatatcgcaccggagcgtaaaaccgatcccggcccggcgtttgactggacctattatcagcagcggttacagcaacgaaaatcatgatttatctggagtaactatgacgttatttaccttgttactggttttaggttgggagcggctgtttaagctgggggagcactggcaactggatcatcggcttgagccctttttccgcggtcgtcggcacttttctgttatgcgcaccctgttgatgctgtttgtggtgatggtgctgaccgcgctggtggtatggagcctgaaaggcattctgtttggtatccctcaactcgtgttctggattgtcgtgggattattgtgcatcggtgccggtgtggtgcgtcagcattatcatgcctatctgcaggccgcgagccgtgatgaagccgcagcgcatcaggcaatggcagcagaattaaccctgatccacggcgtgccggttgaatgcagtgaacgcgaatttttacgtgagttacaaaacgccctcatctggattaacttccgtttttatctggcaccgatgttctggtttgtggtgggaggtgcgtggggcccggttttgctggtgggttacgcttttttacgggcctggcaaagctggctggcaaaacactgtacgccgatggcgcgtgcgcaatccggcgtggacagcattttgcatctggttgactggattccggtgcggctggcgggcgtagcctatgcgctgctcggccacggagagaaggcgttacctgcctggtttgcatcattaaccgacaggcaccgctctcagtaccatgtgctaaccacgctggcgcagttttccctggcccgcgatccacacagcgataaggtcgctacgccacgtgttgcggtggcgctggcgaagcgtatttcgctggtgttagtcgtggtggtggcgctcctgaccatctacggcacgctggtgtgatcggcaggtggcacgccaaaatccggtgtgccatcttctcgccagtgtacatatttcaggcgcgtgtgacgattaccatcccacagagggtccccttcaatttccgtatagttgcgcgcatggtagaccagcagatcgcgtccgctttcatcctgtgtaaagcaactgtgccctggcccgtactggcgattttcccaactggtcgagaataccggtcgcgctgacttttgccaggctagcgcgttcaacggatcggcgtcacgctgaatagacagcaggcccatacagtaattttcatccgttgcgctggccgaatacgtaatgaaaagccgatcgccatgcacaatcgctgccgccccttcattaacactaaagcccgcgcactcccattcgtattccgggcggctcagcatcaccggcttaccttttagcgtccacggattgcgcaactccgcaaggtagaggttggaattacccggaatgctgggatctttctgcgcccataaataccagtttttgccctgatgaacgaagtgagtggcgtccagcgagaaactgtcgatgtggcttaaaacctggcgtgcaggctgccagctgccgctgaggggatccgcatcgtcgcagaccagtgcgtacatgcggtgctggaacagtccgtctttgatgtcgcgtgaaggggctgcggcaaaatagatgacccactgaccatcaatatggtgcagctccggtgcccaaatcaactcgctaaaggggccgatatcaggcttttgccataccacaaccggctctgcgttgcgtaagcccatcaacgtgctggcacgacggatttccagacgatcgtattccggtacggaagcaatgaagtaatagtgctctccatggcgcaggataaaaggatcggcacgtcgttcgataaaagggttaggccagttctcgctcatttcactgctcccgtctggatctcgctggtgtgttgattgtgtcccgtctgtaccgctgtacggcgcagggcaagatcgcgttggatggtttgcattaagctgcgatccactttcatcagccgcactacgccggcggtaatcaaataaccgatgcccggaataacggtaaacagcagcacgatcccactgatggcatgcgcggattgctgttccgctccggcatcgtagccgtaagccgagagcagaaaaccaaccatggcacctgcgaccgccaggcccaccttgaggaagaacaggttgccggaaaagctgatgccggtaatgcgcttgccggttttccactcaccgtagtcatccacatcggccataagggaccaatgcaaaggcgaaggaatctgatgcaggatattcagcaggaagtaggcgatgaccaccgtgacggtggcgtgcggatcgagccagtaaaaaccactggagaacaacgcgagggcaatattggtccagaaaaagaccttcagcttacaccaacgatcggtcagcacttttgccagcgtactgccaagcatcatgcccaccacaccaaggctgataaacagcgtagcaaagtgaggggtttggcccatcacccaggtgacgtagtacatggttgccgccatacgaataaacccagggcagacgttgcagaacgtcagcagcaggatgcgcacccactgatcattcttccacacgtcacgcaaatcgtgtttcagatcttcatttgtcggcacggcagggtgaatacgttcacggacgttggcgaaacagaacaggaacatcgctaatcccaccagcgccagtaggcccatcgccatttgatagccgcgcgctttattctcgccaccaaaccactcagccatgggcagcagtgacagtgagaggatcaacgtagcaatgcccaccatcacaaagcgataggactgacaggacacgcgctcaccgggatcgttggtaatcacgccgcccagcgagcaataggggatattaatcgcagtgtaggtcagggacatgaaaaaataggtgacaaacgcccaaataaccttgctgtggtagctccagtcaggtgtggtaaacatcagcacactgaatatgacatagggcaccgatacccagagcagccaggggcgaaagcgtccccagcgacttttggtgcggtcggcaatagcgcccattatcggatcggtgatggcatcaagaatccggacagagagtaacagtacaccgaccaatgccggggctaagccaaacacatcagtatagaaatagctgagaaacaacatgacggcaccgccaatcatattgcatccggcatcacccatgccgtagcccagcttttctctgaacgagagcgttttacctgtcattattgtttcctgcagaaggattaaacagaaaaggattattaatgtttaatcagcaggatgagcggcaataaatcgttgcgatgatggacaaaacagccatggagagagaagtgtgaacagcgtcgggtttaacgactgcccacccgcttaaacatgcgcgcgggtgggcagcgccatcaggctttttgcgttttatttttaactacataaccaacagcaaggatgagcagccagacagggattaaccatacggaaatggccatgccgggtgtcatcgccatcaggaccagaattccgcccaggaaaaccaggcaaatccagttacccagtggatacagaacggccttaaagcgggtcgtcacgccctgctgatttttctttttacggaatttcaggtgcgccagactaatcatcgcccagttgataaccagcgcagaaacgaccagcgacatcaacagaccaaacgcttcgcccggcatcaggaagttgagcagcacacacagggcagtcgcaacggctgacaccagaatactcatcaccggcacgccgcgacggtcaacgttcagcagcgctttaggcgcatttccctgctgtgccagaccaaacagcatacgactgttacagtaaacgcagctgttatagaccgacagagcggccgtcaggatgaccacgttcagggcattcgcgaccatcgcatcgcccagttcatggaaaataaacacgaaagggctggtgtcttcggttacgcgcgtccacggcatcaaagaaagcagtaccgccagcgagccgatatagaaaatcaggatacgccacagcacctgattggtcgccttagggatcgtgatttccgggttatccgcttccgccgccgtaattcccaccagttccagcccaccaaacgaaaacatgataatcgccatgaccatcaccagtccgcccaggccattaggcagaaagccgccgtgctcccacaggttgcgcacggttgcctgtggaccgcccgtaccgctaaacagcagccagccgccgaacaggatcatcgcaataaccgcaatcaccttgataatggcgaaccaaaattccatctcaccaaacacttttacgttggtcaggttaacggcattgatcagcacaaagaagatcgcggctgaggcccaggtaggaaaatcaggccaccagaactgaatatatttaccgacggcactcaactcggccatcgccaccagcacatacagaacccagtagttccagcccgatgcaaaaccagcaaagttaccccagtatttataggcgaaatgactgaagctaccggctaccggctcttcaaccaccatttcaccaagttggcgcataattaaaaaagcgataaatccggcaatggcatagcctaaaataacggctggccctgccgatttgatgaccgacgcgctgcccagaaacaggccggttcccactgcaccacccagggcaatcaactgaatatggcggttttttaaaccgcgcttcagcgattcgccgtgctgttgttccatacacacctcgtgatgttgttattcttcgctgcagtgcaagctgactgtaaagaattgattacattaacgactgatatttttagggtatctgacttgcgtaatgaagccagttgtaacctggggaccagaatagtgataagcgcagggctttgcacctgctttcgctttagcggtcacgagttgcctgaaaaagaagcaaccgggtggaatccatagcgattggcgataaagaaaaaggctccggctcggtcaaaaaccgcacagccagctaaatcggtttaactgccgacgttatgtaatttttagtaaaagttaaaaaaattaacattccgctaacgcccggctttccactttttaactctacagttatggcagccacgccgcattccttcactttaatgtcacagatgccgtatagacacaaggtgaatactttgttactttacgggcaccttttttgaattggtattaccaatttactttgtcagacaggcacatttaagaagggaagatggcttacagtaagattcgtcaacccaaactctgcgatgcaattgagcagcaacttgaatccctgatcatggaagggacgcttcagccgggagagaagttgcttcccgagcgcgaactcgccaaacaattcgatgtttcacgtccgtctctccgcgaggcaatccagcgtttagaagcgaaaggattgttacttcgccgtcagggcggcggaacattcgtacagaagcatctctggcagagcatgagcgatcctctcgttgagcttctcgcagaacatccggaatctcagtttgacctgttggaaacgcgccatgctttagaaggtatcgcggcttactatgccgcactgcgtggcacagaagaagatttacagcgtattcgcgactgtcatcttcatatacagcaggcgcaggacagcggcgatctcgacgctgaagcagacgcagtgatgaagtatcagatcgctgtcacagaagccgcccataatgtcgtgcttttgcatttgctacgatcaatgggccctatgctggaacagaacgttcgacagaattttgaattgctctactcgcgccgggaaatgctggcgaaagtgagcggtcaccgcgccagaatttttgaggcgattgtggctcgtgagccggaacaagcacgcgaggcttcacaccgtcacctggcgttcattgaggaaatcttgctggacagaagtcgggagcagagccgtcgagaacgctccctgcgtcgtttacagcaacgtaaggaataacgtgcggcaaagatcgtgcggacatgtgcgacgagcctgtctccctgacgttaacaggctcccgatttttcaacgtattagacacagataaggaataccccccatgtcagaacgtttacacaatgacgtggatccgattgaaactcgtgactggctacaggcgatcgaatcggtcatccgtgaagaaggtgttgaacgtgcacagtatctgattgatcaggtactgagtgcagcccgcaaaggcggtgtgaaagttgctggcggtgctgccgcaatcagtaactacatcaactctattgccgttgaagatgaaccggactatccgggcaacacctcacttgaacgtcgtatccgttccgccatccgctggaacgccatcgtgtcagtgctgcgtgcatcgaaaaaagatttggaactgggtggtcacctctcctccttccagtcttccgccaccatttatgaagtgtgctttaaccacttcttccgggcgcgcagcgaaaaagatggcggtgatctggtttacttccagggccacatttcgccaggcatttactcacgtgccttccttgaaggtcgtttgactgaagagcagatggataacttccgtcaggaagtcgacggtaaaggtctgtcttcttatccgcatccaaaactgatgccggaattctggcagttcccgaccgtctcaatgggcctgggtccactgaatgcaatttatcaggctaaattcctgaaatatctggaacaccgtggcctgaaagagacgtcgggccagaccgtttatgccttcctgggcgacggcgagatggatgagccagaatcgaaaggtgcgattaccatcgccacccgtgaaaaactggataacctggtcttcatcatcaactgtaacctgcagcgcctggatggaccggtaaccggtaacggtaagatcatcaatgagctggaaggcatttttgccggtgctggctgggaagtgatcaaggttatctggggtggccgttgggacgaactgctacgcaatgacaccagcggtaagctgatccagctgatgaacgaaaccgttgatggcgactaccagacctttaaatcccgcgacggcgcttatgtacgtgagcacttcttcggcaaatatccggaaaccgcagccctggtgaaagactggtcagacgatgagatctggtcactgaaccgcggcggtcacgatccgaagaaaatctatgcggccctgaaaaaagcgcaagacaccaagggcaagccggtgctgattctggcacataccattaaaggttatggtatgggcgacacggccgaaggtaaaaacatcgcgcaccaggtcaagaagatgaacatggatggcgttcgctacatccgcgatcgcttcaacgtgccggtagaagacgacaagatcgaatctctgccttacatcaccttcgataaaggctctgaagagtacaactacctgcacggccagcgtgagaagttaggcggttacctgccatcacgccagccgaagttcactgaaaagctggaaatgccagcgctggaagagttcggtgcgctgcttgaagagcagaacaaagagatctcgaccactatcgcatttgtgcgtgccctgaatgtgatgctgaagaacaagtcgatcaaagaccgcctggtaccgattcttgctgatgaagcacgtactttcggtatggaaggtctgttccgtcagattggtatctacagcccgaacggtcagcagtacacgccgcaggaccgcgagcaggtggcttactataaagaagacgagaaaggtcagattttgcaggaagggatcaacgagctgggcgcaggttcatcctggctggcggcggcgacctcttacagcaccaacaatctgccgatgattccgttctacatctattattcgatgttcggcttccagcgtattggcgatctgatgtggctggcgggcgaccaacaggcacgcggcttcctggtcggcggtacatcaggccgtaccacattgaacggtgaaggtttgcagcatgaagatggtcacagccatattcagtctctgacaattccaaactgtatctcctacgatccgtcatatgcctacgaagtagccgtcatcatgcatgatggcctggtccgtatgtacggcgaagcgcaggaaaatatctattactacatcaccacgctgaacgaaaactaccacatgccagcgatgccgaaaggtgccgaggaaggtatccgtaaaggtatctataagctggaaaccgtggacggtagcaaaggtaaagttcagctgttgggctcaggctctattctgcgccatgtacgtgaagctgcccagatcctggcgaacgattacggcatcggttcagacgtttacagcgttacctcgttcaccgaactggcccgcgatggtcaggattgtgagcgctggaacatgctgcatccaacggaagcacctcgcgtgccttacatcgctcaggtgatgaacgaagcacctgccgtggcgtcaaccgactacatgaagctgtttgctgagcaggttcgcagctatgtgccgtcaagcgattaccgcgtgctgggtacggatggttttggccgctctgacagccgtgaaaatctgcgtcaccactttgaagtggatgcatcttacgttgtggttgccgcgctgggtgaactggctaaacgtggcgaaatcgataagaaagtcgtggcggatgcgatcgtgaagttcaagatcgatgccgataaagttaacccgcgtctggcttaagaggtaacagagtaatggctattgaaatcaaggtaccagatatcgggtcagacgaagttgaagtcaccgaaattctggtcaaggttggcgacaaggtggaagccgagcagtcgctgatcaccgtggaaggcgataaagcctcgatggaagttccctcgccgcaggccggtgtggtgaaagagatcaaaatcgcgaccggcgacaaagtagaaaccggctcgctgatcatgatgtttgacgcagacgatgctgcagaagccgcacccgcgccagcgcaggagaaaaaagcagacgcagcgccagccgctgcacctgccagcgccagcgccagcaaagacgttaacgtaccggatatcggcggcgacgaagttgaagtcaccgagatcctggtaaaagtgggcgacaaggtagaagctgagcaatcgctgattgtggttgaaggcgacaaagcatcgatggaagttccggcgccgttcgcgggcgtggtgaaagagatcattattaccaccggcgataaagtgaataccggttctcacatcatggtatttgaagcagaaggcgctgcgcctgctgctgatgctaagccagaagtaaaagaagacgcggcggctgcgccagcagcagcggctggcgcaaaagacgtcaatgtaccggatatcggtggcgatgaagtcgaagtcaccgacgtgctggtgaaggtgggcgataaagtcgaggctgagcagtcactgattgtggtggaaggcgataaagcatcgatggaagttcctgcacctttcgccggtacggtcaaagcgctgaaaatcgctactggcgataaagtcagcaccggctcgctgattatggtgtttgaagtggaaggcgcagcgccagccgctgcaccggctgccaaaaaagaggccgcacctgcgccagcggcggcggcggaatctaagcctgcggctcctgctgctgcgaaagcagacagcaaaggtgagtttgccgagaacgatgcctatgtacatgccacgccggtcattcgtcgtctggcacgtgaattcggcgtgaatctggcgaaggtgaaaggcacgggccgtaagggccgtatcctgaaagaagacgttcaggcttacgtgaaagatgcggtgaaacgtgcagaagccgcgccagccgctgccagcggtggtggcctgcccggcatgctgccatggccgaaggttgacttcagcaagtttggtgaaatcgaagaagtggaactgggccgtatccagaaaatctcgggtgcgaacctgagccgtaactgggtgatgatcccgcacgttacgcactttgataaaaccgatatcaccgagctggaagccttccgtaaacaacagaacgccgaagctgagaagcgtaaactggatgtgaaatacacacctgttgtcttcatcatgaaagcggtcgctgcggcgcttgagcagatgccacgcttcaacagttcactgtctgaagatgcgcagaagctgacgttgaaaaagtacatcaacatcggtgtggcagttgatacgccaaatggcctggttgttccggtgtttaaagacgtgaacaaaaagggcatcaccgagctgtctcgtgagctgatggcgatctctaaaaaggcgcgcgatggcaaactgaccgctggcgatatgcagggcggctgtttcaccatctccagccttggcggcctgggaaccacccactttgcgccgatcgttaacgcgccagaagtggccatccttggcgtgtcgaagtcagcgatggagccagtatggaacggtaaagagtttgcaccgcgtctgatgatgccaatctctctgtccttcgatcaccgggttattgacggtgcagatggggcacgtttcattaccattgttggcaatatgctgtcagatattcgtcgtctggttatgtaaaacgcgcaaaaggccggcaaatgccggcctttttgtaacattcagggcaccgcggttggcagtttattaacaattctgtaaactcttgcggtgaacatgtcccggtggaataaggacattatgagcctattccattaggcataattggcgtagtcagattgagtcactgccgcgcaaacccgatagccgtgggtttgcagcagcatacgcaatatggccagttaactagcctaatgggataggctcagcgtctgacccgccggaaatccaataagaggtcatgatgagtacagagattaaaactcaggtcgtggtacttggggcaggtcctgcaggttactctgcagcctttcgttgcgctgacttaggtctggaaaccgtactggttgagcgctacagcaccctcggcggtgtctgtctgaacgtaggctgtatcccgtctaaagcgctgctgcacgttgctaaagtgattgaagaagcgaaagcgctggaagaacacggcattgtgtttggtcagccgcaaacggatatcaacaaaatccgcagctggaaagagaaagtcattaaccagctgactggcggcctgtcaggcatggccaaaggtcgtaaagttaccgtggttaacggcctgggtaaatttaccggtgcgaatacgctggtcgtcgaaggtgaaggtggggcaaccacgattaacttcgataacgccatcatcgctgcaggttcacgtccaatcgaactgccattcattcctcatgaagatccacgcgtgtgggattctaccgatgcgctggaactgaaagaagtgcctaagcgtcttctggtcatgggcggcggcattatcggtctggaaatggccaccgtttaccatgcgctgggttcagagatcgacgtggttgaaatgtttgaccaggttatcccggctgcggataaagacgtggttaaagtcttcaccaagcgtatcagcaagaaattcaacctgatgctggaaaccaaggttaccgccgttgaagctaaagacgacggaatctacgtttcaatggaaggcaaaaaagcgccaggcgaagcccagcgttatgatgccgttctggtggcgattggtcgtgtgccaaacggtaaaggcatggacgctgacaaagccggcgttgaagtcgacgaccgtggctttatccgcgttgacaagcaaatgcgtaccaatgtgccgcacatctacgcgatcggcgatatcgtcggtcagccgatgctggcgcacaaaggcgtgcatgaaggccacgtggctgcagaagtcatttcaggtctgaagcactacttcgatccgaaagtgatcccatccattgcctatactgagccagaagttgcctgggtcggtctgaccgagaaagaagcgaaagagaaaggcatcagctatgaaaccgccacgttcccgtgggcggcatcaggccgtgcgattgcttctgactgtgcagacggcatcaccaaactgattttcgacaaagaaacccaccgcgttatcggtggtgccattgtcggcaccaacggcggtgagctgctgggtgaaattggtctggctattgaaatgggctgtgatgcagaagatatcgcactgaccattcatgcccacccaaccctgcatgagtcagtaggactggcggctgagatctttgaaggcagcatcactgatttgcctaacgcgaaagcgaaaaagaaataagtctcaggacagaaatagcggccccttatggggccgtttttttatggtttcttttaattcggataagtaaacgaataaaggaaagggcgcctgcgctaacacattcacactggcaaaaatggcggagtcacccccgccattaacgaagtttttactgcctggtttcgtaattcaagacagccgaaagttcagcgctcattattctgaggcgaagttcacataatgaacttcggttcgataagctcaaacctaaaagaattaacccgctaataataagtaaaccgtatttcgacttcatggtggcacctctcttgatttttatcgagtgagggactaccctgacagtgttgaggtgttagggtggttcccccgctcgcattcgttgaatagtgaatgtgagcggttccttcctctttccacctcaggttctcacccaaagcaaaaagcctcaggcgcccaaccgcagtctacgcattgattattttattgtctctgtgcttttaactaatttatggttgttattttctactttaatgattaatgaaagtcgctacgtttaattgattatgcctgacgtgattcttaacattaatttcctggtgagtggtttaaaataatctcgtcattgttatcaccttgtcatgaaattgggttaattactcacttcgtgattattaaaacgtagccagtcaataaaatgacgtaaaggtgctgagacatagcgcctgccgggatagtaaagccagaatccttccgcattgcttgtaaagtcacttaatagctcaacgagttcgccacgttgcaggctgggattcacggctgcctgttgcagaaatgcgatgcctgcgcccgcgacagtggcctgcaaaatccgcgtgttgttgtccagtaccaatgggccacgcacggcgatctcctgtttttttcctgcgttccagaattcccagcgatagcgtcggccactgggaaaacgccgttcgatacagggaaactgaagcagttcatccggtgtttgcggtgtaccatgacgttcgataaacgccgggcttgcgaccaccagggtgcgcattgccggaccaaagggcagggcgatcatgtcctgtgccagcacatcgccgtagcgaatacctgcatcaaaacccgcttccaggatatcgaccagcgcatcgttactgtcaatttccagcgtgatgtccgggtactgctggataaacggcagaatcaagctatcaaaaaacagcgcttctgcagaacgcggcatattgagctttagcgtgccgtgcggacgggcacgccagtcattaagctcatctaccgcctgtgacagatcgaccagcgcgggttgaatacgctgcagaaaatattcgcccgcttcggtcagtgagacactgcgtgtggtgcgattaagcagccttacgccgagccgttgctcaaaatggcgcatggcgtggctcagcgccgacggcgtaacgttacgcgcctgtgcagccttacgaaagctacggtggtgcgcgatggcgctgaacatttccagttcctgcagggttgcccgcgagagtgtcattaatgagttttcctcactgaatcggcaaaaatagcgcaattgttgttgtgattgttgaggattataacaataacaccgcaacaataatgaggaagatgtcatgcaacaacgtcaattaggcaatcagggtttacgggtatcggcgctcggactgggctgtatgggaatgacctttgcctacggcaacaccgatgagcagcaggcattgaatacgttgtcccgcgcgtttgaactgggcgtcaactttctggataccgccgagatctatggtccctttaccaacgaagcgctgattgccaaagccattaaaggccgccgtgataacgtgacgattgcgacgaaatttggtttcaatattaccggtgcaggtcagggctgggagaacatgaccggcgtgaacagccagccgcagcatattcgcgaagccgtcgagggatcgttaacgcgtctgggcaccgatcatattgatctgctttatcaacatcgttttgatcctgccgtgccgattgaggatgttgtgggcaccatggcggatttgattcaagaaggtaaagtgcgttacctcggactgtcagaggtgtccgcagcaacgcttcgccgtgcctgtgcggtacatcccatatcggctttacaaagcgagtactcactttggactcgcgatcccgagcagggcattcttgccacctgtcgcgaactgaatgtgggttttgtaccttacagtccactagggcggggtttcctgaccggcaagctggcatccgtggcggatcttgaccaaagtgatttccgccgcagtttgccgcgctttcaacagcaggcacaggaacataaccaaaagttagttgatcaattgacagaggtcgcacggggttatggtatttctgcggcgcagctggcgctggcgtgggttttaggcaagggcgaggatatcgtgccgattccgggagcgagtaaggtccaccatcttgaagaaaactgcgcggctgcggcagtcgtcgtgaaaggcaccgatagtgattatctggatgggttgtttgcgccggaaaacgttagcggagcgcgctatgccagcgctgaatttggcatgatcgatcgctaatccgggcgcggcattccattgttaacaggcagggctttacgccctgctttttttcgtttacaccgcattaggcagctcattctgctgaagaaaacactaatgttgcttttttgtaaacagattaacaaggcggctaaatcctgctatgctgccccacgcggaaccgggcaccttaccctactcatggaatgcgttgtcatcagggtgcaccggaaacccatacaatgagagcgaggagaacgtcgtgctagaagaataccgtaagcacgttgccgagcgtgctgccctggggattgtacctaagccattagatgcttcccagatggccgcgctggttgaactgctaaaaaatccacctgcgggtgaagaagaatttttgaccgatttgttggtcaaccgcgtaccacccggcgtcgatgaagcggcgtatgttaaagcaggtttcctggctgctgtcgccaaaggcgaaacaacctctcctctggtatctcctgaaaaagccatcgaactgctcggtaccatgcagggcggctataacatccatcctctgattgaagcactggatgatgccagactggcaccgattgcagcaaaagcgctttctcatacgttactgatgtttgacagcttttacgacgttgaagaaaaagcgaaagcgggcaatgcccatgcgaagcaggtgatgcagtcctgggctaatgccgaatggtatctgtcacgtcctgagttggctgaaaaaatcaccgttacggttttcaaagtcactggcgaaaccaataccgacgacctgtctccggcacctgatgcctggtcacgtccggatatccctcttcatgccctggcgatgctaaaaaatgcccgtgaaggtattgagccggatgaagcgggtaatatcggaccgattaaacagatcgaagcgctgcaggccaaaggttttcctctggcttatgtaggtgacgttgtaggtacgggttcatcacgtaaatctgccaccaactcggtgctgtggtttatgggtgatgacatccctaacgtgcctaacaaaaaaggcggtggtgttgtcttaggcggcaaaattgcccctatcttcttcaacacgatggaagacgccggcgcgctgccaattgaagtggacgttaacgacctgaatatgggtgatgtcattgatatctatccgtttaaaggcgaagtccgtcatcatgaaaccggcgatctgctggcaagctttgaactgaaaacagacgttctgattgatgaagtgcgtgccggcggccgtattccactgatcatcggtcgtggcctgaccagcaaagcgcgtgaatcgcttggcctgcctgtcagcgatgtgttccgtgtagcgaaagacgtcgcggaaagctcacgtggctactcactggcgcagaaaatggttggccgtgcctgtggcgtggatggcgtgcgtccgggtgcctattgcgaaccgaaaatgacatcggtgggttctcaggataccaccggaccaatgacgcgcgatgagctgaaagacctggcgtgcctgggcttctctgctgacctggtgatgcagtccttctgtcacacagcggcttatcctaagcctgtggatgtaagcactcaccatacgctgccagacttcatcatgaaccgtggcggtgtttcactgcgtccgggtgatggcgttattcactcctggttaaaccgcatgctgctgccagataccgtgggcaccggtggggattcccacacgcgcttccctatcggtatttcgttcccggcaggttctggcctggttgccttcgcggcggctaccggcgttatgccactggatatgcctgaatctgtgctggtccgcttcaaaggtaaaatggagccaggcattacgctgcgcgatttggttcacgccattccgctgtatgccatcaagcagggcctgttgaccgttgagaagaaaggtaagaaaaacatcttctccggccgcatccttgaaatcgaaggtctgccggatctcaaagtcgagcaggcatttgaactgacggatgcctctgctgagcgctccgctgcaggttgtactatcaagctggatcaggcgccgatcaaagagtatctgacgtccaacattgttctgctgaaatggatgatctcagaaggctacggcgatcgtcgtacgcttgagcgtcgtattgacggcatggaaaaatggctggccgatccacagctgctcgaagccgacgccgatgcagaatatgctgcggtgattgacatcgatctggctgagatcaaagagccgattctgtgtgcgccaaacgatcctgatgacgcgcgtctgctgtctgaagttcagggcgaaaagattgatgaagtctttatcggttcgtgcatgaccaacattggtcacttccgtgcggcaggtaagttgctggacagccataaaggccagctgccaacccgtctgtgggtcgctccaccgaccaaaatggatgcggcacagctgacggaagaaggctactacagcgtattcggtaagagtggcgcgcgtatcgagatccccggctgttcactgtgcatgggtaaccaggcacgcgtcgccgatggcgcaacggtggtatcgacctcaacccgtaacttcccgaaccgtctgggaacaggagcaaacgtctacctggcgtctgccgagctggctgcggtctcatcgctgttaggtaagctacccacgccggacgagtatcagcagtttatggcgcaggtggataaaacagccagtgatacctatcgctatctcaactttgaccagttgagccagtacactgacaaagcagatggcgtgattttccagactgccgtctgatagctgacatttattgatccatcgaagagggacgccctggcgttcctcttttttttatgtctcaaaagacgattatcaggaatcaggatgtgtgcgctaagcaggtgcacagcaatcaaaatagcggtataacagcgcgagttactgacaaagagataagatcatggagtatgaatttctacgggacgttacgggtaaggtaaaagtccggatgtcgatggggcatgaagcactgggccactggttcaatgaagaagttgagcatgacgccagcgtgcttgatgaggtggaagcagaagccctgaagcttaaaggcagccagcgccagtggcagcgtaccgggcgtgaatatacgctctggatggacgacgaagaggtcatcgtccgtgcgaatacgttgaattttgaaggtgatgaaatggaagagggcatgaattactacgacgaggaaagcctgtgcttctgcggtatggaagatttcctggcggtcattgccgcctggcgacggtttatgcaaaacacatgatcgctgagtccatcttattacccgcactcctcctgctatattgattgattatgctcaaataactgcattttattctgcgactcacaccacatcttttcattaaatgatttaatatcatcatcgtgattataattaatcagtctggtgatgatatggatattaaagcaaccattgaaaaaatccccggcggtatgatggttgtgcccctggtcctgggggcggtggttaacacgctggccccagaagccttacaggtggggggttttaccagtgccctttttaaagacggtgcgcccgccctgattggcgcatttttgttttgcatgggcgcaggaatctctctcaacgctgcgccaaaagccctgctgacaggtgtcggtgtcacggcaagtaagtttcttgtcgctgtggcgatgggctttgctgtcgataagtgttttggtgctgatgggttatggggactgacctcggtcgctgttattgcggcgatgagcaacagcaatggcggcctttatgccgcgctggcgggtgagtttggtcgcgacaatgaagtcggggcgacgcccgtgatcgcccttaatgacggtccgatattaaccatgattgccctgggcgcggcaggcatggcaaacataccggtgatgtcggtggtggtggtgatcatccctatgctgctgggcatgttgctcggtaatctcgacccgcaaatgcgtgatttcctgtctaagggcggcccgctgttaattcctttctttgcctttgctttaggtgccagtattgattttgccatgttgctcaaaggtggcctggcaggcattttactgggtgggttaaccacgctcgtcggcggtttctttaatattaaggttgatcgtttgttaggtggcagcggcattgccggcgcagcggcgtcgagcacggctggcaatgctgttgccacgcccatcgccatcgcccaggccgatcccgctttggcacatgtggtcgccacagcgacgccgctggtcgccacctctgtcattgttaccgcaattttaacgcccatgctgacctcatgggtggccaagggcaatcagcaacgatcactgtcttccacggagaaaccattatgaaaatgatcgtcatcgccgacgattttactggcgcaaacgacacgggcgtccaactggcaaaaaaaggggcgcgcacggaagtgatgctgacgccacaacagaaaccgtcgcgccggactgacgtactcgtcatcaatacagatagtcgggcgctcagcgctgagcaggcgacgatggccgttacccaggcgctttctgccaggcaggacgagacgcaaaatgacgtgctgatctataaaaaaatcgactcaacttttcgggggaatccgggggcagagattgcagcggtcatggcggcaagtggtgctacgctggcgatagttgccgctgcgataccttcggcaggccggacaacgcgcaatggcgaatgtctggtgcaccagcgtccgttgctggagacggagtttgccagcgatccgcgcacgccgattatctcatcgcgcattcgtacgcttatcagcttacagacctgcctgccggtgaatgaaatatcgctggatgaggtacgaagcggcaacctgaacgttctgcttgaaggtgtggcccggcaggaatacagcatagtggtcatggatgccgaaagtgataacgatctgaatctgattgcccaggcggccttagcgctgaaaaaacgtcccctgttagtgggggcggcgggactggcaaatgcgcttccggcggaaagttacatgaatatgcatcaaagcttgccggtgctggtggtggcggggtcgatgagtgaaatgacccgacgtcaggtggagcaggcacagcgtcagggacgtgttgaggttgtcaggattgatgtaaaaacgcttctggcacctgaagacgagagtcatgacattgtgacgcaggcctgccagatactgatgcagaacaggcattgtgttttgcagaccagcagtaacgttgacgatcgcaaccagatagacgcgctgaccgcgcaatacgatatgagccgggaagtgttaggtgaaacgctgagccgacgtatcggcgaaatcaccttagctatccttgaccgtgcccgcacaggcggccttttcctcaccggcggcgatatcgctattgccgtggctaacgccctgggtgcagaaggttatcgtattcagagcgaggttgccccctgtattccttgcggcacctttgttaacagtgacattgatgatttgccggtcattaccaaggcgggcggatttggcaccgacaacaccctttgcgaagcactccactatattgaggagttgtatcgcagacagtgagtatcaacctgcacctcggcgactttacagtcgatgtgcaggctaaaatcggttttagagagcagaaggtagggcttatttgtattaacgtcagggtgacagacaatattaaatgccttccacaatgctgtgttttattaaaaataacggtttataaaaatatgtctggtgtgctgatgcgccactgtcaggttgtaacaaaaaattgattaataatgcgcctcctttaagccaaattaaattcgacgattcccggcaagacctgatccgaaaagattttcattatcgtttcgattttatctttttgattgtatggtttttttattttgtttgcctgcttatttatttactgccctacagcccggatagataagttttcttgtgatttttactgttgttgaaaattaaatttgtaacgcagtggcaatttccgaaacagcgttaataatcaactgaacattaatgcgcgtctgttagcgtcactctgcctccggttgagtgggcaggcttttcattaaatttatacgtctgctttattaatgtgttttgccattagtctcagttaattaatggaatttaattgtttttttccactcgcggagaaattatgctcagcaatacatctatcagaacacgactctatattgcgtttggcaccattacgctcgtcatgattgttgtttgcagcctgttttatgccggttttggtcgggtgacgcaggccagtcagctcaatattcatacttatcaagtcgttgagggattgagcaaaacgaccgaaaatctgcttaatatggaaaccggtgtgcgcggattttcgctcagtgggaaaacaccgatgctggcaccgtttaatgaagggaaacaggccttcagacaatatatcgagagtattcatcaactggttcaggataatcctgaacagcagaagcgcttagcggatttggaaagcagacaacgaaactggctggagacgtatgcgcaaaaggtgattgatgcgcgtgaacgccttaaccagggcagcatgagtcagcagagctttttcgacatctttgccagcggtgaaggaaaaatccaaatggatgcgatgcgcgcggtgattgcgtcaatgattgtcaccgaaaaatccctgctgcaatcacgtgaagatgaattgatgaatgagcgcacaaagacaagaatgaccttgattggcgggttaattctttcggcgggcatttcattgattctgggcttgcttatttcacgcagcatttcccgccctctgacgctggcggtgaatacagccgatacgattgcccgaggtgacctgacctccgttatcaccgttgatcgcaacgatgaaaccggcaagctgctggcggcgctggcaaatatgcaaaatcacctgcgtacgctggtttcccagatcaaagactccgccgcgtcggttgagcttgcggccagcgaaatcgcccagggaaataccgagctgtcttcccgcaccgaagagcaggcggcggcattacaacagacggcagcaagtatggagcaaatcaccgccaccgttcgtaataacacctctgtggctgaatccacggcctcttcggctcgtgagacagaatcgctgacccgcgccagtgagaaagcggtcaatgaaatgagtcagacaatgcacagcatttcggtcagcgccgcgaaagtcaaagagattaccgcggtgattcagagcattgcgtttcagaccaatattctggcgctgaatgcggccgttgaagcagcaagggcaggcgagcatggtcgcggttttgccgtcgtggctaccgaagtgcgcacgctggcacaacgcagcgcgtcatcctcacgtgaaatcggtaacctgattgaagaagcggtcaatggtgtagagaaaggcgttaaggctgcggataataccgcacacagtattctgaaagccgcaagtgaggtcgcgtcgctggcgcaatatatggatggcctggcgctggcatcggtagagcagatgcaaggcgtttcccaggtcagcgtagcggtcacccagatggacagcgtcacgcaaagtaacgctgcgctggtcgagcagtcggcttctgcctcacagtcgttaacagaacaagccagaagcctgcgcgtgttaacggcggcctttcaggtctgattcccgcttgccagacatcgtagcggatgtctggcaagttggcggcaatggccagatagtttaacgggtcagaaagcgttccagttcctggcctttattgttttgttgatcaagttgcgcggcataaaagtcgcagttgtgtttcttttgacgtgaaagcgccgccatttttctgatctccccgatcccttttcctttcagtccacaggccaaccgttccagggcacgggcattttcaaactgatcgaacgcgcgaggatagatgagttggggcacgccatttttgagtaactgcgcggtcgtcccaatgccgccatgatgaatggcaaataagcacgtttctgccagcgcaatattcaactgaggcacggtcataacgtcatcttttaccgataacgcttttgccgttggcgtaacaagaacgcacttcagtccctcatcctttaaatcctgcaatatcggggcaaccgattttttctccgccagcgcccaactggtaaaaaagaccaccgtgcgcgagtcgataaaagcagtaatgcgatcgtcatccgaggatgcgcgacttttgttaagcagaaagcccgcataaaatccgtcgcgcgcctttttttgatagaaccaggattcatataacacgattgtatgctgttcgctgcttacccaatcggcataaatattacgacaagcgggcaggttattgtcgcggcgtaatttgtctattgtgtcctgaagcgtgggtgaaaccagcgctcgttgaaataaggccagcttccagttcaaatttaccttaaagcttttttccagcgagttgatgagtcgtccgggctgcaattttaaatttgaattggtcaggctgattgcgtatttctttatctgatatttatcgcttacggctttcgccgcaaagcaccataaagaatgaatgatgatgcagtcatcgtcgacaagggcgctcatggcatcgaacatggcttcctgctgttccgccatatagtacgaaatccgttttagagaatgctttttttcccataaggatcgatcctgtactgcgttcacgtaggtttctttatcgccgacggcaacaaaggaaagtccgcgagacaccgcttctgacctgaaatagtcgttagcgagcaggtaaacatcgtgatgtttctctttcaggagcgaacccacttcaatacagggaaaaacatcacctgccgagcccagagcgccaataatcactttcatttcagacaccaatttgactaaaaatggtattaaaggcggcggcggttcgctcccggctgacctttccttccaggtctaaaaagtgtcccgcatctctgatttgataaaagcgtgttttatctgattccccgcatatctcttcaatgtttttctgtggagtatgaatatccagatcgccattgatgaagtgaaactgacatgccgaattatcgataatgcgcttgtagtcatgattgcgaatgttagagatttgctccaggtggaaacgcccctgccggtactcaatctcatccagcgtggtcaggtgcctgaagttgcagaatttcattttattcggcaaatacgcacccacttcctcattcatcaaatgggcaagatcgacaaactttttctctttcgagtacaggtttgcctgcttaacgtaggtgcgcatacgatcgttaaattcgaaagagtaagacgcaataatggcgtgttccaggccctcttcgccgttatgtaacagcttcagcgtggatgcgcccccccatgaggcggaagcgataatgttcggcttatagattgaaataatttcccggatgatggccacttcatcatccagcgtgacgatattacagtcctgctcgttgaaaggcttcgatttgccggaaaacggtaaatcgaaggtaatcacatcggatttgtctgccaggaaccgtttccagttgcgaaatgaagaagacgttgccagcgcaccattgatcaggatggtcctgttacgcgtaggaacgctgcattttgttaactccacataaacgttaagttcatttatgtttagaacggaacattcgtgactcatatcactctcctcaccaacaagtacctgcaaatcgtaaaattttctaatgtatagcacagggtgttgtgatcattaagtgatttttatgttttatttgagtttttaaaagtctgttttttatattattgatagttaaggttttttatcataatttttgtaatcctactgatgtttcttagttttaataacaaattaagcttatgttttacgcgtccttactgtgacgaagttcaaggaatttcaggcggggctgggatcgaagcacatgcgtaaggcttcagtttaacgattggcatgatagtttttaaggttaaataaattaatgtttcctggcggagataacgatgagatttggtgtttagtcctgtctgtttgtattaattcattcgttatcgctggaaaaggtaagcgatgccggagagtggcagggttcaccgcgataaaacagaggaaaagataagacaggttctgcgaacaggaagcggtacacaccgcagcagatagcccgatgaaagcagtgaaatgacgaaaaatccgtcacaacagcgctatcctggttttcggcgagaaataagtcgtgtttgagtcgaatggcaggaggcgttacggtcaggcaagaagggagaaaatggcccccgatcacgggggcgttgcagcggtatgttgattagtacgtttttaatcccactgacggaatatttctgccgtaataaatctcgcgcatttctttccacagcaggtcggtaatacgcttgtgttcctgaggcgtaagatcttcaggacgggtattgaaaagatagtgttttaaatcgaactcttttaataacatcttggtgtgaaagatattttcctggtaaacgttaacatcaaccatgtcgtacatgcccttcatgtcctcagacataaagttctgaatagaattaatctcatggtcgataaaatgtttcacgccgttcacgtcacgtgtaaaaccccgtacgcgataatccacagtgacgatatctgactccaactggtgaatcagataattgagtgccttaaggggggaaatcacgccgcaggtcgacacttcaatgtcagcacggaaggtgcaaaggccgccttcagggtggctctctgggtaggtatggacacaaatatggcttttatccagatgcgcgaccacagaatttggcagcggccccggatgctcagaggtatcaatatctttgggatcgatgggctcttcactcacgagaatggttacgctggcaccctgtggctcataatcctgacgcgcgatattgagaacattcgcgccaatgatcgaacaggtttcggtcagaatttctgtcaggcgattggcattgtattgctcgtcaatgtaagcaatataaccatcacgttcagcttcagtatttgcatagcaaatatcgtagatacaaaaactcaggcttttggtcaggttattgaagccatgtagttttagcttttgcaattttactcacccccttataaatgcccagtcagcgcgggtcttccagtgcattcaacagatattgtggcagggcaaagctgccagtgtggattgccggtgtatagtaacggcagttcaggccagaggcctcaaaacgcgcttgcagtatggcaggatcgggctggcgtaacgccggattgtcgcttgcccaggcaaaggtcatgatgccgccgtagtaagtcgggatagcggcctgataaaagctgacgtcctgaaaatagtgactgagtttgcgatggctgttaaccgcctcatcctgctgcaggaagcacacgccgttttgggcaacgaaaataccgttttcattcagggcgtttttacagcccgcataaaattcagaggtaaacagactttcgccaggaccaataggatcggtgcagtcagagataataacgtcgaacttttcagtcgtgtgattaacgaaattaacaccgtcatcaatcaccagattcagccgcgggtcgtcataagccccggcactgtggttgggcaaatactggcggcaaaaggtgaccacgccagcatcaatctcgaccatggtgattttttggatagcagagtggcgggacacttcgcgcagcatggcaccgtcgccgccgccaatgatcagcacgcttttcgccgaaccgtgagccagcaacggcacgtgcgtcatcatttcgtgatagataaactcatcacgttcagtggtttgcaccacgccatccagcgccatgacgcgacccattgccgcgttttcaaagatgattaaatcctggtgggccgttttatcacgataaagctgcttatcgacggtaaaatactggccaaagccggtatgaagtgtttcataccacatctcattttgggccatgatggggctctcctttcgtgacatcaccctgaaaatcggcgggacatcatagctaactatgatagtcgttgcacgggcaaatgtctggcgggagagcgggctggcgcgctactttacataggcaagcaggctgagagagtctcgggccaacgacttacattttttgtcgttagcaatagcgataccgcttaaatcacgatagctggcttcgccgagtgccttcatgttgtagttgttgtaattgcttaaatcccagcggttctgctgggcaaaaaacaccaacgccttacgaatctgcgcatcgggcaaatcctggtagccacaatcattttttaaataaacgaatacggcagtgagatcggcaagatcttctgcttcggattcgctcagggcaaagctggtggaggagaagccgaagagtcccgccagcagcaggatcttgatgcttttcttcatagttattctcatctgataggagtcttagagacgttagcacagttatgtaaagattttcgatcaatttacgtttttcggggcattctgtgtggcagggcttgaccttgccataagggcagggtttaggcttgaggtcatttcgttacaaggatgctgattatgcaacgtcgccactttttgaaactcagcgcggcactgggcgctgcgggtgcgctaccgctctggagccgctcgctcatggcagccagccgaccgccgcttcccatccccgcgttgctggaggcggatgccaaaggccagtacagcgtgacggcgatggagggcaccacgcaatggcaggggaaagcggtgcccacctggggctacaacggcagcctgctggggccggctattcgcctgaaaagggggacgacggccaccattaacatccataaccggctcagggaagcgacgacgctgcactggcacggcctggaaatccccggcgaggtcgacggcggcccacaaggcattattgcgccgggcgcgatgcgtcaggttacgttcaccccggatcagccagcggcaacctgctggtatcatccccatctgcatggcaaaaccggtcatcaggttgcacaagggctggcggggttaatcgtgctggacgatcaggcgtcaggcacgctccgtctgcccagccagtggggcacggacgatgtgccgcttatttttcaggacaagcagctgacgccgtcgggcgagcgtatcgattaccaactggatgtcatgcgcgcggcggtaggctggtttggcgacatgatgctcaccaatggcgtgcagtatccccagcatgccgtcccgcgtggctggctccgtctgaggctgcttaacggctgtaatgcccgttctctgcatattgctgccagcgacaagcgccctttgtatgttatcgccagcgacggcggactgctgtctgagccggtcaaactagactcgctcccgctgctgccgggtgaacgctttgagatcatgatcgatacctcagacggcaacgcctttgatatcgttacgctgcccgtcacgcaaatgggcatgacgctggcacctttcgatcaccccttaccattggtgaatatcttgccgctgcggatcatggccagcgcaaccttacctgaccagttagcgacgctgccggccgtgccgaaaacagaaaacctgacaacgcgctggctgcagctcagtatggatccgcagttggatcaacaggggatgcaggcgctgatggcgcgctatggtgagaaagccatggggaaaggggcggaccatgatatggcgatgggcaacgatgcgagtgggatgaaacatgatggcgatgcgcagacgatggatcaccagaatatggaccagggtgagaaggctgcggcgacctatgattttcacaacggaaataaaatcaacggcctgccgtttgatatgacccggccagcctttgacgtgaagcagggcaccctcgaaaaatggaccatttccggcgaaggcgacagcatgctgcatcctttccatattcacggtacacagttccgcattctttcagaaaacggtaaaccgcccgccgctcatagtcagggttggaaagacatggtgaatgtcgacggctggcgcagcgaagtgctggtccgtttcaaccaccttgccgccgccgatcatgcgtatatggcccattgtcatttgctggagcatgaagataccggaatgatgctgggttttaccgtgacctgatctcaggcacgttcaagggccagccggatatcctctaccaggtcgccggcgttttcgatgccgatagataatcgtatcgtcgcgtcggtgatgccaatccgctgacgcactgcatcaggcacgccagaatgggtggtggtgccgggatggctggcaagcgattcggtgccgcccaggctgacggcctgtttaaacagtgaaagcgcattgagaaagcgaaacgccgcgggctgtccgccaacaatgtcaaaagagaacgttgatccggcgccgctgcactgttcacgatacgttctgcctgcagggctttctgcatccaggtagggtaaccagtgcagcgctgcgactttgggatgagggcgcaaaaaggcggcgacggcttcggcattgtgaaacgctttctccatgcgcaacgacagcgtttccagcgaacggccaatcatccagcttgagtgcgggtccaactgtgtgccaatcgcgctacgcagggcacgaatttgcgtcatcagtgttttgttacccatcaccgcgccagcgatgagatcggagtgcccgcccacgtatttggtcagagaataaagcgagaggtctgcacccagcgtcaaaggctgctgaaaaatcgggcccagcagcgtgttatcacaggcgaccaccggacgtgaaccctgttgccgcgcaatgtcgtcggcgatgcgtgccatcagggcaatattgaccaggctgttagtcgggttagccggtgtttccaccagaatcagcgcaacgcgtcccagcgccatcgcgctatgtgccgcatcgcgcactttggcctcatcgtgcccgtcactaaagccaaccgcgttgatgttcagattatgcagtgtcttactcagcagcgtttccgtaccaccatacagcggctgagaatgcaaaatgacgtcacccggccttgcaaaggttaacagcgttgtcgaaatggctgccataccggaggcgaacaaggcacagctttctgcctgttcatagattgccagtctgtcttcaacgatctcactgttaggatgattaaagcgggaatagaccagtccgccgcttttgccttctggcggctgacggcggcctgaaacgtaatcgaaaaagtcgcggccttcttctgcgctgtcaaaaacaaaggttgaggtaagaaacaccggcggcttaaccgccccttcagacaggcgaggatcgtagccataattcagcatctgcgtttcaggatgcagttgacgatcgccaacgtgcgttttcttacttgagggtaaggccatggagatctcccaataaggtcgctaaccgcataacgatatgttgttaaaatcgtatcatgcagtaattaatgctgctaaatgccgtattgttctaaggtaatgctgatgatgcaacagcctgaacgcaggtgaagaattttaccgcacgtaaacgtttgctatttccgtgcggcgtcagtactcagttctactatgataaactgcgtggctttgtgagctaccaggcagaaggcaatgaaacatactgttgacgtaatgatccctgaagaggcaatcgccgcgcgcattgctgaactgggcaaagagattaccgcccattaccgcgacagcggcagtgatatggtgctggtggggctacttcgtggctcgttcatgtttatggctgatttatgccgcgtcattgacgtgccacacgaagtcgattttatgaccgcatccagttacggcagcggtatgtccacgacccgggatgttaaaatcctcaaagatctggatgaagatattcggggtaaagacgtattaattgtcgaagacatcatcgactccggtaacacgctttccaaagtgcgcgagatcctgcgtctgcgtgagccaaaatcactggcgatttgtaccctgctggacaagcctgaacgccgtgaagtcgacgtcaaggttgaatacgtgggcttttccattcctgacgagtttgtcgtgggctttggcattgactatgcgcagcattatcgccatctgccttacattggcaaagtggtgccgctcgaagactgaatgccgtttaccgcacattcttccaaggcccgcgcccttcatttcgtgtaggcttgtcgcgcacagcggttactggcgctaaaaatcgcccttaaccaacagattggccatgccgtgacgatagcgttgctcaaggttttcccggctgcttgccgtaacatcaaggttacgcaggcagccatcctggataccgtaaacccagccatgcagcgaaactttgcgtccgcgcttccaggcggattgcagaatagtggaatgccccagattataaacctgctcaacgacgttgatttcgcagagtttatccaggcgtttatccggcgggagttctcccagcaacacgctatgcttgtaccagagatcgcgaatgtgcagcagccagttatcaataagaccgagctctggattatccattgcggcctgcacaccgccgcaaccatagtggccgcacacgatgatgtgttcaacttccagcacttcaacggcgtattgcacgacagaaaggcagttgaggtcggtatgaaccaccaggttggcaacgttgcgatgaacaaacagttcgccgggttcaaggccggtgagacgttcggcgggtacgcggctgtctgaacagccaatccaaaggaaacgcggtttttgcgcctgagccagtcgctcaaaaaagccgggatcttctttgaccagtaatgtggaccattcgcggttattactgatcagggtatcaatatctgtcatggcgttaagcaacctgttactgcgcatttgcgtgcgcgtactataggcgaaggcttcctaaattcaaacggcattacaatgccacaaaacagggtatgtattcagaatgacctatgcactggaactttcccggctgaccaagacctatcccggcggcgtacaggcgctcaagggcatcgatctcaacgtcgaagccggtgatttttatgcactactgggacctaacggcgcgggtaaatcaaccactatcggcattatcagttcgctggtgaataagtctgagggaagcgtacgcgtcttcggctacgatctggaaaaagacgtggtcaatgccaaacgccagttgggccttgtcccacaggagtttaacttcaacccgtttgagacggtcatgcagatcgtggtgaatcaggccggttactatggcgttgagcgccgtgaagcgcttcagcgtgcggaaaagcatctgaaacagctcgacctgtgggaaaaacgcaatgagcgggcgcggatgctgtccggcgggatgaaacgtcgcctgatgatcgcccgtgccctgatgcattcgcctaaattgctgattctggatgaacccactgccggggttgatattgaactgcgccgctcaatgtgggtgtttctaaaagatctcaatgcccagggcaccaccattatcctgaccactcactatcttgaagaggccgaaatgctgtgccgcaacatcggcattattcaaaatggtgagctggtagaaaacacctcaatgaaatctctgctttcaaagctgaaatcagaaacgttcatcctggatctggccccgcgcagtccgttgccgtcgctggaaggtttccagtaccggctggttgatacctccacgctggaagtggaagtgctacgcgaacaggggctgaacagtgtatttagccagctcagcgcccagggcgtacaggtactgagtatgcgcaacaaagcgaatcgtctggaagagctgttcgtcggcctgacgcaaggaaaaacaggagctaaagcatgacacatttgtactgggtggcgttaaagagcatctgggccagggaggtgaaccgtttcgcccgtatctggattcagacgttggtgccgcccgtcatcaccatgacgctttattttattatctttggtaaccttatcggtgcgcgcatcggcgatatgaatgggttcagctacatgcagtttattgtgcctggattgatcatgatgtcggtgatcaccaacgcctatgccaacgtggcttcctcgttctttagcgccaaatttcagcgcaatatcgaagagctgctggtggcaccggtgccgacgcacatcattattgcgggctacgtcggtggcggtgtggcacgcggggtttgtgttggtgtgctggtcacggccgtctcgctgtttttcgtgccgttccatgtgcactcctggatgatggttgccatcacgctgctgctcactgccgtgctgttttcgctggcgggcctgatcaatgcggtgtttgcccgcacctttgacgacatcagcctgattccgacctttgtgttgacaccattaacctacctgggcggcgtattctattcgctgacgttgttaccgccggtgtggcaggcgatttcaaagctgaacccggtggtgtacatgataagcggcttccgctttggctttctcggtatccacgatgtgccactggccctgaccttatcggttctgattgcctttatcgtggtgttctatatcgcggtgtacttcctgatccagcgcggacgtggattgcgcacctgatgcagtaacgggcaaaaaaaagcagcgatatcgctgctttttttatgccaactgatctaagccaactgacctatgccagctgtaccggcagcgcttttgcgaggcgcttcatctgattatccccttcaaagtaggccacgttgggctgccactggcgggcttgtgcatcatcgacctgcacataggagcaaataatcaggatatcgccttcgcaggcacagcgagccgctgcaccgtttaccgaaatgattttcgagccacgttcggccgcgatggcataggtggagaaacgctgaccgttggtaacgttataaatatcaatggcttcatattgcaggatgccagaagcatcaaggaaatcctgatcgatggcgcaggagccttcatagttcaggtccgcctgcgtcactttcacgcgatgcaatttgccttgtaaaaccgtgcgaatcatagtcagaaaccttgttaaacagccaaaaatacgacctgcaacccgcagcctttactgcgtgaggtcgacctgttgattatcgatcagccgtgcgttccccagccaggccgccattaaaaccacagcacgctggctgtccaccgtcagaggctgtagcgtttctgcatcacagattgccagaccgtccgggcgaaagcctttttcctgcagcgacagattcgcggcatcaataatatcgtcaatatgccgctcgccattagccagtcgggctgccatctcattcatcacctggctcagcgcgggggccagcttgcgttcatcatcagtgagataaccattgcgtgaactgagtgccagaccgtctttggcgcgcaccgtgggcacaccaataatctcaatgtcgaaacccatatccgccaccattttacgaatgatggctaactgctgaaaatctttctcgccgaagcaggcaatatcgggctgaaccagattgaataatttactgacgatggtcgcgacgccgcgaaaatggccgggacgactcgcgccttccagcagcgatgacaacaccgggacgtccacaaacgtctgattggccaatccctgaggataaacctccgcaggtgagggggcaaacaccacatcgaccgcatggcggttcagcttttcgcaatcctcctgaagcgtgcgcggatagcgggccaaatcgtcagggcgatcaaactgcatggggttgacgaatatggacacgatcacgatatcacctcgttcacgtgcctcgtcgaccagcgtcaaatgtccttcgtgcagattgcccatagtcggcaccaacgcgatgcgtttaccttgctcgcgccagcgacgaacgtcgcggcgtaacatgggcagagtttcgatgatcagcacggcaattctcctgaattactggaaactgtgttccacggcggggtagcgtcctgcttcaacttcggcaatatattggcgaatggccgcccgaatatcgcccgtctccgccaggaaatttttagcaaatttgggaacatgtccgccagtgatgcccagggcgtcatgcatgaccagtatctgaccgtcagtgacattgcctgcgccgataccaataaccggaatcgccagtgcctgggtcacgcgctgtgccagcgcaacagggacgcactccagcacaagcagctgtgcacccgccgcctccagggccagggcatcagccagaagctgctctgcgcccgcttcatcgcggccctgcactttatagccaccaaaaatattcacggactgcggcgttaatcccaggtgcccgcaaaccggaacggcgcgctccgtcagcattcgtacgctgtccgccagccatgcgccgccttccagtttcaccatattggcaccggcgcgcatcaactgcgccgcattatcaaaggtttgctgaggcgtggcataactcataaagggcaggtcagccagcaaaagcgactgaggcgcgccacggcgcactgcagcggtatggtaggcaatgtcatttaccataacgggcaacgttgagtcatggccttgcacggtcattccaagtgaatcgcccaccagcaggacctgaatgccttcatcggcaaacagtcgggcaaaactaaactcgtaggcggtcagggtggcgaattttttgccgctttctttccactgacgcaggtgagaaatggtggtgggtttcatggtgctctcaactcagaaattcagattggcgcattttactggatagtgttgcagagcggaatccatgaagtgtgattaggtgcttagctgtgccatggtcggatgctggaacggtccagctgggccaggattggtttgagcgaccgaccgtctggcaggctcagatcgggggcaatctccagcaacggaaccagcataaatgcgcgattaagcaaatcataatgcggcacggtgagacggtcgctgttgaggctggctgtaccaaacaacatgatatcaatatccagcgtgcgtggtccccagcgctcggccttgcgaacgcgaccgtgttcctgctcaatgcgctgcgtctggtccagcagcgcctcggcagacaacgcggtatcgagagcgacggccgcattgagataatcgggctggtccggtgggccgtagggcggcgtccggtaaaaagcggaggtcgccacgcgctgtgtatcagggagtgcatccagcgctgacagcgctgcatcaatctgatgcagcggatcggcaaggttactgcctagtgccagaaacacacgtgtcatgacgcgctattgttatcacgacgcggagccgttgaacggcgacgtgggcgacgcgtgcggctgcgtggtgccggatcgtctcccagcgtattcagcatggtcttctgctgtggcggcgcggccacctggaactcgccccaccacttactcagacgcagcagttccgggttgttttctacctcagcccgcaaagagagcaggtcgtaagcggcgcggaacttcggatgctccatcagcttccaggctcgcttaccatggcgacgagacatgcgtaactgcagctgccagatatcacgaattaacgatgtgatgcgtttagggatcgccagcgcacggcaggcttcatccagcgtatcgttcattgccagggcaaaggcatcgtaataggtcaggccactttcctgcgcaatgcgttcggcggcttcaagctggggataccagaacatcgcggcaaacagaaacgccggattaacccgcatatcattctgaatacggttatcggtgttcttcagcacctgcgccagcatgcgttccatgtggctgtcgccgttctcggtaaagttacgcgccagcgtcgggaacagcggctgaaataactggtattcacacagtttaagccaggtactgtagccatagccggcctgcagcagctttagcgactcttcaaacaggcgcgcggcgggcacgtcacgtagcaacgacgccaggcggggaatcggctcggccgtttcaggcgcaatgcgcatattcagtttggcagcgaaacgcgcgacacgcagcatccgcaccggatcttcgcgataacgggtttccgggtcgccaatcaggcgaatgatgccttgttgcagatcgttcagcccaccaacatagtcacgcaccgaaaaatcagccacgctgtaatagaggctgttgatggtcagatcgcgacgctgggcatcatcttcgatgttgccaaaaatgttgtcgcgcagcagcataccgctctgggcacgctgagagttgttctgatcgtcggtggtctcttcaatctgatgatgaccgcggaacgttgccacttcgatgacttccgggccaaacatcacgtgcgccagacggaaacgacgaccaaccagacggcagttgcggaacagtttacgcatctgctccggcgtggcgtttgtggtcacgtcgaagtctttcggcttctgccccagcagcaaatcgcgtacgccaccgccaacaagataggcttcataaccggctttattcaggcgatatagcaccttgagggcattttcgctgatgtctttacgtgagatggtgtggctttcacgaggaatgatggtcatatgactctcaggttcaacctctgctggtgcttcctcgtcatcacgcttcaggactttccggcaaaaattagctactcgggtaaaaatgggacacctcgacagtgacaattagggtgtaggtaaaatcagcggctaatcatagcctgttgtgaatcatttgagaatgctgttgtctatgcatccgttatcagggcgttatcatgaggtatcaaagcgatattccactgcttcacagcctcagacagcagtttctcctgcgttttgtccttccaaccttcgccaaccggctgccccagaaagcgtaaagcctgtaccaggcagggacgtgtatccccatcaggcagcgcgggcgcatgattttgtttagaaagtttgtgaccatcagcggtgatcgccaggggcaaatgcagatagtccggcggcatccagccgaattgctgataaagcgcaatctgccgtaccgttggctcaattaaatcagccccacgcacaatttctgtgatgccctgatgatgatcgtccacgaccaccgccagattgtaagcaaacagcccatcacgacgatgaataataaaatcttcttcagccagtcgcctgtcggcgacgacctcgcccctgagccgatcctgaaaacgatagacaggtgcatgctggcgcaggcgcagggctgccttatcggggccatgttgccggtcccgacagtgaccatcgtaaaagccgccagtttgctgaatgcggcttcgcgaacaggtgcagaaataactttgacgctgcgttctcaaccactgaagtgcgtcacgataggcgtcatgccgctgcgactgccacatcacctcaccatcccagttcaggccgtaatgctccagctgttgcagaatccgcgttgcggcacccgcgacttcacgaggcggatcgatatcttcaatacgcaccagccagcgaccatgctgtgcgcgagcgctgaggtaactgcctaacgcagcaatcagggagccgaaatggagttcaccggaaggggatggcgcaaagcgcccaacgcaggatgagaatgacataggcattatgaaccagacggcggaaaaagatggccttttcccgccgtgtggctgcagtcagacggcaacattagcccgccatttgcttctcacgaatttctgccagtgtcttacagtcgatgcacagatcggcagtaggacgcgcttcaagacggcggataccgatctcgacgccacaggaatcgcaatagccgaagtcgtcgtcttcgactttcttcagcgttttttcgatcttcttaattaacttacgctcgcggtcgcggttacgcagttccaggctgaactcttcttcctgagcggcacggtcaaccgggtccgggaagtttgcagcttcatcctgcatgtgtgtaacggtgcgatcgacttcgtcccgcaattgattgcgccaggcttccagaatcttgcgaaaatggtccagttgcgcgtcattcatatactcttcgcctggcttctcctgataaggctccaccccagcgatggcgagaatactcagggacgatgttttacggttttgcccttcttgcatgttgtttctctcctggataacacgcactataccctttgattgccatcggtaagcgcatacacgctaaccttaatgatgaacctctcttgggtacatcgatcccccaacggggaaaaaacaggccgctataaataacagaagcagtcaaggttggcaattattcctgatcgcatcttgacaagcctgtgaggaacagcgtagttagcccctgacagaagatagtcatatcacagaacgatgccaatgatattacaatgttacgtcaatggcggtcgtcagaaacattcctgctgatgacagttctgcccggtaagccaaaatctccacgccactcagctgcgcctgtaccagttgttctgcgtaagcagcatcaatgtgacgcgccggggaaacgtcctcaatccccgagtgcagaacggcaaacaacaaaacggcccgatgaccttctgcggcagccttactcagctcacgcaggtgtttctgccctcgaatcgtcaccgcatccggaaaatagcctttaccttcctgtaaaagcgttacggatttcacctcaatatagcactcaggtcgctcctctgctttgagcaggaaatcaattcggcttttttcactaccgtatttaacttccgcctgacatttcgcgtagccggtcagcggtaaaagtcggttttcgtccagcgcttcacgcaccagttgattggcgcgcagcgtattgacacagatccagtggccttgctgcgtctcggtcatttcccaactgtgcgggtatttgcgcgtcaggctgtcagacgtggagtaccacacggtatcgcccggcgtggcacagccggtcattgcgccggtattcgcgcaatgtatcgtcagcgtttcgccttcgggcgtcacaacatcggccagaaaacgcttgtagcgagtaataagacgcgcgggtttaagagcgggagaaaaaagcataaggctcctgattaagagagtaacggccaactggccagcgtgcggtagcgtgtccggccttgcgcgtactctgaggcaaaaagggaaaattgcctgaccgtaaattgccagtgaaagccacgtggcggcagggcgacaggctgggtcgccgcacgcaacaggctgacgtggggatgaaagggctgagccggttgttcgcagccatgtcgcgcggcctgagcgcgcagcaggcttgccagctgtaacaagccacgcggggggcgctggcaacccagccacacgacgccggggcgcggccaatgacctgcatcgtctaacgcaacgtcaaatgctggctggtttatgcgtgacgccagggcctgcaactgctgtgatgttccagccgacacatcgcccagaaaagccagcgtcaggtgaaggttcgctgccgcaatcgggcgtcccgcctccgcatgaaaggtttgtgcccgccagtgcaccagttgctgctgcagcgtgtcaggcggggtaatagcaaaaaataagcgttgtaacgccatggcggtctccggcaatcctcacggatgagtgctacaatgcgcgccatcttaacatagccattcgcggagtttgcggtgagtgatttacccgtcagcgcggtgttgcctgaccttctgagtgcgcttaatgatgcctcaaacatcctgctggccgcgcccacgggcgcaggtaaatccacctggctgccacttcagcttttacagcacaaggccttgccgggacgcattattatgctggagccgcgccgtttagccgcgcgcaacgtggcgcaacgcctggccgagcagttgggtgaacaaccgggcgtgacggtgggctaccgtatgcgcggcgaaaactgcacagggccaatgacccggcttgaagtggtgaccgaaggcattctgacccgaatgctgcaacaggatgcgatgctggagggcgtgtcgctggttatcctggatgaatttcatgagcggagcctgcaggccgatctggcgctggcgctgctactggatgtgcaacaggggttacgtgaagatctaaaaatcctgctgatgtcggcgacgcttgataatgcgcggctggcggcactgttgccggacgctcctttgattacctctgaagggcgcagctatccggttgaacggcgctatacggcgctgagccagacctcgcgttttgacgatgcggtcgcgcgtgaagtcgcacagttactgcgcgacgaaacgggctcgctgctcctgttcctgcccggcatcgccgaaattgagcgggtaaaacgggaactggagacgcgcgttgacgatgacgtggatttaacgccgctgtatggtgcacttcctcttgctgcccagcaacgggctatcctgcctgccgccagcggacgccgcaaagtggtgctggcgaccaacattgccgaaaccagcttaaccattgaaggcatccggctggtcgtggacagcgccctggagcgaaaagcccagtttgacgctcgcagcggcgttacgcgcttgcagactcagcgcatcagtcaggcgtccatgacccagcgagccggacgagccggacgtgtcatgcccggtatttgtctgcatctgacaccacaggaacaggcctcacgcgcgcccgcgcaaagcgaagcagaaattttgcacagcgatctcgcgtcgttgtggctggagttgctgcagtggggctgtacccgtatcgaacaattgcagtggatagatttgccgccggaaaagcacctgcgtgcggcgcagcagcagctgttgcggcttggggctctggacgagcagggccacctcaatgcccagggacgacgtatggcgcagctgggcagcgacgcccggctcagcgctattttatgtgcagcaggcagtgaccctgacgccgttgccagcgcggccttgctggtggcggttctggaagatccgcctcgcagtgccggagccgatctgcgtgatgcgctttatcgtccattgccacaatggcagcgccgcgcacagcactggcaaaaacgcatcggcgtaaagggcggtcgggtagacgaataccattttgccgccctgctgaccgccggcttcagcgaccgtctggcacgtcgccgcgataacagcggccgctatcagttagctaacggcctgggcgcgatgctggacgaacagcaggcgctgacgcgttatgaatggttaattgcccccaccttgttacagggcagtagcgcgcccgacgcgcgtatcctgatggcgattcccgttgatatcgaggcactgacgcagcgctgtccgcagctgattgaacagcgcaccgaggtggaatgggatgaggagaagggcacgttacgcacgttgcgccgcgagcagattggcgaactgatactgaaaacccagccgctagcccgtcccgacgcaaaagtcttgcaggcggcaatgctacgctggattggcaagaaagggctatcggtgttgggctggacgccggaggcagaacagttgcgtctgcgcatccagtgtgcggcccagtggttgccagaggaacactggcctgaggttgacgacgccagcctgatcgagacgcttgaacactggcttctgccccagatgaccacggtgcgtgatctgaaaagtttacaggcggtgaatctggtcagcgcgctcttacatttgctcacatggtcacaacgtcagcggctggatactgcgctgccaactcattacactgtgcccaccggaagtcggctgcctgttcgctatgatgcagataaaccgcctgcactggcggtgcgcatccaggaaatgttcggcgaagccagcaacccaagcgtggcagaagggcgcattccactggtactggagctgttatcgcccgcccagcggcccttgcagattacccgtgacctcgccgctttctggcgtggtgcctataaggacgtgcaaaaagagatgaaagggcgttatcccaaacatccctggcctgacgatccggcttccgccttgccgacaagacggacaaaaaagaagacgtcacagggtggaacctctgattaattcagagggttctgccatgcgacagtgaagaaagcagttagagtagcggcgcagccgtaagctatgcctggagaataaaacgaatgtctgggaacgatcgcgaacctattgggcgcaaaggaaaagcgctgcctccgcgcagcagcgcccgccgtgggcggcgcagagacatcgatgacgatgttgctcaggacgattttgatgatgactacgaggaggaagcgccggtgccacgtaaaggtaaaggtggaaaaccgccgcgcggcaaacgccgttggctgggatggttaattaagctgttcctggtatttgtggtggtaatggccgcgtggggcgtatacctcgactcggaaattcgcagccgcattgacggtaaagtgtggcaactgcccgcaaccgtatatggtcgtatggtcagccttgaacccggcatggcctacaacaaaagcgaaatggttgccctgcttgaaggcacgcaataccgtgaagtttcacgtattacgcgcccgggtgagttctcggttaagggcaacactatcgaactgttgcgccgtccatttgatttcccggacagcaaagaggggcagattcatgcccgtatgacctttagcaaagatgaactcagagagattaaaaacgttgaaaccgggcgtgattttggtttcttccgtcttgatccgcgtctgatcaccatgctgcagtcgcctaatggtgaacagcgcctgttcgtgccccgtgcgggcttcccggatctgctggtcgatacgttaatcgccaccgaggatcgccatttttacgagcatgatggtatcagcccgtactccattggccgtgcctttgtcgcgaatatcacggcaggtaaggcggttcagggtggcagtacgctgactcagcagctggtaaaaaacctgttcctgaccaacgagcgttcgctgtggcgtaaagcgcgtgaagcctatatggccgtgatcatggacgcgcgttacagcaaagatcgcattctggagctttaccttaacgaagtgtatctcggtcaggcaggtaacgatcagattcgtggtttccctttggccagcctttactactttggccgtccggtggatgagctgagtctggatcagcaggcaatgctggtcggcatggtaaaaggcgcttcgctctataacccatggcgtaacccgaaactggcactggaaagacgcaatctggtgctgcgcttgttgcagcagcagaaagtcatcgaccaggaactgtatgacatgctgtcggcgcgtccgttaggcgtgcagccgaaaggcggtgtgattacgccacagcctgcgtttatgcagatggtgcgtaatgagcttcaggcaaaactgggtgacaaggttaaagatctgtcgggggtgaaaattttcaccaccttagatccggtctcgcaggatgccgctgaaaaagcggttatcgacggcattccaaccctgaaaaaacagcgcggtctgaaagatctggaaaccgcgatggtggtcgttgaccgtttcagcggtgaagtccgcgcgatggtcggcggggccgatccgcagttcgccgggtataaccgtgcgttacaggcccgccgttctattggttcactggcaaaaccggccacctatctcaccgcactgagccagccaaatacatatcgactcaatagctggattgccgatgagcctattgcgctgaaacagcccaatggcagcatctggaaacccatgaatgacgaccgccgcttcagtggcaaagtcatgctggtggatgcgttgaccaactccatgaacgtgccgacggtgaatcttggcatgacgctggggctgaatgcggtggtggatacctggaccaaactgggtgtacctaaagatcagctcaacccggtgccggcaatgttgctgggcgcactcaacctgacgccgattgaagtggcccaggcgtttcagtcgattgccagcggagggaatcgtgcggacctgtcagcggtgcgttccgtgattgccgaagacggaacggtgctgtaccagagcttcccgcaggcgcaacgggtagagcctgcgcaggctgcctatttaacgttgtacacgatgcagcaggttgccgatcacggtacggcacgcgccctgggcgctcgcttccctaatgcgcatctggcaggcaaaacagggaccactaacgacctgatagacagctggttcgccggtgtcgatggtaaagaggtggcgatcacctgggttgggcgtgataacaaccagccgaccaagctgtacggtgccagcggtgcgatgcagatctaccgtcgctatcttgataaccaggcaccgatgccgttgcaactgacgccgccggaagacgtgacgatgatgaatatcgactcagcgggcaactttgtttgtggttcaggcagcagtacctggcgctcattgccggtttgggcactggacccgaatgcactgtgtcagcaacagcagcaacaggttcagcaaatgcagcagcaacaacagcaacaacagcaattgcaacagcagcaacagcaggagcagaaagacagcgatggcgttgcaggttggataaaagacatgttcggcaagtaacgggtcaaaagcagtgaaaagaaggcacttcggtgccgtttttttatgactgataaatacgctgtaaacaggctacaaacagcgccacagtagggaattctgcttgcagagattgttgcacttcgcatattatcgaaccgttataataatcattatcgtttcgattcgcttaatcatccccatttgagagacaccttcatgactgcgcgcaccaccacttttggtttcacatcagggtcgtttacccctcgtcctttggcactgatgattgcgctgatatccagtggcgcaactcccctggccttcgccgaacaaacggtggtggtttcagcaaacggcggtgccgctgttgcgcaggaaagtccgtggggcccggcaccgaccgtcgccgcgaaacgcagcgccaccggcaccaaaacggatacgccgattgaaaagaacccgcagtcggtttccgtggtcacgcgtgaagaaatggacatgcgcagcgtcagcagcgtcaagcaggcatttaactatacgcctggcgtactgaccggcaaccgcggcagttctgcggtcattgacgcgctgtcgattcgcggttttagcgaaaccaataccaatcagtatctcgatgggctgaagctgcagggtgacaactactctgaattcgctatcgatccctattttctggagcgggctgaactgctgcgcggtccggtttccgtgctgtacggtaaaagcaatcccggcggtgtcgtcgctttagtcagcaagcgtcccactcaggaaacgctgcgcgaagtccagttccagatgggcaaccataatctttactccaccggtttcgactttggcggcgcaatagacgacgcaggcgtgtacagctaccgtctgacaggcctggccagtagccaggatgcccagcaggcgaataacaagcagaagcgttataccatcgcgccttcattcagctggcgaccagatgaaaacacccgtcttgatctgctgacctatttccagaacgagccggataccggctactacggctggctcccgcgtgaagggaccgtggtgccgatcacccggcctgatggcagccagtataaactgccgaccaactttgatgagggcgagaagagcaaccgcatctcacgcaataccaaaatgctgggctacagctttgagcaccgttttgatgagacctggacggtgcggcagaacctgcgttatgccgagttaaccacggattatcgcagtatttacggctttggttataatccggacacgcagctgattacgcgcaattcagcactttccaaagagaagctgaaccagtttgctgtggacaatcaggtacaggctaaatttgccaccggtgaactcgctcataccttattgcttggcgttgatttccagcgtacccgtaatgatattgacgcacagttcggtacggcaacagcgttaaatccgtttaacccgcaatatggcaatgatacgacttcgccctatgctgaaccctacaagcacttaaataaacagcgccagacaggtctttatgcgcaggatcaaatggaatgggatcgctgggtcctgacattaggtggccgctacgactatgccatgacgtcagtttacaaccgctacaacggcaatcttgatcgtcagaatgatcaggccttcacctggcgcggtggactgaattacgtatttgataatggtatcgcaccttacttcagttacagcgaagcgttccttcctaatgctggctcgacttatgaaggtaatgcgttcgatccttcacgtgctaagcagtatgaagcaggtgtgaaatatgtgccgaaagatcgtccaatagttatgacggccgcagtttatgagctgactaagactaaaaatctgacggcagatcccaatccattgcatccttttgccagcatccagagcggcgaaatccgttctcgcggtgttgaactcgaagcgaaagcggcgctgaacgccaatgtaaacctgacggcttcttatacctataccgatgccgaatatacgaaagatactcagcttcagggcaaaaccccggttgaggtgcccaaacatatggcgtcactgtggagcgactataccttccacgaaaccgcgctgtcaggcgtcacggtcggcgcgggcgtccgttacgtgggcgaaagtcaggggctgtatagcaacggtcctgatgccaaccagaactttagcgtagcgggttacaccaccgtcgatgctgcactgaaatatgatttaggacgttttggtttgcctggatcaacggttggcgttaacgttaataacctgtttaaccgcgactacgttgccagttgttaccgtgaatatgcgtgctactggggcgcagaacggcagattgtaggcaccgccacgttccggttctgatcgatgagggcgcttcggcgcccgtttacagggattaccatgcagcttccgcagcaccaacagacgaccttccaactggataatgccagctttcgtgtacccggtcgcacgcttctccagccgctgtctctctcttttacaccaggcaaagtaaccgcgctgattggtcacaatggttcgggaaaatccacgctgttaaaaatgctggggcggcatcacgcggccagcgaaggccgggtgctcctgaatgaacggcccgtggagagcctgaacagcaaagtatttgcccgtgaggtcgcctatttacctcagcaactgccggctgcagaaggcatgacggtgcgcgagctggtggccattgggcgctatccctggcatggggcgctggggcgtttcactcaggaggaccgcgaccgcgttgagcaggcgatttcgcgcgtggggttaacgccttttgcctcacggctggtagacagcttatcgggcggcgaacggcaacgtgcctggctggcgatgatggtggcgcaaaacagccgctgtctgctgctggatgaacccacttccgccctggatatcgcccatcaggttgatgtgctggccctgattcagacgctgagccgggagcatggcttaaccgttattacggtattacacgatatcaatatggctgcccgttactgtgaccatctggtggcattacgcggtggcgcgcttatcgctgaaggcgggccggaccacattatgcaggcggacgttttgcaggcgatttacggtattccaatggggatcttcccccatcccggcggcggtgcgccggtgagttttgtgtgttaaggacccgataatgcccgatttgttccgccgtcgcctgatgatggcgatggcgttatcgccactgatgagccccttttcactccaggcggcgcagcccgatcccgatcgcatcatcgcgctggagtggttacccaccgagctgctgctggcgttaggcgttaagccctttggggtcgccgatgtgcataattataatatctgggttgggcagccagccttgcctgccggcgtggtggatgttgggctgcgtaccgagcctaaccttgaactgatgacccagatgcatccctcactgattctctgttcaaacggttatggaccgcctaaagaaaaactccagcatattgcgcccattatggggtttgacctgcacggcggcgacggtaaaccgctctcccgggcgcgtgtctctctgcaggccctcggcgccaggctggggcgggaagcccaggcggcggcgcacctgcaacgcatggacgaggaaatcgccgcggcgcgccagcgtctggcaccgcatgccggacgtgccatcctgctgatgtcactgcttgacggtcgccatgccatcaccttcggtaaaaacagcttattccttgaggtcatggcgttgcttggtctgcagaacgcctggcagggcgaaaccaatttctggggaagttcagtgattggcctggagcggctggcggcgtttcacgacgtggaagccatctgcttcgatcatgacaatgcggccgttatgcagcagctgtcacgcagcccgctgtggcaggcaatgccttttgtccacagcggccattttcaacgcgtaccggcggtctggtattacggggcaacactctctgccttgcactttgtacgcgtgctggaacatgcgctggagaaagtctgatgcgctatcgttttttctcagtcaccgtgctgggcgtactgtttttactggcgctggcgctcaccgcaataaactttcagcaggcgttgcccctggggcaatggacacaggccctgtgggcacctgataccacgaatgtgcaacagatggtgtttcactacagtttgctgccgcgctgggcgctggcgctgttggtgggggccggtctgggattagcgggactgctgtttcagcaggttctgcgtaaccctctggcggaaccgggaacattaggcgtttcatccggcgcacaactgggaattaccgtcgccacgttgtggcacctgccgggcggagtcgttacccagcagcttgccgcctcgggtggtgcgttgctggtgggggcgctggtatttagcgtggcctggagcaaacgcctgtcacccgtaaccttgatcctggccgggctggtcctcagtctttacagcggtgctgttaaccagatcttcgccatcttcaatcacgaccaactgcaaaatatgtttctgtggagcacaggcgcattgaaccagatgagctgggacagtgttacccagctctggccgcgactgatgctggcgctgttactgtcactggcgctgctgaggccgctgacgctcatggggctggacgatggcgtggcaaaaaacctcgggctggccctgtccgctacccggttagcgattctggtgctggcgatattgcttagcgcacagttggtgagcgtcgccggtatcattggttttatcggcttgttcgcgccgctgctggcaaggctgctcggtggacgccgcttgctgagccgcatgctactggccccgctgattggcgcattgctgctgtggctggctgatgcctgcgtcctgtggcttacgacgcactggcgcgaggtttcaaccggcacggtgacggcgctactgggcgtgccgattctgctgtggctgttgccgcgtctgcgaaccggttccgttccacccgcactggatcagggcgacaaggttccggtcgaacgccatcactttctgcgctggagcctgatcggcttagcgctgttaggcatgctggcatggctgtgtctggcgtttggacgggatgcgcaaggctggagctggaccagcggtgacctgctacagcagctgctgccctggcgcgcaccgcgtgtgctggcggccctggaggtaggcttaatgcttggcgttgccggcagcctgatccagcgactcacgggtaacccgatggccagccctgaagtcttgggcatcagttccggcgcggcctgcggcgcagtcgtaatgttgttcttcgtgcccggcaatgcgctggcattcctgttacccgcgggtgcgctgggcgcggcggtgacgctggcgattattatgttggtggccagtcgcggcggtttttcccctgaacgcatgctgctggccgggatggcgttaaacagtgcctttgtcaccatcctgatgttgttgatggccagtggcgatccccggatgtcggggttactgacctggatctccggctccacctataacgtcagtgccacccaggcgctgcaaagtgctgtctgtgcggtggtgctggtgtcattagcgccgctggccagtcgttggctcacgctgttgccgcttggcagcgcgacggcgcgctcggccggaatggcgctcaccgcctcgcgtctggcgctgctgctgctggctgcggccttaacagcctgcgccacgctgacgattgggcctctgagctttgtgggactgatggcaccgcacatggcgcgcatgctgggcttccggcgggcgctaccgcagctgttactgtctgggttactcggggcaggtttaatggtggttgctgactggtgcgggcgaatggtggcttttccaaaccagattccggcaggattgatggcaacctttttaggcgcgccctattttatctggttgctgcggcgttcacgttaaaaaaagaccggcgttagccggtctgtcaccttacagcttagcgaagcagcgacgcgcggcatcgatggtgtgctgaatatcctctgcactgtgcgccagcgacataaagccggcctcaaaggcggagggcgcaaagtaaacgccttcttcgagcatcaaatggaagaagcgcttaaagcgttcaacatcgcactgcgtcacgtctttatagcaggtgacgctcgcggcatcggtgaagaacaggccaaacatgccgccaacctgattcacgacgacaggaatattttcctgttttgccgcctcaaccagtccctgtgctaactgtgacgtcaggctgttcagcttgtcatgcatgcccggctgggcaatctgggttaagcaggcataaccggcagccatggcgacagggttaccggacagcgtccctgcctgataaaccgggccggtcggtgccagtgcattcatcacctcccgacggccaccaaaggcaccgacaggcatgccaccaccgatgattttgccgaggcaggtgagatccggtttcacattgtaatgtgcctgcgcgccacccagcgcaacgcggaaacctgtcattacttcatcgataatcagcagcgcgccaaactcatcacagagcgcgcgcaggcccggtaaaaacgtgggttggggcggaatacagttcatattcccggcaacgggttcgacgataatggcagcgatagcctgcggatactgttcaaacgccgcgcgaaccgaatcgagatcgttgtatgtgcaggtcagcgtatgctttgcaaaatcggcaggcacgccaggggaattaggttgccccagcgtcaaggcaccggaaccggctttcaccagcaggtgatcggcatgaccgtggtagcaaccttcaaatttaatgattttgtcgcgcccggtaaaaccccgcgccagacgaatcgcgctcatggtggcttcggtaccggagttcaccatccgcaccatttccatgctgggaaccagcttacacaccagctgcgccatggtgacttccatctcagttggcgcaccaaagctcaggccgcgctgggctgcttcaatcacggcattacggatgccatcgttattatgtcccagcaccatggggccccatgaaccgacataatcgatgtattttttaccatcggcgtcataaagatatgcaccgtcagcatgttcaatgaacagcggaacgccgcccacaccggtaaacgcacgtaccggcgagttcacaccgccgggaatcaggcgttgtgcttcagcgaacagttcttcagacttactcattttcggctccagcagttcataaaatatcgggctattctacggaagaggggcggcagacgaaaggccgctataattaaccaggtgaatccggcacagagtgcgaagctgagagcttgattgcgtcgggtcgctggcagataatagcaacattgaggtcgttttctgacccgggcgtttacggagtaacacatgagtgatgaagtagtagcactgccgttgcagtttaccgacgcagcagccaacaaagttaagaatctgattgctgacgaagataacccggcgctgaagctgcgtgtgtatatcactggtggtggttgcagcggctttcagtatggttttaccttcgacgatcaaatgaatgacggcgatatgaccattgagaagcagggcgtttcgctggtggttgatcccatgagcctgcaatatctggtgggcggttctgtggattacactgaagggctggaaggatcgcgctttatcgtgaccaatcccaatgccaaaaccacctgcggctgcgggtcgtcatttagcatctgatagcatctgattagcgagccgccatcacccggcggcctcgtttaccattcaatggtcaccagccgatcgctggttcccctactcccctggcgttttagcaccgtttgcgtcacgcgcggctgtgcgctgatttgacgaccacactcaacctgcggcacagattgacccactgaagtgttaatttcacaacgtgaatagatgacgagtctgacgttaatagagccggtcgtcgatcccgcgaatgcctgttgcgcgatcacaagccctatggccagaagcagggctttggtcatatttaaatacctggtgtagtaaaaagcgctgagcgctaaaaaggacatcgggcttacgtggcacgtgtctcatatctaaaattaacggcagtaagggtgatttctttaatttatagcgttacgcacgccagtctgcagcattatttaactggatgcagggctttacaaagctgatctgcggctaacaggatgcgcggccccgggcggctgatccagtcgtcgttaagggcaatgactctgacgctaagttgtggcagccagaattgcgcagtctgactcgcctgttgggcatcgccggtggtaatgatgacctgaggatggcgcatcagcacctgttcacgactcacctgaggccaactgactgcactgtcagcaaagatattctgcccgccgcacagcctgatgacgtcgttctgcagtgtcgccttagccgcggtaaacatgggtgaaaagccaaactgcagaaagaccgggacagggcgctgttggctatagcgctgtcgcagtgcggcttcctgctttcgcagttgcccggcggcttgcgcggcgcgttgcgggtccggactccacgttgctaatcccgccagcgcatcaatcatgtcatccagcgttgaagcatcgacccattccacgttaataccgaactgccgcagctgatccacctgacgctgcgggttaccgccacgccacgcgagtaccacatcgggtttaagctgcaaaatacgttcgagattaatgccctgccagttagcaacctgttcaatttttttcgcctcagggggataactggaccatgcgctgaccgcaatcggggtaatcccggcggcaaaggccagttcagtcaggtgcggggcaagggtgatgacgcgggacggggcagcaaacaggctgctgctcaacagcagcagccagcaaaacagcaggtgtttagccacgagccaggcgggccagcaaattttcaaccatcaatgatgactgtctggcggcgacgcttagaaactcgtcaaagctcaggtgggattcctgatcggcaacgtcggaaatcgccctgacgaccacaaaaggtacctggaactgatggcagacatggccgatggcggtcgcttccatttcaaccgcaatggcctgcgggaaggtcgcacggatgcgtgccaggggttctgaaccattgataaaggcatcgccgctgaccaccaggccgcgtacggcgttcaggtttagctgctttatgcaggcttccgcctcggcaatcaggttactatcagccgtaaaggcagcaggacaacctgccatctggcctggttcatagccaaacgccgtaacgtcagcatcgtgatagcgcacttcttcagacaccacgatgtcgcccacggttaatgtaggggctaaaccgcccgcggagccggtgttaataaccagatcgggtttacataattgcagcagcagcgttgtgccgagagcggctgaggttttaccgatgcctgatttcagcaacgcaacctcgacaccattgagtgtgcctgtgtaaatttcacaacccgccagagacagggtctggcggttttcaattttgtcacgcagcagggtaacttcctgctccattgcgccaatgatgcctgctttcattttgcgtctcgctaatgtaatgaatgtaaaaatcgggcatagtctatcatggcaatgacgggattatttcacgaaaaaatacggggacatgtatggcagcgatcaatttcaggacgaagatcagcttcactcgcccttatagcaaccgtaaagatccgcaaggcgaatattttattacccgccattttgaaagcgatcgcggacgcatcattaattcggcggctattcgccgactgcaacaaaaaacgcaggtattcccgttggagcgtaacgccgcagtacgttcccgcctgacgcattcgcttgaagtgcagcaaaccggtcgatatatcagtaaagagattctgcaaacgctaaaaacccagggcggactggcaaaatatggactggaagacatggaaggggcgtttgaaagcctggtcgaaatggcgtgcctgctacatgatgtgggtaatccaccgtttggccatttcggcgaagccgccattaacgactggtttgaagataatctggctgccgagctggtcgatccgctggtagctggggtagaaactgatgagcagcgccatgcgtttgaccagatgaacgccatgattcgtcaggatttatgccattttgaaggcaatgctcaggccattcgcatggtgcacacgctgctggagcttaacctgagctattcccaggttgcctgtattctaaaatatactgcgccggcatggtggcagggcgagaaaccggctgaatttagcgtcttaatgaaaaaaccgggtttctatctatctgaacgggaatatatccgcgacctccgtgcggccaccaatttgacggagcatcatcgtttccccctgacctatatcatggaagcggctgatgacatttcatattgtattgccgatttggatgatgccgtcgaaaaagccattttcaatgtagacagtttgtatgaatatctcagcaaagcctgggggacgataaataataatgatgcgttcagccgcaccgtaggcgaagcctggcgcgaggcgggaagtaaaaaacgccgcagccgtagcgatcaattcttcatgtcactccgggttaatgttcagaatgttctggtcacctatgccgttaagcgttttattgataacctgcccgctatttttgatggaaaattcaaccatgcgttattagaagatgagggtgaagagggccgtttactacaaatatttaaaaccgttgcgcgtcagcaggtgtttaatcactctgaggttgaacagttggaactccagggttaccgggttattaaaggcttgctggaaatatatcagccgctgatgatattaaattatgaagctttcaccacgctgataaacgaagactttttacgcaatcacccgattgaaacgcgcctgtttcataagctttctggaaaacacaggaaagcctatttgcataaaatgcgcacgctggttgttgaacataaatatgagcgtttattatgggagcggtattatcggtttcgcttaattcaggactacatcagtggcatgaccgatctctatgcctgggatgagtaccgtcgtttgatggcggtggaataagccgagaattgtaaagagcgcgaataaatttttacctttgcctaaaacttttagaggaacttcgcgctaaaacatttatctcaacattcgaccacagcaatggtcagtatatccatcattgtgagataccaaaatgaaaaaaacctccttaatgttaagcgccctggcgcttagtcttggcatggcactgacccctgtgagtgctttcgctgcagaaacgtcatcttccgtttcatcctccacgacccagccgttgccaagccttgccccgatgctggagaaggtgatgccttcggttgtaagcatcagcgttgagggaagcaccacggtcaaaacgccgcggatgccacagcagttccagcaattttttggcgataattcgcctttctgccaggacggttcgccgttcatgggctcgcccctgtgtcagggcgcgggtggcagcggcggcggtgcgcctgccggtcctgatacgcagcagcaaaaatttaaagcgttgggttcaggcgtcattattaacgcagaaaaaggctatgtggtgaccaataaccatgtggtcaatgatgcgacgaaaatccaggtcaaactgagcgacggccgtagctacgatgctaaggtgatcggcaaggaccccagctccgatatcgccctgattcaactggaaggcgcgaagaatctgaccgcgatcaaaatggctgactccgacaatttacgcgttggcgattataccgtggcgatcggtaacccctatggcctgggcgaaaccgtgacatcgggcattgtctcggcgttaggacgtagtggtctgaacgttgaaaactatgaaaactttattcagaccgatgccgcgattaaccgcggtaactcgggtggtgccctggtcaatctcaacggagagctgatcggtattaataccgctattctggctccggacgggggcaacattggtatcggttttgccatcccaagcaacatggtgaaaaatctgaccgcccagatggtggaatatggtcaggtgaaacgcggcgagctggggatcatggggaccgagcttaattctgaactggctaaagcgatgaaagtcgatgcgcaacgcggcgcgttcgtcagccaggtggtgccaaattcagccgcagcaaaaggcggcattaaagccggagacgtgatcgtttccatgaacggcaagccattgaccagctttgcctcactgcgtgctgaagtgggatcgttaccggtgggcactacgctgaagctgggcctgctgcgtgacggtaaaccactggatgtctctgtgcagttgcagcagagcacacaggacaaagtgcagtccgcgacgatttacacgggcattgaaggtgcggatctgagcaacaacgcaggcaaagagaaaggagttcgggtcgatagcgtaaaagcaggcagtgctgcggcacgagtgggtctcaaaaaaggcgacctgattcttggcgtcaaccagcagccggtaaccaacttaggggaactgcgtaagattctggataccaaaccaccggtactggcgctgaacgtgcaacgcggcgatacctcgctttatctgctgatgcagtaatcacagtcttgtgttgagcaggcggacttcggtccgccttttttatgccaaaaatcacaaatgtgatgcctgccgcatttctgttaacgccgccgcggctatgggcgaatgcataatgttctgcgcgtgacgcaccgctatcctgttctccctcttatatgactcaggagtaaaggatggctacctgtcatctcgacgcacggctggcgcaggaaattgtcgcgcgcaccatgaaaatcattgatggtaatgtcaacgtcatggacgcacgtggacgaatcattggcagcggcgacagggagcgcattggcgagttgcatgagggcgcgctgttggtgttgtctcagggacgcattgtggatattgatgatgccgtggcaaggcatctgcacggcgtgcggccgggcattaatcttccgctgcgcattgacggggcgatcgttggcgtaattggtctgacaggcgagcctggtgcactccgtcactatggtgagctggtctgtatggcggcagagatgatgctggagcaggcacggctgttacatatgctggctcaggacagccgcctgcgtgaagagctggtgcttaacctgattcgcagtgatgagctgacgccgcaactgacggaatgggctcagcgcctggggatcgatcttaatcagccccgcgttgtggcggttatcgaagtcgacagcgggcagttaggcgtggacagcgccatgtctgagttacaacagctgcaaacgttactgacaacgcctgtcagggataatctgatagccattgtgtcgttgaccgaaatggtggtactgaagcccgccctaaacgcacacggacgttacgaccagtacgatcaccggcggcgggttgaacagctcatgcagcgtatgaacgaaagcggtcatctgcgaatgcgtattgcactgggcaacttctttaccggcccgggcagcattgcccgctcttatcgcaccgcgcacacgaccatggtggtgggaaagcagcgtatgccagacgtacgcagctacttttatcaggacctgatgctcccggtcttgctggacagtttgcgcggtggctggcaggcaaacgaactggcgcgtccgctggaaaaactgaaaagtatggacagcaatggcttactgcggcgcactttgagcgcctggttcagcaataacgtgcagcccggtgccacgtcgcgggcgctgtttatccaccgtaataccctggagtaccgcctcaatcgcattgctgaattgacgggactgaatattggccattttgacgaccggttactgctgtatattgcattacagttggatgagcagggctgaggctgttcaccgtaaccgggaggaaccccagatgcgtacactgtttttaacactttgcctgctgatattcacgttcacctgccaggcacggcctgacaacctggtttttctgtctgctgacgcgttagtgaaaacccgacaggcactccagaagcatcaggcagatgcactgaccgaacaggcctggcgtcagttgcaacgtcaggcggataaggcgctcagtcagcctgaccccagcgtcatggacaaaggtctgataccacccagcggctcgcggcatgactatctcagcctgagcgcctactggtggccggacgcccggcagaaaacgggtttaccctggatacgtcgggatggtgaggtgaatcctgataccaaaaacgaccaaaccgacggcgtgcgcctggcgcgatttagcgcagacgtgcaggcactggcgttggcatggttcttttcaggggatgcgcgctacgccagcaaggcacaatccatgatccgccactggtttatcgatcctgcccgtcgtatgaacccaaacctgaactacgcgcagggcattccgggtcgaaccgcgggtcgtcatgatggcgttctggacgggcgctattttgcaacccgcatggttgatgcgctgatattgctgcgtcagtcgcccggctggcggaatagcgacgaggcggcgttgcatcgctggttcagcgactatctcagctggttgcagaccagcaagctggcgcaacaggagcggaatgcgcccaataaccacggtagttggtacagtgttcaggttgccggcattgccgcttatctggacaaccgtgcggtgattgcagacatgactgccctggccaaaagcaagattgacgggcaaatagagcgtgagggaactcaaccgcttgaactggcccgaacccgttcttttcattacagcttctttaatttacaggcgctgaccgcaatggcggcgttggcttccctgcggggagagggcgatctctggcattataaaaataaacagggtggctcactgctgactgcgctggactatatggcgccttttagcgatccggcacgtcactggccgtggaaaacgcgcgaacgtaacagcgaacggttaattcccttgctgctggtggcggacaccacactcaagtcagatcgttaccaatcctggatcaatcacgtggcatggcgtgatgcgcctgccgaggtggtacgcgacgtgtggttgctcaggcactaaccgggcagggtgacaataaaaaaggccagccgcgtgaggtgaattccaccgcatacggctggccttatcgttgtctgaaataattaacgaccgttgcgggtcagtttttccagatcggattcaatttccgcgatcttatgagaaaccacaccttcaagatgacgcaggtcatcgaggattttacgtttcagatcgacttcaacctggtcgcgctgacagatttgatccagttcatcaataacataacgcaggttcgggctgatttcctgcacttcacgatagccctgagaggcgttatcggcaacgacggttttacgctgacgaggatatttaaatttcacgcttttggcgaagaattcacctttatctttgcggaaataaattttcaaaatatcgttattcgcttcctgacgcaggctatagcgatcgatatcctcagggttactaatgcctaagctcttaatattgtcatacataacgttttttccaccaaatgaataagcgcgcagaagtgttcatgacttaatgactatagacataaataacatgaatcagtgcgcaacaggatttaactggcgcgaattatgacctggatgaaaagtaaacgcacctgttggttcgcgtagaaaaacaacattacccgtaacagctgtaaacaaaagatgacgggctgtctggtgcagcccgtccgacagtccgacaaattagtcgatagtgcgcagcagttcgttgataccggttttcgccagggttttcgcatcgacctttttcacgatcactgcacagtagaggctgtagctaccatctttagacggcagattacccgagacgacgacagaaccggcaggtacgcgaccatagtggatctctccggtttcgcggtcgtaaatcttggtactctgaccgatgtaaacgcccattgaaatgacggagccttcttcaacgatgacgccttcaacaatttcagaacgtgcaccaataaagcagttatcttcgataatggttgggttggcctgcagcggctcaaggacaccaccgattcctacaccaccggataaatgcacgtttttaccaatctgcgcacaggagccaacggtcgcccaggtatccaccatggtgccttcgtcaacataggcaccgatatttacataggaaggcattaacaccgtgttacgcgcaatataggcacctttgcgtaccgcagcaggcggtacaacgcggaagcccgctgctttaaagcgcgcgtcatcccagtcggcaaacttcatcggtactttgtcataaaaacgggtttcagccccttccatcacctgattgtcattgatgcggaaagagagcagaacggcctttttcagccactgatgcgttacccattcaccctcgattttttcagaaacgcgtagctcaccgctgtccagtttagcgataacctgattaatcgcttcgcgagtttccgtatcgacactggtcggggtgatatcagcgcgacgttcgaaggcagattcaataacactctgtaactgttgcatattttttcctgatctgtcatttgtggtgccagccagtgaccggcacgggtaaaaagttgatgttcacaaattgaagcgggtcacactttatcgtttggattaagggcctctgtcaaccgttgttgcaacgtgtgacgcatttcctcgtccagtgccttgcgttcgctattcgctaaaatgaacaaatcctcgactcgctccccgatggtgctgatacgggcgccatgcagagagacgccaagatcggcaaacacttcgcccacgcgtgccagtaaccccggctgatccagggccaccagctccagataactgcggcgatcggtgtgcgttggcaggaaattcacctcggtatccacgttgaagtgtttcagcctggcggcctggcgacgggtccgcggcggcacccattctgactgggtaatcgcttgctccagcgcctgaatgatcagcgcatgacgatcgggcgacagcgggctgccatccggctccagcacgatgaacgtgtccatcgccatgccatcgcggctggtaaaaatttgcgcatcatgcacgctgagattgcgacgatccagttcgcctgccacggcggcaaacaggtgtggacgatccggactccagataaaaatttcggtgccgccgcgcgtcgcctgcgggctgaccagcaccagagggtgattaagatcgtgcaccagtaaatgacgggcatgccaggcgatctgattgggcgtatggcgcaggaagtagtcggcgcgacaacggttccagatatggtgtaagcgctcttcatcaatgttgtccatgcgcagcagtgccagtgcctgcagacggtgatgacgcacgcgctcgcgcagatccgggctgttctccataccgcggcgtagctgtttttcggtagcaaagaacagttcacgcagcagactttgtttccagctgttccataagctctcattggtggcgcagatgtcagcgaccgtcaggcacaccagataacgcagtcggttttcgttctgcatgacctcggcgaactgctgaatcaccgtggggtcctgaatgtcgcggcgctgagccgtcacggacattaacagatgatggcgcaccagccaggcgacaagttgcgtttcacgcgagttaaggccgtgcatctcggcgaacgccagcgcgtcctcggcaccaagaacagagtgatcgccgttacgtcctttagcgatgtcgtgcagcagcgccgccatgagcagtaattcctgctggggcaggcgcggccacagctcaacgcataaaggatgctgtggacgcgtcgcttcgttggcaaaactctccagcttctgtaacacccggatagtgtgctcatcgacggtataagcgtggaacaggtcaaattgcatctgtccgacgatctggccccagagcggcgtataagcccagagcacactgtggcgatgcatgggcaccagggcgcgactgaccgcaccgggatgacgcaggatcgacataaataagcgccgtgcttcgggcaactggcacagcggctgcttgaggtgacggcgagtatgacgcaggcggcgcagcgtggtggagtagatgcctttgatattttgattgcgcaccatgacgtagaacatgcgcataatcgcctggggctcacggtcaaacagggtttcatcacgcagatcgataaggttgccccgaagctgaaaatcatcatcaatggcacagggtttttcgttagtggagagcgccagaatggcttcatcgaacaactgcaacagcatctggttcagttcgctgatacgacgcgtgacgcgataaaaatccttcatcatgcgctcgaccggttcgttgccttcgccctgataattaaggcgctgagcaacgctcagttggcgatcaaacagcaggcggttatcgtaacgcggcagagacaaatgcaacgcgaaacgaatccgccaaagaaacgactggcactcgttcagttcgctgcgttcggcttctgtcagaaagccaaatcccaccatttcgtcaagtgttgtggcaccaaagtgacgccgtgcaacccactgcaacgtatgaatatcgcgtaatccgccgggactgcttttaatatccggttccaggttgtagctggtgccgtgatagcgcttatggcgttcttgctgttcgtctattttggcggcgaaaaagcgagatgatggccagaagccatcgctgaagacatttttttgcagttcaagaaacagggcgacatcgccggtcagcatccgcgcttcaatcaaattggttgccaccgtcaggtcggataaaccttccagcaggcactcttccaggctgcgtacgctgtggcccacttccagcttgagatcccacatcagcgtcagcagtgcgctggcactctgggcggcttcttcattcagcggctgacgactgagaattaagacgtcaatgtcggagagcggatgaagctcaccccggccatagcctcctacggcgacaagggcgatggatttcatactgtcgaagccaaaaaaacgccataagcgacgtaaaaggcgatcgatatacagggttcgggcatgaaccagactttcgacagcctcaccactgtcaaaggccgctgccaggtgctgctggaagccctcaaggcgctgcttgattatttcacgtgttagctgatcgtcctgccactcgccaggcgaatctttcaggccgttttttacttcttgcgacaggctcatgcaacgctctcatcgttaaccataaaaaaaccggcatagcgccggctttttcatcagtggtggaattaatcctggttaactaacaccgcgggaagggtgtcgtctttgcgcagggttaaaatctcacagccgttatccgtcaccacaatagtatgctcatactgcgccgacaagctgcgatctttggttttcaccgtccagccatctttcatggtacgaatgcgatagtcaccggcattcaccatcggctctacggtaaaggtcatgcccgcctgcaggataaccccgctgtcatcggcatcgtagtgcagcacctgtggctcttcatggaagcctttgccaatgccgtgaccgcaatattcacgcaccaccgagaagtcattcgcttcgacatatttttggatagcgcggcctaactcacgcaggcgaatacccggtttcaccagacgtaaggacaaatagaggctttcctgcgtcacacgacacaggcgctcaccctggatagtgggtttgccgacaataaacattttcgacgtatcgccgtggtactcgtctttaatgacggtcacgtcgatattcacgatgtcgccatcttttaacgggcgatcgtcactgggaataccgtgacaaaccacttcattcacagagatacagacggatttgggaaaaccgtggtaacccaggcaagcggatatggcctgttgctgctgcgtaatgtgttcatggcagagacggtcaagctcaccggtggtcacgccgggctgcacatgcggttcgatcatttcaagcacttcggcggccaggcggcctgcgacgcgcattttttcgatttcttcgggggttttaattgtgattgccattaaattattccgctgctgctgaaattttcagcaataatgaaagctgtgctctcatgttaacagcaagctaaaagggctgccaaacagagaacgcttcgcggccagttagcgaacatttattggcgtccaaagcgtgattgtggtataaagcgcgccgacgattctctgtatggccgttaaggtcagcgggaaacgcaacaatctcactatgtgtaaataaaacacacatgtatcgacacatacgccggggtgccttgaaagaggtcggttgtatgggatacatggaggcccaaccccaattaaactagaggtagtaatcatggcaactgtttccatgcgcgatatgctcaaggctggtgttcacttcggtcaccagacccgttactggtgtccaaaaatgaagccattcatttttggtgcgcgtaacaaagttcacatcatcaaccttgaaaaaacggtaccaatgttcaacgacgctctggctgagttgaccaaaatctcttcccgtaaaggtaagattctgttcgttggtactaagcgcgctgctgccgaagcgatcaaagagtctgcactgagctgcgaccagttcttcgtaaaccaccgctggttgggtggcatgctgaccaactggaaaaccgttcgtcagtctatcaaacgtctgaaagagcttgagactcagtctcaggacggcactttcgacaaactgaccaagaaagaagcgctgatgcgcgctcgtgagctggccaagctggaaaacagcctgggcggtatcaaagacatgggcggtttgccggatgcactgtttgttgtcgatgctgaccacgaacacatcgcaatcaaagaagcaaacaacctgggtatcccagtatttgctatcgttgatactaactccgatccagatggcgttgattacgttatcccaggtaacgacgatgcgatccgtgctatcaacctgtacctgactgccgttgcgaccaccgttcgcgaaggccgctctcaggatctggctgagcaggctgaagaagcgtctttagaaaacgcttaattaaggtttgctctgcataagagcccttagcattcagatgtgatctgtaaggggccaaacttggcccctttattttatccaagtctgttacgcccctgttcaggtcggcgggacagagtaaattttccgcaaataagtaccttctgatgcacttgtgctcaggtacgaaccgaggattctggaatggctgaaattaccgctgcattggtaaaagaactgcgtgagcgtactggcgcaggcatgatggactgcaaaaaagcgctgactgaagcgagcggcgacatcgagctggcgattgaaaacatgcgtaagtctggcgcaattaaagcagcgaaaaaagcgggtaacgttgctgctgatggcgtaatcaaaaccaaaatcgttggtaactacggtgtgattctggaagttaactgccagactgacttcgttgcaaaagacggcggtttccaggcgtttgctgacaaagttcttgacgctgctgcggctgaccgcatcaccgacgttgacgttctgaaagcacagttcgaagaagagcgtgttgccctggtagctaaaatcggcgagaacatcaacattcgtcgcgttgcactgctggaaggtgaagagctgggtagctacctgcacggcgcacgtatcggcgttctggtttctgccaaaggcgctaacgacgatctgatcaaacagatcgccatgcacgttgcggcaagcaaacctgagtttgttaagccagaagacgtttctgcagacgtcgttgataaagaataccaggttcagctggacatcgcgatgcagtctggcaagccaaaagagatcgctgagaagatggttgaaggccgtatgaagaaattcaccggcgaagtctctctgacaggtcaggcattcgttatcgacccaagcaaaaccgttggccaggcgctgaaagagcagggcgctgacgtgattaacttcatccgctttgaagtgggcgaaggcatcgaaaaagttgagactgattttgctgctgaagttgcagcaatgtccaaacagtcttaatgatctgaaagaaccgccagatggcggttcttttttgtctgcctcaggcaaaagatacgttttcagtttcatcccaatagcaattcttttgctctaagcggatgattgatcggaattacttctcattcatcatatcttccaggaagaattgaccatggcgaccaacgcaaaacctgtttatcaacgtatcctgctcaaactcagcggcgaagcactccagggtgcagagggttttggtatcgacgcgagcgtgcttgaccgcatggctcaggaagtcaaagagctggtcgagctgggtatccaggtgggcgttgtgattggcggcggtaacctgttccgtggcgccggtctggcacaggcaggcatgaaccgcgttgtgggcgaccatatggggatgcttgcgacggtaatgaacggcctggcgatgcgtgatgcactgcaccgcgcgtacgtgaacgcccgtctgatgtccgccattcccctgaacggcgtttgtgacaactacagttgggcagaagccatcagcctgttacgtaacaaccgcgttgtcatcttttctgcgggtaccggcaacccgttctttacgacggattccgctgcctgtttgcgtggcattgaaatcgaagcggatgtggtgctgaaagccaccaaagttgacggtgtttactcggccgaccccgtgaagcagcccgatgcaaccctgtacgaaaaactgacttatgcggaagtgctggatcaagagcttaaagtgatggatctcgccgcgtttacgctggcgcgcgatcacaaactgccaatccgcgttttcaacatgaacaagcctggcgcattgcgtcgcgtagtgatgggtgaaaaagaaggtaccctgattacgcattaatacccgaggcgagataaaataaggtatattctgtcagtgcggtattgtttaaccgtgcaccagtcaggattatcgatgattatcgatcccgcttccggtgatgccggaactggccaggtcaaaccgaatccaagggttttaacgtgattaacgacattaaaaaagatgctgacacgcgcatggacaaatgcgtcgaagcattcaaaaccactatcagcaaggtacgcacaggtcgtgcttcaccttcactgctcgacggcattatcgttgaatattacggtacgccgacgccactgcgtcagctggcttccgtcaccgttgaagactcccgtacgctgaaaatcaacgtgtttgatcgctctctcggcccggccgtagaaaaagcgattatggcatccgatcttggacttaacccgaactcagcgggtgcggacattcgtgttccactgcctgcgctgacggaagagcgtcgtaaagatctgattaaaatcgtacgcggtgaagcagagcagggacgtgtatccgtacgtaacgtccgtcgcgacgccaacgataaaatcaaagcgttgctgaaagataaagaaatcagcgaagacgacgaacgtcgtgcgcaggacgaaatccagaaaatgaccgatgtgcacatcaagaaagttgatgctgcattggccgaaaaagaaacggagttgatggacttctgattccatcatcaccgattaaaacgccgtacagagaggccttctgacagaaggccacctctggcggcgttttacattgtgccccacgttttacctttacatggacagcattatgaagcgattaactctgctcggttctaccggttcggtaggcaccagtacgctggcagtggtcagtgccaatcccacgctttaccaggtcacggcgctggtggcgggtaaaaatgtggctctaatggcggagcagtgcgtgcagttccaaccgcgctatgcggcaatggcagatgaagagtccgccgccgcgctacgtgagcgactgagagcattaaagatcaatactgaagtgctctccggcgttcaggcagcctgtgaactggcagcattagatgacgttgaccaggtgatggcggcgattgtgggtgcctcagggttattaccgacattggcagcgattcgcgcgggtaaaaccgtcttgctggctaacaaagaatcactggtgacctgcggccgtttatttatggaggcggtgcgccagcacaatgcccagctgttgccggtagacagcgagcacaatgcgatttttcagagtttgcccgctaccatccagcatcagttaggttacgctgacctgcagaataacggcattgagtcgattattcttacgggatcgggtggcccttttcgtgacacaaatttagcggatctgagcagcatgtcgccagatcaggcctgtgcacatccgaactggtcaatggggcgtaaaatctctgttgattcggccaccatgatgaataaaggtcttgaatacattgaagctcgttggctgtttaatgccagcgcagcgcagatggaagtgattttgcacccacaatcggtgatccactccatggtgcgttactgcgatggcagcgtgctggcacagttaggttcgcctgacatgcgaacacctatcgcccacagtatggcctggccagcgcgaattcacgctggggtcacaccgctggactttacccgcatgtcggcactgacgttctcagaacctgattttggccgttatccctgtctgaaactggcgattgatgcctgcgaagccgggcaggcggcgaccaccacgctcaatgcggccaatgagatagccgtggcggctttcctgaatcagcgaattcgctttacggatattgcggcgttaaacagtgcggtgctgtcagctcagcagtgtcaggaaccggactctgtggacgctgtcatcgaaattgatcgtatcgcgcgggcggcggcgacagaaatgttgccacgttacacggtataacaacgattgcgttgaggctatttgttcgcttcaggtgaaaatgttatagtcgctggctcgcgtttaacggtctgtcaccaaattcggtgtggcctggcagacaatgtcgggatttgtaccgggcgcaatgtattcagaaaccacagcatttctgatgaaaggaattgattacgcgttatgtcgtctgaaaatcacaacaacaccgatgaccaacagggaaccggtccacgccacgtcgctatcatcatggatggcaacggccgctgggctaagaaccagggaaaactgcgtatctccggtcacaaagctggcgtgaaatcagtgcgccgcgccgtaagctttgccgtcagcaataatctggaagcgttaacgctttacgcctttagtagcgaaaactggagccgtccagcgcaggaagtgactgccttgatggaactgtttgtctgggcgctggatagcgaagtgaaaagcctgcacaagcacaatgtccgcttacgcatcattggtgatatcagccgtttcagcccgcgtattcaggaacgtgtccgtcgtgcagaagcactgacggagaataacgatcgactgacgctgaacattgctgctaactacggcgggcgttgggatattatcgaaggcgttaaaaagttggctgagcaggttcaggaaggcttgttacgccctgaccagataaccgaagagagtctgacgtctcaactgtgcatgaaccagttagcgccagtggatttagtgataaggaccgggggagagcatcggattagcaacttcctgttgtggcaaattgcctatgcggaattctattttactgatgtgctttggccggattttgatgaacacgtttttgaaggtgcactgaatgcattctctctgcgggagcgacgctttggcggcgctgcaccaggcggcgcctgagcaatctgggggtaacctttgctgaagtctcgtctgatcaccgcgctgattcttatcccgctggtgatcgctgcattgttctggttaccgcctgttggctttgcaattattacgatcattatctgcatgcttgccgcctgggaatgggggcagctttctggtatggcatctcgtcagcaacgtgtctggctggcactgatatgcggtctggtactgacgctgatgctgttgacccttcctccttacgaacataatgcgcatctgccgcaggtggctgtctggctgtgggcctcgctggcctggtggatcggtgcgttactactggttctgttttatcctgcctctgccgcaatatggcgccgctcccggccattgcgcctgttgtttggcgcgctaacggttatccctttcttctggggcatgatggcgctccgtcaatatcattacgaagccgatcactttgccggtgcatggtggctgctgtttgtcatgtttctcgtatggggcgccgattcgggtgcctatatgtttggcaaattgtttggcaaacacaaactggcgccgaaagtctccccgggcaaaacatgggaaggctttctgggtggactggtttcttccgcgttgattgcggtgctgtttgccagttttgcgccgctttccgttcctaccggcacactggtgatatgtgctgtgatgtcgacccttgcatcggtactgggcgatctcactgaaagcatgtttaaacgcgaggccggcatcaaagacagcggcaacctgattccgggacatggcggtattcttgaccgcatcgacagcctgacagcagcagtgccggtatttgcctgtttattgctgttggtgtttcagacactctaagggcaaacaacgatgttaagcgtaatctggagttttgccgcatttatcgttgcactgggcgtactcatcaccgtgcatgaatttggtcacttttgggtggcgcggcgttgcggtgtgaaagtagagcgcttttcgatcgggtttggcaaagcgttatggcaacgacgcgaccgtcacggtaccgaatttgtcatcgcccttattcctcttggcggttacgtcaaaatgctggatgagcgggttgaaagcgtgcccgctgagcttcggcatcaggcatttaacaataaagccatctggcagcgcgcttcgattattgcggcgggcccgattgccaacttcctgttcgctatctttgcctattgggttgtgtttatccatggcgtgcccggtataaaaccggttattggtgaaattctgaacggttcggtggcggcagaagcgcaaattacacccggtacggaacttaaggccgttgacggtatcgaaacgcctgattgggaagctgtccgcatggcgctcatcggtaaaatcggtgatgccagcaccacgctaacggtgagccagtttggcgagcaggggacgcagcagaagcaggtcgatttgcgcaactggcagttcgagcctgataagcaggacccggtcgtggcgctggggattcgtcctcgtgggccgcagattgaaacgaccctggctgaagtgcaaaagaattcgccagccagtgaagccggtttgcaagctggcgacaggatcgttaaagtcgatggtcagttattaacgcaatggcagctttttgccactcaggttcgggataaccctggaaaaagcatcgctcttgaggtcgatcgtaacggtgaagcggtgcagttaaccctgacgccggaagcgaagcctgggaatacagcgcaaggattcgcaggggtgatcccccgcgttgtgccattgccagacgagtacaaaacggtaagacaatatggtgcgttttcagccattggtgaagccagtgtaaaaacctggcaattaatgaagctgaccgtttccatgttgggcaagttaataaccggtgatgtgaagttgaacaacctgagcggcccgatttcgattgcgcaaggtgcaggtttgtcagctgagtacggaatgatttactacctgatgttcctggcgttgattagcgtcaacttaggaattatcaacctgttcccgctaccggttttagatggtgggcacttgctcttccttgcgatcgaaaagattaaaggtggaccggtgtccgagcgagttcaagactttagttaccgcatcggttcaatactgctggtgatgttaatggggcttgcacttttcaatgatttctcacgtttgtaaccgctggaacgcgagcttgcgtgggatgtgttaggaaaacgcataataacgatggcgatgaaaaagttgctcatagcgtcgctgctgtttagcagcgccaccgtttacggtgcagacgatttcgtggtgaaggacattcatttcgaagggctgcagcgagtcgccgttggcgcggctctgctgagcatgccagttcgggttggcgatacggtgaatgacgatgacgtcagaaataccattcgctccctgttcgcaactggcaactttgaggatgttcaggtcctgcgagatggtaatacgctgattgttcaggtcaaagaacgtcccaccatcgccagcattacctttagcggtaacaaagcggttaaagacgatcagctcaaacaaaaccttgaagcctcaggcgtgcgcgtcggcgaagcgctggaccgcaccaccatctcttctatcgagaagggactggaggacttctactacagcgtgggcaaatataccgccagcgttaaagccgtggtcacgccgctgccgcgtaaccgcgtcgatttgaaactggtgtttaccgaaggtgtttctgcaaagattcagcagatcaacattgtaggtaacaaagcgtttagctcagatgagttgatttctcgcttccagttgcgcgacgacgtgccgtggtggaacgtcgtgggtgaccgtaaataccagaagcagaaactggcgggtgatcttgaaaccctgcgcagcttctatctggatcgcggttatgcccgtttcaacattgattcgacgcaggtcagcctgacgccggacaagaaaggcatctacatcaccgttaacattaacgaaggcgatcagtacaagattgctggcgttatcgtcaacggcagcatggcaggccattcggctgaaatcgaacatctgacaaaaataccggcgggcgagctgtataacggcacgaaagtcacgtcgatggaagatgatatcaagaagctgctgggccgttatggctacgcttatccccgcgttgtgacgcagcctgaaattaacgatgccgataaaaccgttaagctgcatatcaacgtcgatgcgggcaaccgttactacgtgcgtaaagtgcgcttcgaaggtaatgacacatcgaaagatgccgtcttgcgtcgtgaaatgcgtcagatggaaggtgcctggctgggcagcgacctggtcgatcagggcaaagagcgtctgaaccgtacgggttatttcgaaaccgttgatgtcgatacgcagcgtgtaccaggttcacctgaccaggttgacgtggtgtataaagtcaaagagcgtaacaccggtacctttaactttggtgtgggctacggtacggaaagtggcgtcagcttccaggtcggcgtaactcaggataactggctcggtaccggtaataccgtaggtatcagcgggaccaaaaacgactatcagacctatgcagaattctctctgaccgatccttacttcaccgttgacggtgtgagtctgggcggccgggtgttctacaacaactttaaagccagcaacgcggatctctccggctataccaacagaagttatggtacagacgggacattgggcttcccaatcaatgagaacaactcgctgcgcgtcggtctgggctatgtccataacgacctgtcagacatgcgtccgcaggttgcgatgtggcgctatctcgactcggttggtaagccacagcagttgaacagcaatggtgacttctcggctgatgacttcacctttaactatggctggacatacaacacgctggaccgtggtttctttgccacctcaggtaaccgtactaacctgaacggcaaggtcacgattccgggttctgacaaccagttctacaaaatgaccttagacagtcagcagtatgttcccatcaataaagatcatacctgggttgtcttaggccgtggtcgtgttggttatggcgatggactcagcggtaaagagatgccgttctatgagaacttctatgccggtggctccagtaccgtgcgtggcttccagtccaacaccattggtcctaaagcggcttacctgaacgatggctcttcattctgtaacctgagcgatccgaacggtatttgtaagtcgagtgatgccatcggtggtaacgccatggcgattgccagcctcgagctgatcacgccgaccccgttcctgagtgagaaatatgctaactcagttcgtacctcgctgtttgtcgatgcaggtacggtctgggataccaaatggcagaacacggcggaaacgcgtgctgctggcattcctgactacagcgatccgaacaatattcgcgtttcgaccggtgtatctttacagtggatgtcgccgctggggccgttggtattctcttacgcccagccgatcaagaaagttgatggagataagtcagagcagttccagtttaacattggtaaaacctggtaatgctctacacagggatgtgaaaaaattagcttgcaggcgtggcgcattgctatgctccacgctgcaaacatacatgttgagggtaaggagtttatagtgaaaaagttgttatgtgcagttactctgggtgttgcattggctgcttctgctggcgcacaggcggcggacaaagtcgcaactgttgatctgagccaggttttccagaaatcacctcagcgcgcgaccatcaccaaacagctcgagagtgagttccagggccgcgcggcagaactccgttctcagcacgataaaatccagcaggaaatgcaggatctgcagcgtaatgcgccaaccatgaaagccagcgagcgcagcaagaaagagaagcagatcaccgctgagcgtgatgcattccaggtgaaagcggatgcgttcgaaaaagacaaccagacgcgtcaggttcaggaacgtaacaagttactggaaaaaatccagaccgctgttcagtctgttgccaaaagcggcggttatgacctggtgctgaattctcaggctgttctgtattcgggttccgatgttaaagacatcaccgatgatgttgtaaagcaggttaaataatcgatgtcatcaattcgactggctgatttagcccagcagttggatgcagaattgcacggagatggcgatatcgtcatctccggcattgcttctatgcaatccgccacctctggtcaaatcacatttcttgccaacagccgttaccgcgagcagctcgccctgattcaggcatcagccgtggtgctgacggaagcggatctggagtggtgtaaaaccgctgcgctggtggtcaaagacccttatctcacctatgcgcgcatggcgcagttgctggatacgacgccgcagccggcgcagaatattgcacccagcgccgtaatcgattccagcgccagactcggtgaaaatgtctctgtcggtgcgaatgccgttattgagtccgatgttgagctcggtgataacgttgtcatcggcgcaggctgcttcgtcggcaaaaaaacccgtatcggcaagggctcgcgtttatgggctaacgtctcggtttaccatgaggtgcagattggtcaggattgtctgattcagtccggtaccgtcattggttcggatgggtttggttatgctaacgatcgcggcaactgggtgaaaataccgcagttgggctccgtggtgattggcgatcgggtagaaattggtgcctgtaccaccatcgatcgtggcgctctggataacactctgatcggcaatggtgttatcatagacaaccagtgtcagattgctcacaacgtggttattggcgacaatactgcggttgctggcggtgtgatcatggcgggtagtttgaaaattggtcgttattgtatgattggcggtgccagcgtcatcaatggccatatggaaatctgtgacaaagtgaccgtaaccggcatgggcatggttatgcgtccgataacagaacctggtgtatactcctcagggattccattacagcccaacaaaacctggcgcaaaactgcagcgttggtgatgaatatcgatgaaataagcaaacgcttaaaagcaatcgagcggaaagtcggtaaagacgactaaacgccatcccatgactgaccggctttcataataacagtgttaagcagggaagccaggcgccacggaacctatttgcggcctgccaacgatcatgatgatcggtgcaggccgtgttattgatgtcatcagattttttaggacaggaagagtattttgactactgaaactcatactctgcaaattgaagagattttagagctgctgccgcatcgttatccgtttctgctggtagaccgcgtgctggattttgaagcaaacaaatatctgcgcgccgtgaagaacgtctcctttaacgaaccgtttttccagggacatttccctggtaaaccgatttttcccggcgtgctgattctggaagcgatggctcaggccaccggcattctggcattcaaaagcgtaggtaaactggagccaggcgagctttattattttgctggcattgataatgcccgtttcaaacgtccggttgtaccgggcgatcaaatgatcatggaagtgaccttcgagaaaacccgtcgcggtctgactcgctttactggcgtagcgactgtcgatggtaaaatcgtctgtgaagcgaccatgatgtgtgcccgtagccgggaggcataattcgtgattgatccaaccgccaacatccatcccagttcagtgatcgaagacggggcaattattggccctggcgtgcatattggccctttctgttttattggggcaaatgtcgagattggtgagggaaccgtactcaagtcacacgtggtggtgaatggccatacgcgtatcggcaaagacaatcagatctatcagttcgcatcgattggcgaagtgaatcaggatttgaaatacgcgggtgaacctacccgggttgatattggcgaccgtaatcgcatccgtgaaagcgtgacgattcatcgcggtacggcgcagggtattaacaccacgaccattggtagcgataacctgtttatggtgaatgcccatatcgcccatgactgcgtggtgggtaaccgctgtatttttgccaataacgcgaccctgggtgggcatgtcactgtggatgatttcgctatcattggcggcatgacggcggtgcatcagtggtgcactattggttcacatgtcatgatcggcggttgttcaggcgttgttcaggatgtccctccgtatgtgattgcgcaaggcaaccatgccacgccattcggtatcaacatcgaaggcctgaagcgccgtggcttcagcaaagaagcactgcacgctatccgcaacgcctacaagttactttatcgcagcggcagaacgctggatgaagtcaaaccggaaatcgaagcgattgctcagcagcacagcgaagtgcagcctttctttgatttctttgcccgctcaacacgtggattaattcgctaattcatgtcagcgcgtccccttacgatagccctggtcgccggagaaacctctggcgacattcttggcgcaggcctgattcgggctttaaaagcccgtcatcctgatgcccgctttatcggtgtcgctggcccgttgatgcaggccgaaggctgtgaagcctggtacgagatggaagaactggcggtaatgggcattgttgaggtgctggggcggttgcggcgtttattgacgattcgccgcgatttgacccagcgctttatctcgctcaaacctgacgtatttgttgggatagatgcgccggattttaacatcacgctggaaggcaacctcaaacgcgcaggtattcgcaccattcattacgtcagtccctctgtctgggcctggcggcaaaaacgtgtgtttaaaattggtcgcaacaccgatctggtgctggcgtttctgccttttgaaaaagcgttttacgaccgttttgacgtcccctgtcgctttattggacacacgatggccgatgccatgccgctacagcccgataaatcagcggcgcgccgtcatctgggcatagatgaggatgcgctctgccttgcgttgctgccgggcagtcgcggtgccgaagtcgaaatgctcagtgcagacttcctcaaaacggcgcaacggctgcgccaacattatccgtcgctggaaattgttgtgcccttggtcaacgctaagcgccgcgagcagtttgaaaaaatcaaagcggaggttgcgcctgagctgccaatgcatctgctggatggacagggacgggaagcgatggtggccagtgatgctgcactgctggcgtctggcacggccgcgcttgagtgcatgctggcaaaatgtccgatggttgtcggctaccgcatgaagccgttcaccttctggctggctaagcgactggtcaagactgactacgtttcgttgccaaacctgttggccgggcgtgaattggtcaaagagctgttgcaggatgaatgtcagcctgaagcgctgtcagccgcgctggacccgttgctgcacgccagtagcgaacgtgaaacgctgctgcatactttttacgaactgcatcagcagattcgctggaacgccgatgaacaagccgcagatgcggtgctggagctcgccaatggctgattttatctatcctgctgcccggtgcattgccggtgtggatgaagtgggccgcgggccattagtgggcgcggtggtgaccgccgccgtgatcctcgatcccgccaacccgatccccggtctggcggactccaaaaaactgtccgaaaaacgccgcctggcgctgtttgatcagatcaaagagaaagcgctcgcctggagcctggggcgcgcagatccagaagagatcgaccgtcttaatatcctgcatgccaccatgctggcaatgcagcgcgctgtggctggcttgccgctcacgccagactttgtgctgattgacggcaatcgctgcccggcgttaccgatgccttctctggccgtggtaaaaggggatagcctggtcgccgaaatcagtgccgcgtccatcattgccaaagtcacgcgcgatcgcgaaatggcagaactggatttgttgtttccccagtatggtttcgcgcaacataaaggttatcctacggcgttacatagggaaaagttaacgcagtacggtgcgacacctcatcatcggcgcagctttgcgcctgtgcgcaatgcgctgatcgatgccgacgtactggcgagcagcctgaccacgctgcgctaatccgaccttgttttaaccggaaactgatatggccgaacctcgttttatacatctgcgcgttcatagcgactattcaatggtcgacggtctggcgaaaactggaccgttggttaagaaagcggctgcgctgggtatgccagccattgcgattaccgacttcaccaacctttgcggtctggtgaaattttacggtggtgcgcatagcgcaggggttaaaccaattatcggggcagattttaacgttgccagcgagttaatgggcgatgaactgacccagattaccgtgctggcgaccaataacaccggctatcaaaatctgacgctgctgatctctcgtgcttaccaacggggatacggtattgccggccccattatcgatcgcgactggctggctgaactgcaggaaggactgattctgctgtcaggcgggcgacgcggggatgtgggccgtagcctgctgcgcggtaacagtaccctggtgtcggactgcctggctttctaccagcaacattttgccgatcgctattttctggagttgatccgtaccggtcgtcctgacgaagagagctacctgcatgcggcggttgagctggcgattgcagaaggaatcccggttgttgccactaacgaagtctgcttcatcaatgaagaagatttcgatgcccatgagatccgggttgccattcatgatggttacacgctcgacgatcctaagcgtccgcgcaactacagccctcagcaatatatgcgcagtgaagaagagatgtgcgagttgttcgcagacatcccggaagcgctggaaaacagcgtagagattgctaagcgttgtaatgtgacggtacgactgggtgaatacttcctgcctcagttccctaccggcgatatgaccaccgaagactttctggtggtgaaatcacgggaagggctggaagagcgtctggcgatgctgttccctgacgaagccgagcgcgcagagaagcgtccagaatacgacgagcgtcttgaggtcgagcttaacgtcatcaaccagatgggttttccgggctacttcctgatcgtgatggaatttatccagtggtccaaagacaatggcgtgccggtcggtccgggacgtggttcaggtgcgggatcgttggtggcctatgcactcaagatcaccgatcttgatccgctggagtttgacctgctgttcgaacgcttcctgaacccggaacgtgtctccatgcccgacttcgacgtcgatttctgcatggaaaaacgcgaccaggtgattgaacacgttgcagacatgtatggccgcgaagccgtgtcccagatcatcaccttcggaacgatggcggcgaaagcggtgattcgggatgtcggtcgcgtactcggccatccttatggtttcgtcgatcgtatttcaaaactggtgccgcccgatcccggcatgacgctggaaaaagcctttgctgcggaaccgcaactgccggaaatctatgaggcagatgaagaggtcaaagcgctgatcgatatggcgcgcaagctggaaggggtaacgcgcaacgccggtaaacatgcgggcggtgtggttatcgcgccaacgaaaatcaccgattttgcgccgctttattgtgatgaaaacggacagtatccggttacgcagttcgataaaaatgatgtggaatatgccggtctggtgaagttcgacttcctgggactacgcacgctcaccattattgactgggcgctgaagatgattaacccgcgccgtgaaaagcagggtctgccgccgattgatatcgccaccatcccgctggaagacaaaaagagctttgatatgctgcagcgcgcggagaccacggcggtcttccagcttgaatcgcgcggcatgaaagatctgattaagcgcctgaaacctgactgcttcgaagatatgatcgctctggtggcgctgttccgccctggcccgttgcagtcgggcatggtggataactttatcgaccgtaagcatggtcgtgaagccatctcctatcctgatatccagtggcagcatgaaagcctgaagccggtgcttgagccaacctatggcatcatcctttaccaggaacaggtcatgcagatcgcccaggtcctgtcaggctatacgcttggcggggcggatatgctgcgacgcgccatgggtaaaaagaaacccgaagagatggctgagcagcgctcaatatttaaagacggcgcggaaacgatgggcatcgacggtgaactgtcgatgaaaatcttcgatctggtagagaaatttgctggatacggttttaacaaatcgcactctgctgcttatgcgctggtgtcctaccaaacgctgtggctgaaagcgcattacccggctgagtttatggcggcggtaatgacggccgatatggacaacaccgaaaaagtggttggcctggtggacgaatgctggcgcatggggctgaaagtcttgccgccggatatcaactcagggctgtatcagttccacgtgaacgatgaaggcgagatcgtttacggcattggcgcgattaaaggcgtgggtgaaggcccgatcgaagcgatcattgatgcgcgtaatgagggcggttacttccgtgaactgttcgatctgtgcgcgcgcaccgacaccaaaaagatcaaccgtcgggtcatggaaaagctgatcatgtccggtgcttttgatcgtctgggtccgcatcgtgctgccttgatgagtgcgctgaacgatgcgctgaaagcggcggatcaacatgcgaaagccgaagccatcggccaggcggatatgtttggcgtgctggccgacgagcctgaacaggtcgaacagtcttatgccagcgttacgccctggccagaacaggtgcagttggatggtgagcgagaaacccttgggttgtatcttaccggccatcccattaaccagtatttaaaagaaattgagcgttacgttggcgggatgcgtttgaaagatatgcatcctaccgatcgtggtaagattaccgtcgcggcaggtctggtgattgcggcgcgtgtaatggtgaccaaacgcggcaaccgaattggtatttgtacacttgacgatcgctctggtcgtctcgaagtcatgttatttaccgatgcgttagataaataccagcaactgctggagaaagaccgtatcctgatcgttagcggacaggtcagctttgatgacttcagcggtgggcttaaaatgaccgcccgggaagtcatggacatcgacgaagcgcgcgaaaaatacgcgcgtggacttgctatctcgctgacggacaggcaaattgatgaccagctattaaaccgactccgtcagtccctggaacctcatcgttcagggacaattccggtgcatctctactatcagagagccgacgcgcgagcgaagctacgctttggtgcagcgtggcgaatttcgcccagcgatcgtttactcaacgatttgcggtcgttaattgggtcggagcaggtggaactggagtttgactaaaacaggaacattatgagtcttaattacctggattttgaacagccaattgcagaactggaagcgaaaattgattcgcttacctcgattggtcgtcaggacgataaacacgtcaatctcgacgaagaagtgaagcgactgcgcgagaaaagcgttgagctgacccgtaaaatcttcgccgatttgggcgcatggcagattgcgcaactggcacgtcatccattacgtccttatacctttgattacgtgcgcaatgcctttgacgatttcgatgagctggcgggtgaccgtgcttatgcggatgacaaagccattgtgggcgggatcgcgcgactcgatggtcgcccggtcatgatcattggtcaccagaaaggacgtgaaaccaaagagaagattcgccgtaattttggtatgccagcaccagaaggctatcgcaaagcgctgcgcctgatggaaatggctgaacgctttaagatgcctatcctcacctttatcgatacaccgggtgcttatcccggtgtcggcgcggaagagcgcggtcagtctgaagcgattgcccgtaatctgcgggaaatgtcaggtctgaaagtgccggtgatttgtacggtcatcggtgaaggcggttcaggtggcgcgctggcgattggcgttggtgacaaagttaacatgctccagtacagcacgtattctgtcatctctccggaaggctgtgcctcaattctgtggaaaagcgccgataaagcgccgctggctgcagaagcgatgggcattaccgctccgcgtctgaaagagctaaagctgattgattcggttatccctgagccactgggcggtgcacatcgtcacccggttgaaatggcacagtcgctgaaaaagcaactgttggccgatctggccgatctggaaggactcagcaccgaagaactgttagatcgccgttatcaacggctgatgagctacggttacgcctgattcagcctcatcaagcgctaaagcggacttcggtccgctttttttatgccactaatctgactgcagtatagcggtatgattcgctatgcttactcaatgcctcaacaatcagggagatgtgcattgaatattctggcgatcatgggcgcgcacggcgtgtttttcaaagatgaacccttacgcgagctggaagtcgcactgagtcagcaaggttttcaacttatccatcccaaaaatcatgacgatttgctcaagctcattgagcataatccccgaatcagcggtgtcatttttgactgggatgagcacaacagcccggagctgtgcggcgaaattaatcagctcaatgaacatctgccgctgtatgcctttatcaatacccattctcagatggatatcagtatcaacgaaatgcgtttgcctctgcatttctttgagtacgcgctgaatgccgccgaggatatcgccttacatattcgccagtacacggatgactacctcgacaacatcacaccgccgttaaccaaagcgttgtttacctatgtgaaagaggggaagtacaccttctgtacgccaggccatatggccggcaccgcctttcagaaaagcccggtcggctgtttgttctatgacttttttggcgctaatacgctgaagtccgatatctccatttcggtaacggaactgggctcgctgcttgatcataccgggccgcatctcgacgctgaggagtacatcgccagaacctttggtgcagaacaaagttatatggtgactaacggtacctcgacctcgaataagatcgtggggatgtatgcggcaccggcaggcagcaccatactggtggatcgcaactgccataaatcgctcacccatctgttgatgatgagcgatttgatccctgtctggctgaaaccgacacgcaacgcattaggcattctgggcgggattccgcaaaaagaattcacccgtgccagcatcgagcagaaggtcgccgccacgccgcgcgcaagctggccggtccatgcggtgatcaccaactcgacctatgatggtttgctctacaacacgcaatacatcaaacaaacgctggacgtgccatcgatccactttgattctgcctgggttccttatactaatttccatcctatctatgagggaaaaagcggcatgagtggcgagcgggtgccgggtaaagtcttttatgaaacccagtccacgcataaactgctggcagcgttttctcaggcgtcgctgattcatattaaaggcgagtatgacgagcagacgtttaatgaagcctacatgatgcacaccaccacctcacccaactacgccatcgtttcatccattgagacggcggcggcgatgctgcgggggaatccgggtaaaaggcttatcaatcgctcagtggaacgcgcactgcactttcgtcgcgagatacagcggttgcgagaggagtgcgacagctggttttttgatatctggcagcctgaacacgtcgatgaagcccagtgctggccgatccagccgggggaagaagactggcatggatttacccaggccgatcgcgatcatatgtaccttgatccgatcaaagtgaccattctgacaccgggcatgagcgagctgggcgagatggcagaagaggggattccggccgcgctggtggcaaaatttttggatgagcgcgggattgtggttgaaaaaaccggcccttacaatttgctgttcctcttcagcatcggcatcgataaaaccaaagcgatgagcgtgctgcggggattaacggaatttaagcgcgcctacgatctcaatcttcgggtcaaaaatatgttgccggatctctatgcggaagatcctgatttttaccgtaacatgcgtattcagacgctggcgcaggggattcatcgtctcatccagcaacatgatctacccaggctcatgttgaaagcgtttgatgtcttacccgaaatgaaaatgacgccgcatcaggcttttcagcagcaggtcaaaggcaatattgaaacggtgagcatcaatgcgctggtgggccgtatctccgccaacatgatcctgccttatcctcccggcgttccgctggtaatgcccggtgaaatgattacagaacaaagccgcgccgtactcgacttcctgttaatgctgtgtagcattggacgccattatcccggctttgagacagatattcacggcgcgaccttaaccgaagagggtgagtatcgggttcgtgtgctgaaacaggctgaataccaggatatcaatgtttaacagggagcaaacatgctgcagctaacgcacatccatcacatcgccatcattgcgtctgactacccgcgcagtaaagctttttactgcgacattctgggctttgaattgcaaagcgagcactaccgtgaagcgcgtgattcctggaaaggggatctggcattgaacggacagtatacgattgagctgttttcttttccggcgccgcctgcccgcgttagtcaaccggaagcctgtggcttacgtcatctggccttcagcgtaccggatgtcgaggccgcggcagattatctggcgagccagggcgtaacatgtgaaccgattcgcatcgatgcgctgaccggtaaaccctgtacgttctttgccgatccggatggtttgccgctggaactctaccaagcgtaaaatagcgactttatggctacaccgctagccgtctcatggattgacatcatgtctgatttcgacgcactgctgaatgagcgtgacgcgctggtcgtggcctttagcggtggcctggattcgaccgtcctgctgcatcagcttcgggcctggcagcaacgtcatccgttatcccggctacgtgcgctgcatgtgcaccatggcctcagccggaatgccgatgactgggcggcgcactgcctgaatgtgtgcgaacagtggcagatcccctgtgacgttctgcgtgtgcagatcgcggagaagggacagggcatcgaagcggcggcgcgtcaggcgcgttatcaggcactgagccaggcactccacggggatgaaaagctgctgactgcgcagcatctggacgatcagtgtgaaacgctgctcctggcgctgaagcgcggcagcggcccggcgggcctggcggccatgccgatgctgaccacgcttgccggacatcccttattaagaccactgctacaccattcccgcctgagcctggagcagtatgccgacgcgcaccaactgacctgggtcgaggatgaaagtaatcaggatctgcgttatgaccgcaactttttacgtcagcagctactacctgcggtactgagccgctggccgcattttgccgaggcgacggcacgcagtgccgccttgtgtggtgagcaggagcaactcctggatgaattgctggccgggcaactcagcgagctaatacaacccgacggtagcctgtgctttacgccgttactgaccatgagtgaggcgaaagggaatgccctgttgcgtcgctggctggccagacagggtgagaagatgccctcgcgggaagcattacgccgtattcgtcaggacgtcatgcgctgccgggaggatgcccagccgcggttaacgttagggaaccacgagatccgtcgctatcgccagcagctttaccgcttgcctctcagcgcgtccttaaccgactgtgaaatggcatggcctgacctcaatcagcccctggttttaccgcagaacctgggcgtactcacgtccgaaaaaaacgtgagtacgcttcgctgtccacagccggaggagcaggtattcgtgcggttttacgcaacaggctatgttcatattgtgaatcgcacagggggacgtgacataaagaaaatctggcagatgctgaatattcccccctggcagcgtacgcgcattccattaatttattttaatcagacactgattagcgcacccgggctgtttgtcacccgtgagggcgcaagtcaggatgcccatggctggcaagtcaactggcagaaaacgacgggagcgccatgatgttacaacgactagcagccttgctgctgctaaccgtcttaccggcccacgccgcaggcgatgtgaaagcgggcgaacaacgttcggccgcctgcatggcctgccacggggcacaggggaaagcgaccgcgcccctttatcctaatctggccgggcaaaatgccgcttatcttaatcatgcgttacaggcgtataaaaaaggggaacgaagcggtggtcaggctgaagtgatgaaggcgtttgtcgcaggcttaagtgatgacgatatggcaaacttagccgcgtactacagtgcgttaaaaccttgatgagatgggcgggagtgcatcccgcccgacgggaagtgaattactcttcgctgacaacaacggtgccaagttcaggatggctaaagctggcaatgtggtcgagacgtagctcgcgtgtttcaccggaaagatcaatcgccaggtactcaacgtttttacgtgaaagaatatccctggccttggccttgagctgttcgccatctttcaactccagcgtcagcatccagtttttttggcaggcgagttccagattatcgtagtcatcgcaattgatgggtttataagcttcattcatcaacatagtcgctcaccaataagtttgcggcggcataggccgcctgttccctgagagaagcatttagcgcagcattcgcggcaatatcatcaagcgcttttaaggcgcagcctatcgcatcgggtacatatcccagatccccgctgccgatttcggcatatttttggcgaactaactcacaatatttttgcacaggcacctcctcagcagagcataaataccctggttgattagcgactatatcacaggcatttccagaaaatcagccaggcaaaagcaggaacaacgcgcaaatcactgctaaagtagctggctatgcagtatcagacgactcaggataaagcacgaaaggttaagttgatgaacagcccaggacaaaaacacacgaattggacgcaggcaggtggcagatgattatgctgtcacgtaacgtggagctgccggacagtgaaattgagctgacggccattcgggcgcagggttccggcggtcagcatgtgaataaaaccagcaccgccattcatttgcgttttgacattgccgcctcgtccttgccaccgttctataaagagcggctgttaaatgccagccatcatttaattacgggtgagggaaccgtcatcattaaggcgcaggaataccgtagtcaggagatgaaccgggaagcggcactgcagcggctgatcaacctgattcgtgagcttaccacggtagagaaagtccggcggtcaacgcggcctacgcgcgcttcgaaagagcgcaggctggaaggcaagtcgcgtcgcagtagtaccaaagcgctgcgcggcaaggtgcaataacgcttagacgcttatgcgcgcgggactcaataaccgcaatacgtgtctgtgggttctgaaagcgtaaataagcgacagagcagggcgttattcagcggggaataaaaacgccccatgaaggggcgttttgagggtgttacttattcagtgcgttaagcaggaacccgacaatctcatcctgcttgatcatctgtttctcaccggcacgacgggctttatactcaatctcgtggttatcaagattgcggtcgccaatcacgatggtgtgcggtacgccaatcagttccatatcggcaaacatcacacccggacgctctttacgatcgtccagaatcacttctacgcctttggcgcgcagcgtgttgtacagctcttctgctaactctttcacgcggaacgatttctgcatgttcatgggcagaatcgccacctcaaaaggtgccagtgctgcaggccagatgatgccgcgatcgtcatggttttgctcgatggccgccgcaacgacacgggtaataccgataccgtaacagcccatggtcatgacctggttacgaccatcctcaccctgaacagaggctttcatcgcttcggagtacttggtgcccagctggaaaatatggccgacttcgataccgcgtttaatctgcaatgtgcctttgccgtccggactaaggtcgccttccacaacgttgcggatatcggccacctgcgccataggaagatcgcgttcccagttgatgccgaaataatgtttaccatcaatgttggcaccggcgctgaaatcgctcatcttcgccaccgtacggtcggcaataaccggcatattcagcccgaccgggccgagcgagcctggaccggcaccgaccgctgcgcggatctcgtcttctgtcgcgaacgtcaggggagaagcgacaagcggtgatttttctgccttgatttcattcagctcgtgatcgccgcgaaccagtaacgcaaccaatgcgtgaccgctttcttctgcgcccttaaccatcagggttttcacggttttctcaatcggcagctggaactgactcaccagttctgcgatggttttggcattcggcgtatcgatctggcgcatctcttctgcaggcgcaggacgatcgccagctggcgcgacggcttcagccagttcaatgttggcagcgaagtcagactccgtggagaaaatcacatcatcttcaccactttgtgccagtacctggaattcgtgagacgcgcttccaccaatcgaaccggtatcagcctgcaccgcgcggaaatccaggcccatacggctgaaaatctggctgtaggcgcggtacatcgcgtcataggtttcctgcagcgattcctgggtcgtatggaaagagtaggcatctttcatgatgaattcacgcgaacgcatcacgccaaagcgcgggcgcacttcatcacggaatttggtctggatttgatacagattcagcggcagctgcttatatgagctcagctcattgcgaatcagatcggtaatcacttcttcatgcgtcgggccgagcacaaacggacgctcgtggcgatccgcaacacgcagtaattctgggccgtactgctcccagcgcccgctctcttgccacaggtctgcgggttggaccacaggcattgaaatctcaatggcaccggcgttgttcatttcttcacgaacgatgttttcgactttttttaatacgcgcagaccggttggcagccaggtatataaacccgaagccagtttacggatcattccggcacgcagcatcagctgatggctgatcacttccgcgtcagaaggtgtctctttctgagtagagagcagatattgagtagtacgcattgattacgattccagttgatcggaaattcacagacaaaaatttgctggcggctagtgtaccagtgagatcactggctaaaaagcgggttttaacgcggatcgatagccacgacttctgtccctgcctcatcaatgcgccagcgcacattaaactccagtagccaggcggcatattccctgccctgggtttcacctttacggtaagcgggccgcggatcctgagcgagtacctcgctgataaatctcgccagatggggatagcggccgtgttgttgcagttgctgctgggcgtgcggtgaaaaccggaccggcatggtgctttccggcgcggactgggcaaaacctgcacgtgcctggggcagggcttcggcaaaaggcaggtagggtttgatatcgacaaccggtgtaccgtctaccaaatccagactgcccaactgcagaatgacctgttgtttctcgcagcgaatgcctttgagctcaaccagcgacatgccaacagggttggggcgaaaggtggatcgtgtggcaaaaacgcccatgcgggcgttaccgcccaggcgcggcggccgcacagtaggacgccagccaccgtccatggtctgatgaaaaacaaacagtatccagagatggctgaagtcttccaggccgcgcaccgcatccgcctgattgtaaggcggcaaaagatgcagttcgccgccgccatcctgaaccagccccggctggcgcggcacggcgaacttctctttccatggtgaacggatcacgccgatttgcgcaaaggcgaattcactcattgactggtgactttcagcgccgatccctgacaaacagcctgacggtagcagcctggcgtgctgctgacgatttcacatttatgcagcagcacagcattggctttcatctgtgacgctttgatttgcatacgtttacgtgcggtagcgatattggggggcgaactctggttgcttacctggcaatcttcagcggacacttcgcccagatcgcggaagggtttgctcaccagatcggcagcgtcggtataaaccttaacaggcgcgggtcgatacgttggcttacgtgtcggttcgctgggttgctgcggctgagaaggtgcgctgcttattgggtggtactctcgaacacaccctgtcagcatcaatgctaacaagcagagcggtaaaaaacgcatggcaacatcctcaagtttcaaaaagtggcgttattgaaacaaggacacggataaataacaagtcagcaaagcgcaataacagaaagggcggctaaaagccgccctgagggaagatgtcagacgggattaccagcctttaaccgcgccgccgttaaagactttattcgcggcgtccgcgacttcgtcagactgataagcctgaacgaatttcttcacgttttccgcgtctttgttgtcttcacgcgccacaatcaggttgacgtaaggtgagtctttgtcttcaacaaagatgccatctttcgccggcgtcaggccaatctggctggcgtaagtggtattgatcaccgccagcgcaatttgctgatcgtccagtgaacgtggcagctgcggtgcttccagctcaacaattttcaggtgttttggattctcaacgatatccagtgaggttggcagcaggcccacaccgtctttcagcttaatcaggccaactttctgcagcagaagcagcgagcgacccaggttggttgggtcattaggaatcgccacctgtgcgccatcctgcagttgatcaagtgatttgatttttttcgagtagccagcaatcggataaacaaaagaattaccaacggataccagcttgtaaccgcgatctttgatttgttgatccagatacggtttgtgctggaaggcgttcacatcaatatcgcctttactcaacgcttcgttaggcagcacgtagtcgttaaacgtgaccagctcaacatccaggccatacttgtctttagcaaccttggccgcagcttctgcaacctgctgctctgcgcctacgatcacacccactttaatgtggtttggatctttagctttttgatcgcatcctgccagcgcaatcgcgccaattaatgcacccacagcggcaatttttttaaatttgaaagacatatcctttccttaagagtgatattgcttgcttatttatgggacacagcacgcacgatgcggtcaccacagaattgtatgagatacaccaaaacgactaataacactaataccgtattcatcaccgtcgcgttatatccgatataaccatattggtagccaatctgtcccaggccgcccgcgcctactgcgccgcccattgcagagtagccaaccagcgtaatcagcgtgatggtggcagcattgaccaggccaggcagcgcttcaggcagcaggactttacggacgatttgcatcggcgttgcgcccattgcgcgcgaggcttcaatcaatccggtcggaagttccaacagcgcgttttcaaccatacgggcaataaacggggctgcgcccacagtcagcggcacgatggcggcctgcagaccgattgaggtgccgacaataatgcgggtaaacggaatcatccataccagcaggataataaaaggaatagagcggaagatgttgaccagcgccgacagcacccggtacaggcctttgttttcaaggatctgccccggacgggtaacgtataacagtacgcccaccggtaaacccagcacgaaaccgaaaaagccagagacaaaggtcatcatcaacgtttcccacacgccgcgccccagcaacgcaatcatcgcttcagacataacctaatacctctacttttacatgatgttcttgcagccactgaatagcggcttgtgtatcgctttcactgccgtgaatttccgccagcatgatgccgaacttcacaccgccagcgtaatccatctgcgcactgataatattgttattgatattaaaacgacgtgcggcttcagacagtaaaggtgcatcaacggactgcccggtgaattccatacgcagcaacggcatgctgtcaggaccggcttcaggcgacaggcgctgttgataatcgtctggaatatccagatgcagtgttgactggatgaactgctgtgccagcggcgttttaggatgcgagaagacttcgctcacgctgtccttttcgattagctcaccttgactgatcaccgcgacctgatcgcagatgcgctttacgacatccatctcatgcgtaatcaacagaatggtcaggccgagacgacggttaatatctttgagcaattcaagaatcgaacgcgtggtggctggatcgagcgcgctggtggcttcatcgcacagcagaaccttgggattgctcgccagcgcacgggcaatggcaacacgctgtttctgaccaccggaaagattggctggccaggcgtcgtgcttatcagccagaccgaccaggtccagcagttcagccacacgctttttaatctcgtcacgggtgaggttgcccagctctaacggcagcgcaacgttgccagatactgtgcgggagttcatcaggttaaaatgctgaaaaatcatgccaatctggcgacgcgcctgggtcaactgccgttcactcagtgccgttaaatccgcaccgtcaaccagcacgcggcctgaggtagggcgttcaagcagattaacgcaacgaatcagcgtactttttccggcaccggatgcgccgatgacgccatagatttgtccggcaggcacatgcaggctgacattggataacgcctgtatcgaacgcgaaccttgctggaacactttggtgatattttctaatttaatcattacgttatttattatcgtcttgcattgtccgtggtctggtgtgcttccatagatgaaagcatgcataagctggatggatggtaaggcatccagacgtctaaatcaatggaagtgattcaatctgacattctcccttttatggcaatcgtgcgatactaagcggcaatttttatagcaggagtttttacgtgacgaatcaagtcccggccatttttctcgatcgcgatggcaccctcaatgttgatcacggctatgtccatgaaatcgataatttccagtttatcgatggcgtcattgaagcattacagcagttaaagaagatgggctttgcgctggtggtcgtaaccaaccagtccggcattgcacgcggtatgtttagcgaagatcagtttatgcggctcaccgagtggatggactggtctttggccgatcgggatatcgatcttgatggtatctatttctgtccgcatctccccgatgcgacgattgaagaatttcgccagcagtgtgactgccgtaaacctcagccagggatgttgctgtcagcacaaaaggagctgcacatcgatatggctgcttcttatatggtaggtgacaaactggaagatatgcaggccgctcaggccgctggcgtaggtaaaaaagtattagtgcgcagcggtaagccggttacggctgaaggtgaggccctggctgactgggtcatcgcgagtcttgccgagctgccttcgcgcattaaaaacgcgtaaaacagcgcttttgtgcaaatttcagacgaacagcaaaaaagtttaaatttgcacttgcgctctgtgaaagcttccctataatgcgcctccactgacacggcacaacggcttacggaatgcggtgttgagaggttcaggaaactgagccgccggagaaaaacttctgaaaaagaggttgactctgaaggagaaaagcgtaatatacgccacctcgcgacagacggttaacccgctgttcgcactgctctttaacaatttatcagacaatctgtgtgggcactcgcaggattgatatcagcgtctccggacgtaaaaaatatcaagtctcacgagtgaacacataatgaaattcattatgacgttttacagatgagcaccgctgaactggtttcagcaaatcaaacttaaattgaagagtttgatcatggctcagattgaacgctggcggcaggcctaacacatgcaagtcggacggtagcacagagagcttgctctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcattgtggttaataaccgcagtgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccactttgtgattcatgactggggtgaagtcgtaacaaggtaaccgtaggggaacctgcggttggatcacctccttacctgaagataccttcccgcgaagtgctcacacagattgtctgatagaaagataaagaagcaagacggctgcgaagtcgagacacgtccgtgtccccttcgtctagcggttaggactccgccctttcacggcggcaacaggggttcgaatcccctaggggacgccacttgcttggtgacaggtgaaaggtgttgcccacatatcttaaagatgacttacgagtcgtgtttaagattttgctctttaacaatccggaacaagctgaaaatttgaaacgacgcattgtcgtgttcctccgtaataaggaacacagcacaacgcgttcgagtctctcaaaagcttacagcttacaagctaactgttatgcagtagcgcgcgagcagtgaagaaagcaaggcgcgtcggcgcacagccagcggagcgtactgaagtacgtgagcatggcgagcaccgcgcaacgacgcattctttacgcgcagccgttacggtattacagataaacgcctgtgggttgtgaggttaagcgactaagcgtacacggtggatgccctggcagtcagaggcgatgaagggcgtgctaatctgcgataagcgccggtaaggtgatatgaaccgcaataaccggcgatacccgaatggggaaacccagtgtgactcgtcacactatcatgcagtgaatacatagctgcatgaggcgaaccgggggaactgaaacatctaagtaccccgaggaaaagaaatcaaccgagattcccccagtagcggcgagcgaacggggaggagcccagaaccatcatcagcttgtgcatcagtggaagcgtctggaaagtcgcagggtacagggtgatactcccgtacacaaaggtgcacaggctgtgagttcgatgagtaaggcgggacacgtggtatcctgtctgaatatggggggaccatcctccaaggctaaatactcctgactgaccgatagtgaaccagtaccgtgagggaaaggcgaaaagaaccccggcgaggggagtgaaacagaacctgaaaccgtgtacgtacaagcagtgggagccttctttatgggggtgactgcgtaccttttgtataatgggtcagcgacttatattctgtagcaaggttaaccgtataggggagccgcagggaaaccgagtcttaactgggcgttaagttgcagggtatagacccgaaacccggtgatctagccatgggcaggttgaaggttgggtaacactaactggaggaccgaaccgactaatgttgaaaaattagcggatgacctgtggctgggggtgaaaggccaatcaaaccgggagatagctggttctccccgaaagctatttaggtagcgcctcgtgaactcatctccgggggtagagcactgtttcggctagggggccatcccggcttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcacagacagccaggatgttggcttagaagcagccatcatttaaagaaagcgtaatagctcactggtcgagtcggcctgcgcggaagatgtaacggggctaaaccatgcaccgaagctgcggcagcgacactatgtgttgttgggtaggggagcgttctgtaagccgttgaaggtgtgctgtgaggcatgctggaggtatcagaagtgcgaatgctgacataagtaacgataaacaaggtgaaaaaccttgtcgccggaagaccaagggttcctgttcaacgttaatcggagcagggtgagtcgacccctaaggcgaggccgaaaggcgtagtcgatgggaaacaggttaatattcctgtacttggtgttactgcgaaggggggacggagaaggctatatcagccgggcgacggttgtcccggtttaagcgtgtaggtgtgtgttccaggcaaatccggttcactttacactgaggcgtgacgacgaggcactacggtgctgaagtgataaatgccctgcttccaggaaaagcctctaagcatcaggtaacacaaaatcgtaccccaaaccgacacaggtggtcaggtagagaataccaaggcgcttgagagaactcgggtgaaggaactaggcaaaatggtgccgtaacttcgggagaaggcacgctggcgcgtaggtgaagggacctgctccccgagccgaagccagtcgaagataccagctggctgcaactgtttattaaaaacacagcactgtgcaaacacgaaagtggacgtatacggtgtgacgcctgcccggtgccggaaggttaattgatggggttaagcgcaagctgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaaatcgctgtgaagatgcagtgtacccgcggcaagacggaaagaccccgtgaacctttactacagcttgacactgaacactgagccttgatgtgtaggataggtgggaggctttgaagcgtggacgccagtctgcgtggagccaaccttgaaataccaccctttaatgtttgatgttctaacgtaggcccgtgatccgggctgcggacagtgtctggtgggtagtttgactggggcggtctcctcctaaagagtaacggaggagcacgaaggttggctaatcctggtcggacatcaggaggttagtgcaatggcataagccagcttgactgcgagagtgacggctcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgctggagaattgaggggggttgctcctagtacgagaggaccggagtgaacgcaccgctggtgtccgggttgtcacgccagtggcactgcccggtagctaagtgcggaaaagataagtgctgaaagcatctaagcacgaaacttgccccgagatgagttctccctgaccctttaagggtcctgaagggacgttgaagacgacgacgttgataggccgggtgtgtaagcgcagcgatgcgttgagcttaccggtactaatgacccgtgaggcttaaccttacaacgccagaggcgttttggttgagagacgattaaattttcagcattgtttaccggaaaagcatttagttctgttctgcggacgagagtccgaaggattttgcgctgaagcagggcggcgtgtaagacgatgtgaaggagcatactgaagtatgtgactgagcagcgcgcgcacagccaacgcagcagcagcgtaaaagacgcaggacagagcacaaagaatttgcctggcggctgtagcgcggtggtcccacctgaccccatgccgaactcagaagtgaaacgccgtagcgccgatggtagtgtggggtctccccatgcgagagtagggaactgccaggcatcaaattgaaaacctgcacgttacttcgggcagttctctactcaaagagagtaggacaaaagcgaatgcttttgaacgctgcagagcagcggcccgaagggtgaatcaccgcgtgattcatcaactgccaggcatcaaattaagaccagtacgctggtcgtgaccttaccggtgacgcggaagggcgaaacacctgatatcagaacgtttttctgacgtcagtacagaatcggtggagcggtagttcagttggttagaatacctgcctgtcacgcagggggtcgcgggttcgagccccgtccgttccgccacttaattggaaagccctgacttaacggtcagggctttttccatttctgcgcggaaattttcagtagtgttctccgcagttgcaggctctacgtcagcaggcacttaaaacactcaggccgacgtagctctgtcaggactttaaagagagctgatgcagcaactgtgtctgcacatgccagggctgcttcaccacccactcacttagaaaatcaatgaaagcgcgaacacgctgggtgacgccaagatcgctgtaatatacggcgttaaacggcatctctaccggcagccgctgctcggacatgatttccaccagacttccttcttctatttctttatgcaccatgtaatcagaaagacaggcgataccattgccgtcaaggcacaactgcttgatcgtttccccgctgttagaatcaagctctgaacgaatgccatagagctcaccaccttcacaggctacgggccaacggttaagacgaggcgcatcaataaaaccaagacactgatggttatccagatcggccgcgcgttgagggatgccgtatttttccagatagtcaggtgacgcaatgagacggcgatagctgataaagagcaaccgtgctctaaggcctgaatccgttaagcttcctgcgcggatcgccacatcaactttacgctcgataaggttaataaagttttcagaagaaataagcgaaaggtctatttccggatagcgttcccgaaaggactttatcatcggcagaagcagatgcagtatgaccggcgttgcagcatctatacgcaataaccccttcggcatctcacggctttctattaactcattttccgcagcggtcatgacctgaaggaaattttgaacctgatgaaaatagcgttccccttcctgagttaacgccagattccgggtggtacgtgtaagcaaagccaggcctaatttgttttccagcttttttatcgtacgactcacggctgaattggccatctgtaacgtctcagcggcccgactaaagcttccactttcaacgacgctcacaaatactttcagttcttcagacgatgccttcatggtttctcttcacgtgaaatagcctgtaagaccaacatgactgttattaaagcacagcctctaccggagcccttggcgtagaaggctttttcattatatcgaggtatcaccagtctgccattttacagcggatgagagaacggagaagatgttgacgcggccatcaggtgccggttatcacggaaataaaacggggtagggtgagaacaatcggcagcatccattgaaactgcgtactaaaatccctataacagataagtcacacgaatttttgaatgattagccaggcgggaaagtgcgcaaaaaaacctatgcgatgagatatgtagccggacagccagcggaaaggatctttcccccgggtgcaatgtttcatctcggtcaggcattgcctcctggcgcaccgctccctgccgatcccaatcttaaagtgctggtatggaatatcttcaaacagcagcgtgccgactggatgtctgtactggaaggattcggcaaagatgcgcatctcgttttactacaggaagcgcagacgacgcctgagcttatccgctttgccaccagtaattatctggcggccgatcaggtccctgctttcgtgttgcctcagcatccctcaggcgttatgacgctggcttctgctcacccagtctactgttgtcctttgcgcgaacgagagccgctgctaaggctctctaaatcggcacttgttaccgcctatccgttacctaccggcgaaacgctaatggtagtaaatattcacgccgtaaactttagtctgggcgtggacgtttacagcaaacaactgggccccattggggaacagatcatccatcaccgtgggccggtgatcatggccggcgatttcaacgcctggagtcgccagcgaatcaatgccctttaccgttttgctcaccagatgcaactggaagaggtgatgtttactgccgatcatcgacgtaaagcctttggccgaccgttagatttcgtgttctatcgcgacatgcgcgtcagcgaagcctctgtgctggtcacgcgcgcatccgatcataatcctttactggtcgagtttaacgccaaaaggtaaagatgatggcgggagtctttctgtcagggggaaggcggaaaagcgcgaggtcaggcagattgcggcagaatcgaataagaaaaaaggctgacaaatgtcagccttttcaatgtatcaggtatctggcgttgcgttattcttcacgaacaacgttaactcatcgccaggctgaatatctttcgcgttactcacaacactgttccagcgcatcacgtctttaatgtttacgccgtgacgacgggcgatactgtcaagagaatcacctttacgaacgcgataggtgatgctgttgccattatccgccaggctggtgccattcgatccgacagtcagtacctgacctggacgaatactggcactgcgcagattgttttgctgcttcagtgttgcaacactgacgcctaacttattcgcaattcccgacagggtatcgccatttcgcactttgtaaccgccatcgccactggctttcgccagttgggtcggctgtactgcggagatatcaccggaagccagtgaatcacgcaattgtgcgacgttagacttcggcaccataatgtaatgtggcccatttggtgctgtcgcgccgcctttgtatccggtattaaagctctttaatttattgagcggcataccagccatttctgcggcctgcgtcagtttaatctgctggcctacttcaacacgtgctaatgcgcggttttcattaggcgtcggcagtttaattccgtaacgcttgttgttcttgagaagttcgctcaaggccaacattttcgggacataaaccgtggtttcacgtggaagcgaaagatgccagaagtcggtgggcttgccgcgcgccttgttctgtttaatcgcttttagcacacgtccttcaccactgttataagcagcaactgtcagaagccagtcaccgccgaacatggtgttgagacgctgcatcatatccagcgcaaccttggttgaggcgacaacgtcgcgacgaccatcgtaataacggttctgttttaaaccatagtttcgacccgtacttcccacaatctgccagatgccagcggcatttgcagacgaggttgcatgaggatcaaaagcgctctccactatgggtagcagtaccagttccatcggcatcttacgtttcttaatctgctcgactatccagtacatgtacggctctgcccgtaatgttacatcgtggagatagctcttattttttaaaaattttaatttttgttcgcggattcgcgggttttccggaatccccatcttcaactcgtcactaatgaaactccagagatcactatcttctgcgaggccagttccatcttcctgccatcgcggcgataaaagtcgatcaccgtattttccattttcactttgaccagctgaagacagactctgtgcatgctgttcggggatattggcgtcattccgtgatgcctgacatcctaccagcaagaccgaggcgagtaatatcgctttagccttcatatgtgtgtcaatagttcgttcgcttaaaagacgagcaactatacgtgacggtgcttcacaacacaacctgaaaaatcaaaaacgatctttcttctcgcgtagaacggcaaatgtctgccataccggcccaacctctgaatcaaggtctaaagcacgttgtaaatcaggatcttgcgttctgagaaataaatttatcacgcgctcgtgggccagttttgtaggtaaagtaatacgcttttcggcccgtaagtccttaattttgtggtattcagccgttatttgcgggtcgtggggtaaaattgcagcagcaaacttcagattggataaagtatactcatgtgcgcagcacaccagagtctctcctggaagcttattaagcttttgaaaagattcatacatttgttctggcgtaccttcgaataaccttccacagccgcctgaaaacatcgtgtccccacaaaaaagataaggcgaactgtaatatgagatatgtcctaaagtgtgccccggggtggcgatgacctcgaaggacagacccaaaacgtcaaacttatccccttcactgacaaggttttttgcgcctttgtccgccgtttcctgtggaccgtaaaccacaatgtcgggaaagtgttcacacaaggttttaacgccgccgacgtggtcattatggtgatgggttaacagaatggcttcgggctgccagccgttcgcgtgaatcttctccagcaccggctgggcttcaccgggatcaacaatcaggcattttcccttgtcatctgttaacgtccagatgtagttatcttgtaatgcaggaatactggtaagattcataaaaccctctcgctggccgtaaaaaaggaaaatggtaaagcatgaagtccgctaaaacacgccaaatcctgaacgcgccactctcatggcgcgacatgccatggggagtctacttccgcgatgcactgacacagcaacttcagccttaccttggaaagctgtacggctttcatatgcttaagcttggcaacctcagcgcagaaatcaacacggaaaattgcgctatttcacatcaggtcagtgttggcactgagggagaacagttacaggtactggccaatcccgcacaactgccgtttgagtcaaaatcggttgatgcctgcttactggcacatacgttgtcatggagtcaggacccccatcggatattacgggaagtcgatcgtgtgctaatcgatgatggctggatgatcatcagcggcttcaatccgttcagtttgctggggatcagtaagatggtgccgggcattcatcgtaaagcgccctggagcagccgcatgtttagtcagatgcgtttactggactggctgggcctgctgaattacgaagtggttttccgcacgcgtttccaggtgttgccctggcatcgacagggggggaaaatgataagcgctcatttacccgcgttaggttgcctgaacattgtcgtggcgcgtaaacgaagttttccgctcacgcccacgaaggcgcggatgagtctgagcaaaaggcaattaccccagaccgtcaatgcgacgcgccagtttcgacaggctaacgatcaggattcgggctgatagccaatatcatcaaaggtcggattgttagccgcactgcgcgccagttcatcacagcgttcattttcgggatggcccgcatggcctttaacccattcccactgaatcgtatgagtgctgagcgcagtatcaagccgttgccataaatcgacgtttttaacgggcttcttttcggcggttttccagccacgctttttccagttatgtatccattgcgtaatgccctggcgcacatactgactgtcggtactcaacaccacatcacagggctgtttcagggcttccagtgaaacaatggccgccatcaactccatacgattgttggtcgtcaggcgataacccgcactgaaggttttttcatgctctccgtaacgcaaaattgcgccataaccacccggacctgggttgccgagacaagatccatcggtgaaaatctctacctgtttacgcatctctggtagacttccttctgacaaaacgccaagtctgacataaaacgagccctatgagcactgcaaataaccgtcaaattgttctcgatactgaaaccaccggtatgaatatgatcggggtgcattatgaaggtcaccgcatcattgagataggtgcggttgaagtagttaaccgtcgtttgacggggaacaacttccatatgtatctgaagcctgaccggctggtcgatcctgaagcgtttggcgttcacggtatcgccgatgaattcctgctggataaacccaccttcagcgatattgccgatgagtttctcgactacatccgcggggcggaactcgttattcataacgcgtcgtttgatatcggctttatggattacgagtttggcaagcttcagcgcggcattgaaaaaaccgaaaccttctgcaagataaccgacagcctggcgatggcgcgccgcatgtttcctggcaagcgtaacagccttgatgcgctgtgttcgcgctatgaaatagataacagcaagcgtacgctgcacggcgcactgcttgatgccgagattctggctgaagtcttcttaacgatgaccggtgggcagacgtcgttgtcgttctcgtcggaagaggagcgagcgcgccagcagcagagcgagggcattcagcgtatcgttcgtcccagctcaggcttgcgtgtcgtcaccgccagcgcggatgaagttaacgaacacgagtcacgcttagatttgattatgaagaagggcggcaactgcctgtggcgcgtctgaaagccaacgttttgtgtgtaaaatcaacattggggcgaaaatagcagcaaacggaatgttacgcggggaaaagcgttgacgcgtaaagacgttgtgattaatatgcgcctcgttcccgacggggaacaaagcgcggagcggtagttcagttggttagaatacctgcctgtcacgcagggggtcgcgggttcgagccccgtccgttccgccaaattttgacgccatgctggttatcagcatggcgtttttgctttttagcgactgaaagcacgaagcattcccccccttcactcactcgtccaaagcgttaatgctgccaaacagaagatgctgtgcccgcagcaaaactttgctctcgcttatgcactattaacgcgttcgcagaactaaataatcaactgctgacggttaaatgcctgattccagtcatggctgaaatcatcaatggcgtgctttgccagaggggagttaaacatttcatacataacatcgacaggcaatgtgacagccgccgctcccgccagcagacagtctgccacctgagtggtgtttttaaagctggcagcgagtattttgcaatccatcttgtgcagttgaataaactgctgaatatctgaaatggcctgctttgcattaatattgttattttccatgcgattaaaatagggcgcaatataatcagcgcccgcgaaggctgctaacatcgcctgtgaggtggaataaaccgcagtacctaacgttggaatgttacgctgtttcaactgagtcattgcggccagccctgcacgattgacgggtatttttacgatcatattggcgcacatttcatgcagatactgcgcttcgcgaataatatttggtgtatcgcttgctaaaacctgagcaaagataagtttctcctcacccaaaatagtccggatgtcactgattaagtgcgtcagttcgacgccagatttagcaaccagcgaagggttggtggtaacgccattgacgggtaaaatttttaccatctcgcgaatagcaaacgtatctgcactatcgatatataattccatattccctctcaggtattctggtgtttcagtcactcgctaatgaatgtcatttatgcaaatcatagatattgatggccccgactaacgtaccttgttggttgaccaccggtgccgcgctaatgcgtcggtcatataatttctgcgtagccgccgcaacgctgaggtgctcggccagtttataaccgggacgtgtcaggagtggctcaagttgatcgtccagctttttacctgccaataaggcacgacgcaggtcgccatcagtaaaaataccctcaatatcattgttatcatcgcaggcaataacaattcccataccggtgcgggtaagttcttccatcgcatctaaaacggaggcgtttttattgacgcgaggaatgcggctaccttttcgcatgagctgcgtaaccgaattaagtaagcctgcacctaagctgccgccggggtgggaacgggcaaattgctcttcgttgaaatcgcgtgaacgcatcagtgccatcgccagggcatcgccgattaacagggtattcacggcgcttgacgtgggagcaagccccatcgggcaggcttcacgattgacagcaaggtgtaaaacgcagtcggcctgttgtgccagaaaggaactggtaacgttggttatcgcaataatgggtacctggagtgcccgcagtgcaggaataattatctgcagttcagcggccctgcccgaattagagataaagataaatacgtcatgagacgtaatcataccaaggtcgccatgcaaggcctcggcgggatgcacaaaaaaagccggtgtacctgtgctggccagcgaggcggctatttttttaccaatatgaccggatttaccgattcctgaaacaatggttttcccctgacactgtaaaatcagcttgcaggcttgtataaactcaccatttaaactattaaacagattctgagcttcggtaatttcaagcgaaagcgcctctctggcatagtccagcagcacttctggattattcatcatcacctcctgcgacaatgacgttgatttttttatccgctaattgttgaaggtaatgagcagtaataccggcatccgtgataatggtatcaaccttgtccaggctgcaaacaacattcggacttttgcgaccaaacttggatgagtcagctaacacaataatcttgtcagcagccgcgcacatcgatgtgctaacggcatgaacttcattaaaggtggtgatccccatatccaaatcaatgccatcggcgccaataaataacttatcaaagttaaaagagcggaatgctgactcggcaagccctccatgaaatgaagctgacttttttcttaacgttccgccgggcattaaaatggtctgatcgccgtctaattccatcagcgcattcacaatgtgtaggctgtttgtcataacagtaatgttattgaacggcttgagatgcctgaccatttggagcactgtactgccggtatcaaggatcagcgaatcaccatcgttaaccagttgtacggccgattcagcaatgcgccttttcctgtcactgttaatatgtgttttatggtcgataggttgatcgccttcttcatggctcagaatgacgccaccgtgaatacgaataacctcactgcgcttctccatctcggtcaaatctttacgaatagtggtgcctgttgctttaaaatgttcgatcagatcgctaattgtggttttgccatttttttgtagataggcaaggatggcttcctgtctttgtcgcggtttcattggtaaagccttatctgaaaggtgtttttttatcaaaattaaagcagtgctgtaattttcatcctgctttcaatttaacacattactctttcattgatatggcggaaagtaaggctttttgacacgtttcacgctcaggaaaaatttttttcgcatctatatcattaagataacagccatttaacaaaggtagcgcgcgtggacgggcaaaaacggtgaaacctttcataatgacagccgatatgattcgtccttttgtatctacagcgagtgcgataataacgcgtggttcaacattgaagcgggtagatgctgaacgcccaattccgactctgccttgctgaaataagccatctaacatgcggttaaagcttcgtagctgataccagccaaacagcgtatgtgccagccatgctaaaagtgctacagcaattatcccgctactcatcgtcttctcctgagcgatgccagctaatcatgatcgggtcgatcagaacatcacctgaccgcccgtgatgttgatagactgtccagtgcaatacgaggatttatcactggcataaaacaacaagacattcaggacatcctgatactcgcatccgcgtttgagtggcactttcgcaatataactggcttcaacttcgttgggggagatgcccaatttttttgcatactgggggagcagagattgaaacatcggcgacttgagcaaattacccagcatcagtgaatgtaccgtgatgccataatccgctaaatcaagtgccagggactgtgttaatcctaccccgccaaatttagcagcactatagcccgaattatgtttactgcctgttttacccgactttgaattaatctgaataatgcggcctggaatattatcgcgaatcatcagcctggcaaattcacgcgcgcaaagaaaatagcctacgagattgacctgcaaagatacttcaaaatcttttaatgcaaaatcagtgacgaaggaggcttttgccatgccggcactataaatcatcacattgacctgtttaaagatcgtatcgatattgccagcaagctcaataacacttttctcatctgttgcatcaacctcaaaccccacggccagatcagcgccatattcggcgttaatttctgaggcaacttttctggcgttttcacccttcaaatctgctacggcaacgcggtagcccgcttcggccaatcctttcgccagaaacgcacccagcgtttgccctccaccgattacaacagcaacttcagacataacaggctcctaagcaaagagtttgacggatgtttcaggggtgatcctttcgggcgcttttccactgacatggattgatccgggtaattgcgctattgactgcccatcgaaaacgacggtgatatgtcccagctcgcgtaggttctcaatcgcgacctcaccgatagcggtcactggataacacctttctcccagctgtagggttgaacccgttacaggatgtcccatcagcatgccatgctgatgaataaagcaataatcctgaatatcggctggtgcgccttcccgaaataaaatcatcatgttttcaagcagcgcatcgtgggcatttatgccaactttgattatttcagtttcaaagtgcgtcatgacttttctccagaaggttaacgttcagtgataaataaaagcagagacggcccaggcaatcagcacagtcggtgcaccggtcagaaaacggcctaccagtacagaaggaacccccacgcgcacggtgtcctgtttcgcctccgccagcgataaaccgacaggaataaaatccgcagcagcttgtgcattgatggcaaacagggcaggcagggcaagatggggcggaatattacccagtccgatctgaacgccaataagtacaccgataacctgggcaatcaccgcccccggtcctaagaacggcgacagtagcgggaacgaacaaattaacgccaacgtgattaatccaagcggattggtggctagtggggtcagcccgtgggcaatcatatcccccaaacctgaggccatgatgattccaatgatggcagcaacgaatgccataaaagggagaatagtcttgagtacggtatcgattgtatcgcggccggcctggaaaaattcggcgacgatggtccccattcccgtgccgatttttgccagtaaaccgtcgctttgctcggtgatttttttactcggatcgtaatctttacccgtagttgaatcacacggtgccagggcagcaagctttgcgtcatgctcgtttacccgctctttactgtcatgctgctcttcattgacgatgcttatattctcaggcttaacaccagagacataaatgttctccagaatatattgcgccagcggtccggatttccccgtggcatggatattcacagtgggaatacctcgtttgggataaagaccacaacgtagcgtgccaccacaatcgatgattgccaggccaatctcatcagcgggtggttcaccttgtttaaaaccatctacggcttcccaaccggtgatttcgctgagcctgtccacaattgacggtcgggtgcctgctgtgatgtaaacaatttttttcccgggtgttatatcaagttgtaaagggccgccccaaccactgcttcctttctcgatacggatttgtgtcgtcattttattttccgcctttattaaagctgaacgtttttgtcgagcttaatgcccatctttttttcaaacaggctggtggtgagatcggtaatccagccccgaaaaaaattagtaaaaagtccaaccagaaaatagctaacagcaagaggacctaagggcaaacctaaggttgtcaggccgctggcaacgcctaaataaacaaaaagttcgcctggattaacatgaggaaataatccattcatggaatggcaactgtacgaagaggccgcgtagtatcctggcttgtatttttcgggcataaatcgccccaggctgagtgtcatagggttacaaaaaacgaaggtgccgataagcggtaaaagcagatagcgtgaaacagggttgcccgcacatttttgtgccagtcgctcaattcgatgttgccctacgaatctgatcaacgcgttcattacgactaataaactaattaacaaaggtaaaattcctgtcaccatgccgacaaaaacttcacctcctttctggaacagtccaataaaccattccgcaccaaaggtgattgcatcaatcatgttgccactcctttaaggttgcctggattttcgcgcttgctacgccttaactcgcaaaaaaatataatcgttttgaagggataaatattttatatagatcacaaataaattatttaactttcaatttgaactattttttgttttgaaatgaattttttgtctggtgggggcatcgcattctttatttgccgttgcgacagggttagctgactctgtaaaggtttatgcttatgatttttaagttttttatacctactgagtttcagctggcaaagacaggatcaatgcgaacgcggagcgtttctacgaaagagggagggctgatatgcatcaagatagcgtgttgatacgcggatgtaggatagggcactcaaggctgaatagaaaaaccagtcaaaatcattcctcatcaatgcagtccggtggtctgcggcccaacgaaaaacgactctacgtagagtcgttttatggggttactgtacagccacagggcttgtggacaggccgctattccttctgcatcaccgctgcaccagaagccattgagcgatctttctcaacggtctgcttttcgcgtgccaccatccagtagccaccggcagccagcgccacaccaataaaccagctaaagttggccacctgatgcagggcagggataaaactgatcaccaggcagattgcgaccgcaggcaataatgcaccaatggcttttggattaaatccaccgcgataccagtagcgcccttttggcgtgtcatcaaacaggtcatcaacataaacgcggccacctttaatcagataaaaatccgctaataaaatgccaaacagtgggccgataaaagagcccaatacatccagcgtgtagtgaatcagttccggcgactggaaaagattccagggcgttaacagcaccgaacctactgccgcaatcatcccacctgtacggaagctaattttctgcggtgagcagtttgaaaaatcgaaagcgggtgacacaaagttcgcaacaatgttgataccaatcgtggcggtaatcatcgtcaacaggccaattgccacggctaaatcactccccaccatgctgacggtttcgattggatcggtgatcattttaccaaacagcgactgtgtgccggagacaatcaccacggtaacgatggagaacaacagaaagttgaacggcagcccccagcgattaccccgacgaatgtcgcccatgcttttgctgtaacgcgagaaatcgccaaaattcagcagcggacctgagaagtaagagacaaccagcgccgtggcggtaatcatttgccaggtctgttcacctgccgtcagttgtttgctggcaagcgtaaacgaaataccgtcgaaacctgttttgtatacaatccagcctgccaacgccagcatcaccacgtaaactgcaggaccggcaacatcaataaagcgtttgatcgcgctcatgccgtgccagaacaccatggcctggagaatccacatcaccccaaagcagcaccatcccaactgagacaggccaagccagtggctgtgtgtcagactttcgagcgcaggataaaactttaacagcaccaacatcagcgcattggccgccagccaggtctgaatgccgtaccaggcgaaagcaatcaatccgcgaatcaccgccggaatattggcgccaaagacaccaaatgcctgacggcaaataaccgcataaggcacgcccgccatttgactcggcttagccaccaggttggcgcaaagctgcacgatacagatccctgccagcagacacagcagcacctgccaactggccagcccgagcgtaaagaagcttgccgctaccacatatccacccatgctgtgtacgtccgacatccaaaacgaaaagatgttgtaccacgaccagttttgattgcgggtgggcgccaggtctgcattacatagccttggactgtacgctgcttcggcttcagaggccgatgtgttacccaccgttgaatgatttggcatgaaacctgctcctctcaaagacatgaataaatgaccctatgtgtaaacgttgcaggattcaggccaaatttgatttttgtatacaatatttatttttaacgtatacgataagttacgcaaagatgtttaccggagcgggtaatgaagagtgaaacaggccagagaacggcggccgatctgcatgataaagatgagcctatctatcaggcgttgatgaacgccattgtcgaacatcagttgccacccggaagtaaattaccggaagaggcgctttcagacgtattcggtgtcagccgcacaggcattcggaaagtgttgcagcgccttgctgcggtgcaaatggtgacgcttacgcccaaacgtggtgcacatgtcgcgacgcccggagtggaggaagcgcgtgacattttccgaacccgcagtctactcgaatgcgccaaccttcctgccgtactggaacatatgcaggcacctcaccttgccgcgttggctgcgctggttgagcaggaaaaggcggccatcgaacagcatgacggccctgcggcaattcgtctgtcggcggcgtttcatatccagctgcaggctatttccggcaatcaggtgttaaccgatctcgttacgcgactgacccaacgatcttccctggtcattgccgcctggggcgctccctggcagcgcggttgccgctgtgatgatcatgagcaactgttaaaacgtttacgagataaggcgttagtaccgctaaccagctcgatgcagcaccactttgaacatattgtttccagcctgcactttgaacgcggaggcgaaacgttgccggatttcacccggttattttcgggtcataaaggagccttatcatgagcctgattcaggtaattaatcccaataccagccaggcgatgacggaaaccatcggtcaggcggcgcgcgcggtggcagcgcccggcacggaaattctggccgtctgtcctacacagggcgtgccttccattgaagggcatttcgacgaagcgatcgcggcgattggcgtgctggaacagattaagctcggcaaagcgcagggcgtcagtggccacgtcattgcctgcttcggcgatccggggttgcttgcggctcgcgaactggccagcgggccggtgattggtattgcggaagcggccatgcacaccgcaaccttactggcgacgcgcttctccattgtcaccactttgccccgaacgttggtgatcgcccgtcatttgctccagcagtatggctttactcatcattgtgcaggcttacatgccatcgatttgccggtgctggcattagaagatggaagcgggctggcacaggagaaagtgcgtcagcgttgcctccaggcgaagcaggaagacggcagtggtgcgattgttttaggctgcggcggtatggcaaagctggcggcgtcgctcacccaggagctggggatgccggtgatcgatggcgtcagtgcagcagtaaaaatggtggaatcgctggtggcgctagggtttggcaccagcaaacagggcgatttggcttatcctttacataaaccactctctggtgcctttcagcacctaaactaagcagatgttcccgttcaccgacaggatgcacgttatgactgaaagccaggataagaaaacctacagcttcaataaaaattacccgcgcgatttgatcggttatggcgctaatcctcctcatgcggcctggccgaagaaggcccgtgtcgcggtgcagtttgtacttaactacgaggaaggggccgagaacagcgtattacatggcgacacaggttcagagcagttcctgtctgacattatcggtgccgccagctatcccgatcggcatatgtcgatggaatcgctgtacgagtacggttcccgtgccggtttttggcgcattcataacgaatttcagaaacggggtttgcccctcaccgtttttggtgtggcgatggcgctggcgcgtcatccggaaatcgttgacgcgataaaacaggccaattacgacgtggtcagtcatggctggcgctggattcattaccagggcatggatgccaaaaccgaacgccagcatatgcagcaggcggtagatgtgttgtccgatctgtttggcaaagcaccgacgggctggtacaccggccgtgacagccccaatacgcgccgtttagtggttgagcagggtggatttagctacgacagtgactactacggtgacgatctgccgttctggacccaggtgacctgccaggacggcacggtaaaaccgcatctgatcattccttacaccctggaatgcaacgatatgcgatttgcctcgccacagggattcaacaccgcggagcagttctttacctatttgcgtgacacgtttgacgtgctgtatgaagagggcgaaacctcacccaaaatgatgtcggttgggatgcactgtcgcctgttgggccgtccgggcaaatttcgcgcgttgcaaaattttcttgatcatatccaacagcataaagaggtgtggatctgtacccggcagcagattgccgatcactggaagaaaacgcaccccgcgccagaggcgtaacctcctccgggcggtaagcgcgtgacggcaaaagagcgccggcacgcgctgccgctgtttctggcgttgttgcccgcgagacaactgcgcaggcaaccactcagtcacacagggcgggatcggcctcaatcatcagttgcttcatctcttcgaaatgacggagagagaagtcgggaatactttcccagtcgcgggcggttttttccgcgacttcatcactcaacacttttaaaggttgcccggtagaccaggcggtgaccaaaatctggcaggcgcgctccagcgtccagatgtcatcaaaggcctcgccaatcgtctgggcggtcaccatgacaccgtgattccccattaacagacggcgtttatcggtcaacaggctggccagtcgtgcgccttcctctttggtatcggccatgccgccgtataacgtatccaccgcgagacggttaaagtagcgcgcactgttttgatcaaccggcggaatgtgtggctgtgccagacaggcgacgctggtggtgtaaaccggatgcagatgcatcacgacgcgcgtttctggcagtcgctgatgaatttgcccatggatagaccaggcggtggcatcaacatcctcctggtctgcacaggatgggtcctctgcattgagcagcagcagatcgctggcacgaaggcgtgaaaagtgtttccactttgggttcatcagaaactgcttaccatccggcgagacagcggcactgaaatgattcgctaccgcctcatgcatgccgagatgggcaataatgcggaaggccgcagccaaatcgatacgcgttttttcttcgaaagaaagtgccatattacctcctgaaaatgaacgcgtgcccggcacgcgtttgagattaaggctgtggcatcaaggttttgagatcgtctgctgtcggcgcttcaaaatggtattttttcagcagcgcggcatactctggcgttttacggtaggtttccagcgcggcgaccagggcctgtttcacttctgtattgtccttcttcacgccgaacccgtttaacactgggtagatgagcgttgtggaggaaatctgaatgcggttgcccagcttttgaacgacgccacgcgcgaccgcggcatcggtgatctgcgcttcgactgcgtgggagagcatcgcctgcgtcgtctgcggatcggtagcatattcgctgatcgcgataggcggcttaccgtttttcacacagtaatcgtcagacagtttatgtaactgctgtaaccaggaggtggcgcccatcgagccaattttatgaccgcagaatgcttcgggcgttttgggctgataatcactgcccttcagcgacagaatagcttcgccgctcttcagatagggaatcatatcgatcaccttcatgcggtcggcggtgatatacattgatgagttagtgatatcgaaccggttactctgcaagccggtaatcaggttaggaaagcgggtatcaatattcacggcctgacggcccatcacttttgccaggccatcaagaaactcaatgtcgaagcccgcgggcttgttatccttcatatattcatatggaaagaaggtcatatccgatccggcgatgattttacctggttgtaaaaaagctgaggcgttaaatgacgccagtacagcgcctgcagcgagcagacttaatacacatgttttcatcgttattatctctctatgttaggcgctatcagacgttggcaagatcttgaccggcctgctgaacaaagaacgaggcgccccgcggtttctgcggcaggcgaagttcatttgcggtgctgcggaccaggccgctctcgtgaccatagaccagcgttccggcatccggactgggtaacgggttttcaccgaacggcagcgcatcttccgccgcgtacacggcgataaacagtgtgcgcggccaggcggtttcattggggctggaggcgtgcagcagccgtgtatgcataaaacacacggaaccggaaggaccaaagcaggcagtaggctgctcacactgttctttcaccaccgcagaatcgacagcaccggtaaagcgtccgtcctgccagtgtgaataaagtggcccctgatggctgcccggcaccacgtttaacgggccattttccggcgtgacctcactgaccatcagcagcgcggtcacaatatcgtcgttgctgtgcggggtgaacagaaaatcctggtgccactccactttggttgcggtatggggcagcttcgagttgatcttactgtgatgataacgtgtgccgctgccaccaattaattgcccggcaatatgcgccatacgtgactgcagggccgcatggcgataggcggcagagatgtcgttcggtgagctcacacggcgtaatgaagggtgatcggcactgtgatcgctctcaatgtcgaaacgcggacggccgtcctgcgtatcgccccagggcgcactctggctgcggctttcctcaacccactgatcaaaatcgtgttgcagcgctgcgatttcatcgcttgtcaggacatgttcaactaccagaaatccttgctggtgatactgatctatctgccattgttcaatcatggtcgtgccctcgtgattaatacatcgttacgccagcgagacatccttcagaaaagcttccacgcgcggatgctggccatcgcgtagcgcttgtggcgcgtcgtcacacacgacgcggcctttttccataaagacaattcgatcagagactttgaaggcgaagttcatctcatgggtcacgatcaccatggtgatgccttcgcttgccagggcttcaatgacctgaagcacttcattcactttttcagggtcgagcgctgacgtcggttcgtcgaacaacatgatttgggggcgcatcatcaaggcgcgtgcaatagcgacgcgttgctgctgccccccggagagctgatgagggtatttccacgcatgttcgagcatcccgaccttgaaaagcagtgcagccgcctgctgctttaaggtctgtgtgggcgcaagcttgtgatagcgtggtgccagcagcaggttatccatgacattgaggtggctgaacaaattaaagctctgaaagaccatcccaatattgaggcggtgttccttatgctcaatgaagcgtggctttcgttgttctccctgctgactgagatgaataaagggttttccgttaatacggatttctccgttatcgatctgctccagaccattaagcaggcggatcagcgtcgtttttcctgagcctgaaggcccgatcacggaaaccacctcaccaggatgaatctgcaggttaacggcacccagcacttcaacattgttgtaagccttatgaagacgcattgcctgcaacgctggcccgccggtgtgcagcgcctggcgtacaggattcaccgcagcgcattgtgcaagttccaacagttgcgcgtcgggtttgccggacggttgacgctgcgtcacgtccagatagcgttccagctgttttaacaggaagtcaaagacggtcacgatcagcacgtaatagaaggccacggcagccatggtttccatgaccagaaagttttgcgaataaagccgttggccgaccatcaaaatttcggtgagtgagataacagagaccagcgacgtcagcttcacgattgcgatgtattcatttgccagcgccggtaacgccacacgcaaggcctgcgggataataatgcgccactgaataccggcatagcgcaatcccaatgcccgggcggcctcgctctggcccttaggaatcgacagcagcccaccacggtggatctccgcgatgtaggcactctcacaaatggtcagcgcaataaacccggcccagaagggatcgctcaataccgtcgacgtggcgggcagtgcctgaggaaggttataaacaaagatcagcagcaccagtaacggcaggctgcgaaagagccagatataaaagcgggcgggtagcgtcaataagggatgacgcgactgcttggtcagcgccaggataaatcccgcgataatgctcattccccaggtcagcaggctcagtttgatgacggtccatgtcgccagccagaaattagcgtcgctaaacagactgaacatatagttccagttaaatgtcatgggcttgctcgcattaaacagaaaagggttaatcatttcattctgtaattcactatggcggcatgatgggaacgatagcaattagtaatttctttggttctgattttaaaaaaactatccaactctactctcacttttaaacggcgtattttgaatgtcacagggtaataattagcgtattgctttcatttttgcgcttatttagggcagcgcgctgatcattaggacgcaacgtgagagttattggtgcaatttctttttttgacgttcgcgatctgtcgaagataaaaaaacaggctggcgatatttttgaaaaaaaggcgctcaggtcgactgagcatgttgtggcacagcatttgcaccagtgcttagtccaaaacgaagcagtgcttctcgctgaccataaaaaaaagaggtaacgccatgagtcgctttacacttaaacagctccgatatttcgtcgccgtggtagagacggaaagcattgctgaagcctcgcgtcagttgcatatcgcccagccctccatctctgtctcgattaaaaatctggaggacgccttcgatcagcaactgttgattcgccatcatgcccagggggtttccctgacgcccggaggccgtcgtttttatgaaaaagcccaagaactgttacgcctgacacacgagtttgagcaaaattcacgggcagataacacactgatttcgggaacgattacggtgggttgctttgaatctgccgcgcctctgtatatgccaaaactgattgccggatttaaaaaacactatccggatatcaccattgaactttacgatggcgagcagcatgaactgatgcacggactccatcgcggacgttttgacctggcttttctgtacgatcttgaactggacaacacgatacaaaaagcggcgctgaacgccccgcataaaccctatgcactcttaccggtaaaccatccgctggcacaacaatccctcgtcacgttgcgtgagctgagtcaggaaccgatgattttgctggatgctgtccccagcaggaattacttcatcaacattttcaaaagcaaaggttatcatccgcaggttgcctacagttcgccctcaattgaaatggtgcgttgcatggtggggcaggggttaggcttttcagtactggtcacccgaccttacacggatatgacgtatgacggtaaaaaacttgcgcagattgatattgaggatgatatggaagcctctacgttaatcatggcctggttaagtcataatgaacccacgcgtccgacaaaactttttatggactattgccagaatagtgccctgggaccaacgacctgaaaaaggccgcgcatatcgcctgctattcggtaagaaaatgaaatgtatttatggcggaagtcgtcgataaatttcacagtttattcgttgagtggctttaataatcaggtgtgcatcctctgcttattaatttcttattcagatattagctttataatattttacccattcatctgcctcaaatagtcttggcgctagcgcgtgtcaggaacacgtcattgaaacggcgggcttgaggatgatggaatgacaataacagagcaagaaacagacaccctggtgattggggcaggacaggctggcatcgccatgagcgagcatctggggcggctcggcattccgcattgtgtcctggaaaaacatcgtattgctgaggcgtggcggacgcgccgctgggattctctggttgccaacggtcccgcctggcacgaccggtttcccggcatgacgtttccgggccagaacccggacagctttgtctctaaagaacagattgctgactattttgacgcgtatgcacggcacattgacgcgcctgtcaaaacgggcgtcgaggtcctcagcgtagtgcctcgtgtcgggcacagcggtttcgacgtctctacctctgaaggcccgatcgttgcacagcgcgtggtcgttgccaccggtcctttccagaagcccatcattcccgccattgcgcccactgatgcgcgattcacccagttgcattcagcggactatcgtaatccacaacaactgcctgaaggcggcgtgctggttatcggcgcgggctcatcaggggtgcagattgccgatgagcttcagcgtgcaggaaaagacgtctggctctcggttgggccgcacgatcggccgcctcgacgctatcgcaaccgggacttttgctggtggctaggtgtgcttggtctgtgggatgcagcagccggtcaacccggtaaagaacacgtcaccattgccgtcagcggtgcgcgcggcggtcatacagtcgactttcgcaggctggcgcaacagggcatcaacctggtcgggttgacggaacgcttttcaggcgatgaggtgactttcaagcccgatctggcgcaaaacattgcctcaggtgatgaaaactatttatccctgcttgacgcggcagatgcctgggttgagcgccatgggctggatttgcccgaagatcctggcgcgcgcgtgtttctgcccgatccggaaagtgtctcgcaccctgtgcagtccctcaacctcgtccgcgcagggatcaccaccctcatctgggcgacgggctacgccaccgactacgcctggctgaaggttaacgcctttgacgagaagaacagaccgatccatcaacgcggcgtctcccccgagtccgggctctattttctcgggctaccctggcagtcacgccggggctcctcgtttatctggggcgtgtggcatgacgcaaaatatgtcgccgaccacatcgctatccaacgtcagtatcaggattaccgtgccgcttcagaaaattgaaccaggagattgtcattatgccgactcatactcgtattcggatgtttaacaccaaagaaacctatcccaatcaaacgctggacaacgatctctgccaggccgtacgtgcaggtaacaccgtgtatctgcgcggtcaggttggcaccgacttcgacggtaatctggtgggcctgggcgatccggctgcccaggcggcgcaggcgatgaaaaatgtgcagcaactgctggaagaggcaggaagcgatctgtcgcatatcgtcaaaaccaccacctatattaccgatccgcgttatcgcgagccggtttaccgggaagtaggaaagtggcttaaaggcgtcttccctgtctctacgggcctggtgatttcggcgctcgcacagccgcagtggctgatggaaattgatgtcattgcggtgattccggatgactggaaacagggagcgatgcaatgaccttatcggtaacggcacgttgtgaagaaaccggtcaactcggtattgccatcagctcatccagcatagccgtgggggcgcgctgtccctggctgcaggcgggcgtgggcgcggtagcgagccagaacattacgctgccttctctggggcagcagattctggtgcatctggatcagggcagggatctgaacgtggcgctcaagctggcgctggctgacgacagattcagtgattaccgtcaggtcgccgcgatcgatattcagggcaatacggcgtttttcagtggcagcaagacgctgggcatcgggagcgtgactgaaggcaaaaactgtatcgccgcaggcaatatgcttgcggataaaggcgtgacggcagcaatgtgtgcggcttatgacgcggcctccggtgaactggccagtcggcttcttgctgccctccaggctggcgtggcggcgggcggggaggccggaccgttacattctgccgcgctcaaactggtggacgactatacctggccgctggtggatctgcgcattgactggactgagcatgatcctgtcgggcaactgacgcaactgtggcttgcctatgaaccgcagatggaagcctatgtcacgcgcgcactggacccgcgtgaagcgccagcctatggcgttcccggcgatgaatgagggtttacgtgtgcttctggcctcactgctggcctttgacacaaccagccgggcgtcaaacctggcactgattcagtttattgacgactacctgacggtcagaggcgttaagacgcagtggctgcatgacgacagcggtaaaaaagccaatcatttgacgacattggcgaggcgaccctggtttgtgggccgggaagcatggatcagggacataaagcggatgagtttgtcagtatcgaacggctggaacgttgtatgacgatgttgaacaacctgcgtcagtggatggcgttaacgcccacgaactcaaccgggtaagccatgcggggcggatcgcaccgcatagccagattatcggctcaacccgtttttacagccggccataaaaagtcatgcgcgcggtctctgataacgcaatgccgggcgcggtgttataggccagcaccgccagcatacgtgtcacgtcgccttcggtgggcgtgacgcgatgcagggaattacgcccgcgaaacagcactaaatccccggcttcaatcgccagctcatcgaccggctgctgttcatccagcaccgcggctacgcccgcataattcatctcgcccgcatcggcattccgcaggtctttcacatactgaaaccgtccaccacccaccggtttctgcaccagcaacgtgatggcaaacgaagagttatcaaaatgccaacccagttctttgccgtgcggcgcatagtgaaggttaatggaagacaagggatcggcgtacggatacaacgcttcttcttcaagcacctcacacaaaaaagactgaaaaagtgcatcgtcgtaaagctgacgcaaaggggaatccggcgcgatcacatcgtcagtgatgcaccctttggtgctactgacttcgcggttgcgaggatgcgtatcgctgaagtctgggtccgctttcatcagatagacgttatgcttactttgggtatggtaagcacgatggcgttgcgcatcaccttctgcgacgatggcttgtagggcggcgggctgcaaaaaatcaggtagcaccagtgcaccttgctggttaagttgcgtccgacagtgttgacgccagtcatgactggacagaggatgtaagtcagtacgtaccagagcttcaggcatcgtttgcttcccgcgtttcaagagtgagatatcactttaacggggtccgatcgtactgaataccaataaatatttaagaccctgataaggaagccttaatgcccacgccgtcgtcgcgcctgcctaaaatcaacgttattcagtcatttaaggtggctgcggaaaccggcagcctgacgaaggcggcagcgcagttggcgttaacgccagccgcagtcagtcagcaaattcgtcagcttgaagagcatcttggatgtgcgctgtttttacgcacccagcacggcgtgatgctgacggatatcggcaagcaatatcttcgctatgtgtcagaggctttcgatattctgcaactggggcaacgaaacatcgggcgcaaggacaccgccgctcagcttacgctgtatgcgcttcccgcgctggcgtcaaaatggttattaccgcatcttcaccactggcgcgagcgctgcccacatgtcggtctctctctacatggcacgcacgccgaagtggacttcagtaaaaccccggcggattttgtcatctgttttggtgaagacgcctgtcccaaactgaacaaacagtatctgtttcacgatgaggtattcccggtcgccagccccgcgctggtcaacgcgttttctgcagcacatatcctcaacgaggcgccactgattcatctcgactggggaaaagaagggcgttttctgcctgactggccagcctggtttgaggcaaaaggcatggccgaacccagggctcagccgggtttgacgtttaacctgacctcactggcgattgatgcggcggtcgccggggcgggactgctgttgggacaacgccagatgattgcccaggaactggcgcggggcgcgctggtggtcattgatgggttatgtttaccgctcagtaagccctattaccttgcctggcctaatcgcactggcaaccaggaaggaagcgaggagatgatcgcctggttgcgcgaacgcgctgcaggggaataaagcgcattcggctggcggtgagcagaggttgcagcgctgtgcgcgggcagtcacagcctgagcgatcttagataaagcgaggcatccttgcctctggcgctacggggagtttaacgcggcttggttaactcatcaggctgacctgggccgcgacgatgcgccagcctgcggggaatttcacccaggtttgttgctgacggccaattttttcagtgcctgcacgggtgaattcggtactgcataccgcaaaagcatcgccaaaggtcgtgatcacggtattctgcaatgagcgatctagtcccgccgaagggcgggcggcgcggaaagcgcgaatctcatcaatgccgtataaattctctccggcacccagacgcaccgtccgtgcatcgtgccagaacagctcatccagaacggcaatatcgttgcccgttagcgcctgttcatagcggtagaatgcggcggttacggcgtccagcacatcagtgcgattaatctcgtcggtgttcatgaggctccagccacgttggtgggagaaaatgtcagaccttgctgttcaagggcaaaagccgcccgcaataccgcctgttcgttaaacggcgcgccgattaactgtatgccaatcggcaagccgcttgccgttgccagcggaacagtacagacgggcaggccgagaaaagagatcggctgggttaacatgcccatgctggccttggtcggcaagttttgtccgttaatggcaatcgtctcctgaccaatcagcggggcactgcagggtgtggcaggggcaatcagcacatcaaaccgatcaaacaacggcagtatttgctgttggacatgacggcggaagcgttgtgcctgcacataccaggcaccaggcagcattgcgcccgccagcaggcgttcacgggaatgcggttcaaactgttcggggtgctgacgtagtgcgggcagatagtggttgccgccttccgaagcggtcatgataaaggcggctgagcgagccagttccgcttccgccatgatcacctcttcgtcagcctgtaacgctttggcggtcttcatctgggcggtgcgcgcatcatcattacaccacgttgaaaagaaaccacccagcacggcacagcgtaaatcctgcgcgccctgttccagcaaaggcaaggatgcagcctgcggctgatctgcctggaaggcatccgcactgtccttaccctgcaacagatcgtagatcagcgccagatcgtccacccgacgcgcaaaggggccgatatgatccagactggcgacaaacggatggctgccgctgcgggacagacgaccaaaggtcggcttcagcccaacgatcccgcacagcgaagccggcacgcggatcgagccattggtatctgtgcccagcgaaaaatgcaccagcccggccgccacggctgccgccgaaccgccggatgagccaccggcgatgcgcgccagatcgtgcggattgcgcgtcgcgccatagtggctgttttctgtggtaaagccgtaagcataggcatccatattgaccatgccggaaagcagtgcgcccgcctgctgaagtcgcgtcacggcaaaggcatcctgctgcgcggcggggcgctggctgaataatgcggcccctgccagcgtcgaatagccctgcacatcaaacaggttttttaccgcatagggaatgcccgccagcggcggtaatttctcaccgcgcagtcgctgttggtcgaccgcgtccgcttcctgcctcatccgcgttgcagtgatatccgtccaggcattaagctgcggattctgtttctctattgctgttagcgtctgctctgccacttcacgggcactgatatccccgcgctgaatcgcctgttgaagtgcctgaatggaaacctcgtccagtttcatgcgtggtacactcccgccacttccagccgatcgtccagcggataagccattagcggtgccgccatagcggcaatacgcgtcatctggatcagcagtgctgcacggcgtgcctcatccagctccagattcaggatctgctccatctgggcgatataagccgcccactcaatatcattcatcatttactcctgtcagaaaccggcggcgctgccgttgctgcgtggatcgcttgcgccttcgaacataccgttgttgtgacgaacaatggcccccgcatggccgacggcctcactgaatgccggaagcgactccacctcatggcctagctggcgtaactgctccagcgtctcaggcgcaaaacggctctccagcttcagggagtcagaggtctgtccccacgtacggcccagcagccaacggggtgcactcactgcctgctgaagcggcattccctgtatcacatgccgggtaaaaatcgccgcctgggtttgaggctgtccgtcaccgcccatcgagccatagaccattgtgcgaccgtctttcaggcgcgcagcggcaggattgagcgtgtggaaaggctgcttgccgggtgccagcgccagcagatgatcgggatcgaggctgaaagccgccccacggttttgccagacgatcccggtgccgggcagaaccacgccactgccaaattcatgataaatactttggataaaggagacggaaagcccgctactgtccatcacgcccatccagacggtatcgccaggcccacgaccggttccccatggcgcagcgcggtgatcgtcaatctggctggcaatcgtggcgagctgatcgctgtcgagcagggcctgcagatcttcaaccacatgacggggatcggtgatgtgccgatcgcgcagagcaaaggctttttttgtggcttcgacgatgcgatgaatggtttgcgcttcatcggcattggccatatccagatgatcggtaatgcccaggatcgccagagaaaccagcccctgtgtcggcggcgtgatattccagatatccccttcgctatggctgacatgcagcggcgtgacccggcgggcacgttgctcctgtaaatcggccagggtgacaggaatgcccaggttaaccatttcgcctgccagatgatgcgccagcgtgccacgataaaagctttccagcccttcttcactcagcagactcagcgtgcgggccagatcgggttgggtaaaacggctgccttccgccgggacattgccatcgggcaaaaacagggcggaaaagccgggttgatgctgtaactcttcacgcttgctgcgagtcgccgacgcttgtgaggccgtaaccggaatgccatctgccgcataacgcacggcgtcacgcagtaatcgtggcagagacagggatgtgccgccgagctcggctgacagcgttaacgcctcgtgccagccgctcaccgtgcctgccacggtcaatgccgctttgggcccgcggtgtggaatctgtgtttcaccctgatagaagtcgatggttgcgagagaaccggctctgccgctggcgtcgatagcgatcgggtcgcctttgcccggcataatcagccagaagccatcgccacccaagccgttcatgtgcggatacacgacagcgatcgtggcggcggcggcgaccattgcctcaatcgcattgccgccgtcgcgtagcactgccagcgcagtttcactggccagatgatgaggcgttaccgccatgcccagcggggccatattgctctgaatcatgctcttctcattgtgttattcagggtacagagcaaataactaagcaagagccgttccagtttttatcaccgcaacgtctctggacaggtttacctggcccaaattatgctagcttctgtcaaaccccgcggttgaaacaaaagttacaggacctgaatgaaacagcttgatgaaaggctcaaaacgcattatccccagctttcgccgcaagagcagcgcattgccgattttatctttgaccatttcgacgatctgattagctataacagtgccgagctggcgcgcctgagcggcgtgtcaaaagccacggtcagtcggctgttcaggcggctcggttatgacaaatacaaagatatgcgtgatgagttgcgtaccctgcgccagagcggtatgccgttgacggataaccgggatgcggtgcagggcaataccttactgtcgcgccattacaagcaagagatggccaatcttacgcagtgggtgaacagcatcgatgcccagcagtttactgaagtcattgcccaactggcacaggctaaacgtatctatatcgttggtatgcgtaacgcctatccggtggcgctgcacctgcgccagcagctgatacagacgcgttcgcaggtgcatattctgccccagccgggacagacgctggccgaagatctggtggatattacgcccgacgatatggtggtggtcatcgcttttcgacggcgcacccgcattatccaaccgctgatgcagcagctgcaaagcgcgggaatccctgtgctggcgctgtgtgagccccaggcgcagagcgtgatttccctggcgcgctggcagttttgcgccccgctggacagcgtttcagcctttgacagctacgcatcggccatgagcctggtgaacctgcttgccaatgccttgctgcatgaattgctgtcagacggacgccagcgcatccatcatatcgccgatctttatcaccagcttgacgagctggagcaccgttaacaggcaccattttggtgctttgcccctttttggaccgtctcccgaggccgctcgggatctgccccatcaccactaatgccttctcttcgcccttcatccgcttttttaatcgtgcaaccgcgttggcacattagttgcagaatgccagctataagaatcttttgtttcacataatctcaccggggtgcataatgaaaaaagttttgatggcggtcgcagcagcggcagtactgatggtgcaggcgggcaacgtgctggctgatcaactgcaggatatccagaaacgcggcgtactgcgggtggcgatcccccaggatttcccaccgtttggctcagtagggaccgatctgcaacctcagggctatgacatcgacatggcaaagtatctggctaaacagatgaaacttaagttgcagctggtgccggtcagcagcgcgaaccgcgtaccttacctgcaaacagataaagtcgatttagttatctccagcatggggaaaaatcccgaacgcgaaaaggtgattgattttagccgggcttatgcgccgttcttcctgggcgtttttggtcccaaaggcgaacatctgaaagatgcggcggcgctgagcggtaaatctgtcggcgtcacccgtggcgcagtagaagatatggttctgagcgaggtggcccctaaggatgcgcaggtgaaacgttacgaagataacaacaccaccttatctgcctatctctctggtcaggtgcagtatgtggcaacgggtaacctggtggtcgccgccattacgcgtcagaacccggctaaagcccctgttgcgcagttcatgctgaaagactcaccgtgctatatcgggctgaagaaagacgaacccgcgctgaaagacaaagtgaatacgctgattgaccaggcgatcaaagacggcacgctgaataaattatcccaagagtggctgaaagcgccgctgccagccaacctgggcgcataaggacggagcaatgaccgggcaacttaatttccctgcattgtggccgtactggccggagttgctctccggcctgtgggtgacgatccagttaaccgtgctggccacggtcggcggcgtcagcatcggtatcatcggcgcggcgcttcgcagtggtaaacccagttggccaagtcgcctgtggggcctttatgttgaactgatacgcaacacgccgtttgtggtgcagctgttttttattgtgttcggcttgcccaatctggggctgaagctgacagccggtgaagcggccttgctggccatgttggtcaaccttggtgcctacagtacagaaatcatccgtgccggtattcaggtcacgccaaaagggcagtgggaagccggacgggtgctgggcctgacgcgcagccagacgtttctgcgcgtggtgttgccaccgtcgctgcagcgaatttatccggcgctggtgagccagtgcatcattgtgatgctgggatcgtcggtcgtctcgcaggtctcttacgaggagctgacgttcgccgccaacctgattcagtcgcgcacctttttgagttttgaagtctattcggtgaccacgttgatctatctggcgttgtcgattgtgatgcgtcagctgttgctggcgattggccgcaaatggctgggagtgcaggcatgatgacaacctttactgactgggacatcctgcgcaatctgctgctggcagcacgctggacgatcgccctgtcgctggtggcctttttaggcggcacgctcgtcacgttacctctgctgtttttacgcctgttaaagcgtaaatggctgacgcgggtgattcgtgcctataccgaactgtttcagggcacgccgctgctgatgcagctgtttttggctttttttggcgtagggctgttcggcattgacgtggcaccctggaccgccgcatcactggcgctgaccttctataccagcgcatttctgctggatatctggcacggcagtattcaggccctgcccaaaggacagtgggaagcatcacgctgcctcgggcttggttttggccagacgttgacgcgggtgatcgcgccgcaggcgattcgcattgctatcgctccgacggtgggatttgcggtgcaggtgattaaaggcacggccctggcgtcgattatcgggtttgtcgagctgaccaaggccggcaccattctgaataacgtgacctatcagccttttaaagtctttgggctggtcgcactgggctacttcctgctgtgttatccgctgtcgcgttacagccagtatctggagaaaaaatttaatgccgctcatcaccattaatcaggtccagaagtattacggcaccaaccatgttcttaaaggcgtggatctggatatcgatatgggagaagtgatctccattatcggccgcagcggttcaggtaaaagtacgttgttgcgctgcatgaacgggctggaaggctatcaggatggcagcattaaactgggcggcatgacgattaccgaccgtgattctcaggcgcgggaaatcagccgttcagtgggcatggtgtttcagaacttcaacctgttcccgcatatgacggcgctggaaaacgtcatgctggcaccgcgtcgggtactgaaaaaaagccaggcggagtgccgggaactggcggcccgtatgctggaaaaagtggggctgggcgagcggctggattattacccttccagtttgtctggcggtcagcagcagcgcgttgccattgcccgcgcgctggccatggaaccccgcgtattactgtgtgatgagattacttctgcgctggaccctgaactggtcggcgaagtgctgaaagtgctggagcagcttgccgcagaaggcatgaccttgattctcgtcacccatgaaatgaacttcgcccgcgacgtgggcgatcgtgtggtctttatgcatcaggggcgcgtctgggagcagggcgacagtaaaacgttgttcgcctctccgcagacggcggagctaaagcagtttatttcctctgtgcgtctttgagtgcttaacaaggaattcactatggatatctctcaatttccacaaattaatccccctcagcgtctgttaatggggccaggccccatcaatgccgatccgcgcgtgctgcgtgcgatgtcgagccaactgctcggacaatacgatccggcgatgacgcattatatgaatgaagtgatggcgctgtatcgcggcgtgtttcgcacggaaaaccgctggacgctgctgatcgacggtacttcccgcgccggtattgaggcgattctgctgtcgacaattcgccccggcgataaagtgctggtgccggtgtttgggcgtttcggccatctgctgtgcgaaattgcccgccgctgccgtgccgaggtgcacacgattgacgttccatggggcgaggtcttcacgccagatcaggtcgaagacgccatcaaaaaagtcaaaccgcgcctgttgctgaccgtgcagggcgacacctccaccaccatgctgcagccgctggctgagctgggcgcaatctgcaaaaaatatggcgtgctgttttacaccgatgccaccgcgtcgctggcgggaaatgcgctggaaaccgatgcatggggactggatgctgtgtccgcaggtatgcagaagtgcctgggcggtccgtcgggtacctcacccgtcaccctgagcgatgaaatggcggcggtgatccgcaagcgtaaatgcgtggagcaggggattcgcaccgacgcgcatcaggatggcgacgacgagatgatctactccaactatttcgatctcggcatgatcatggattactggggcccggaacgactcaatcaccatactgaagccaccagcgcgctgtttggcgcgcgcgaatgtgcgcgtctgatcctgcaggagggcctggataacggtattgcgcgccacaaactgcacggcgacgccatgctgaaaggcattcagggaatggggctggaaacctttggcgatctcagtaacaagatgagtaacgttttaggcgtggtgattccacagggcgtcaatggcgatcaggtccgtaaactgatgctggaggatttcggcattgaaatcggtacttcttttggcccgctgcacggcaaagtctggcgcattggcaccatgggttacaacgcccgtaaagactgcgtgatgcaaaccctggcggcgctggaaatggtgctggcgcacgtgggctaccgtgcgccacagggtgccggttcgcaggccgcctgggatcactacgggagccatgcatgatgatgaatgccagcgaggctcagattgccgcccggcgtatcatggcgcgctgtgacgcgctggctgagatcagcgaaagcgatcaggggctgactcgggtttacctgtcaccagagcacctgcgagccaatgcgcgcgtcggcgaatggatgcaggccgccggcatgacggtctggcaggatgccgtcggcaatatttgcggtcgttatgaggccgcccagcccggtgccccggcgctgttattgggctcgcacctggacacggtccgcaatgcgggccgctacgacgggatgctgggcgtactgagcgccatcgaaaccgtgcagtggctgagcgatcatcagcgtcgcctgccgctggcgattgaagtcatcggcttcggtgatgaagagggcacgcgttttggcatcaccttactcggcagtcgtggtatcaccggtacctggcccgacagctggccaacgcatccggatggcaacggcattaccgtttctcaggcgatgcgcgatgtggggctggatgctgcccagatcccgcgtgctgcgcgtgccgtcagcgatatcgtggcctatctggagttgcacatcgagcagggaccttgcctggagcaggacgatctcgcgctgggcgttgtcacggcgatcaacggtgcccgccgcctgaactgcagctttacgggcgaagccggacatgccggtacggtgccgatgaaccaccgtaaagatgccctggcggcggcggcagaatggatggtatttattgaacacacgacgcgcgaacaaccggggcagttagtggcaacggtaggcacgcttagctgtgcaccgggcgcggttaacgttattccgggcgaggtgaacctgtcactcgatgtgcgtgggccggaggacgcgccgcttgagtcgctgctgtccacgttactgacccaggcggaagccattgcgctgcgtcggggtttgacctttacgtctcatgaatattaccgcattgcggcgacggcctgcgatgcgaggttacagcaggcgctgagccatgcgattgaaaccgtacaggggcgcagtctggcactgcccagcggcgcaggccatgatgctatcgcgattgcggaacgctggccggtagggatgctgtttgtgcgcaaccatcgcggcattagccatcatccggcggaatcggtgaaggaagcagatgtcggctcagccgttcaggcttatttgcaggccgtttgccaccttgcggagcagcactaaatggatctcgtcacctttaatcagttacccgacgccgccgctcagcttgcgctgtcgcactgcgtcgcgattccacgctggcagcaggcgatggtggcggctcgcccctttcacagccttgaggcattgattgccgaagcacaacggctgacagctgactggcagacagaagacctcaattttgccctgtcggcgcatccgcgaatcggtgacaaggtgcagggcaacggtattgaaaaatgtttatcgcgcagtgaacaagccgccatgcaccaggcggacgacgggctgcagcaggcaatgctgcggggaaatcaggcttatgaggcgcgttttaatcgggtatttctgatccgggcaaaagggcgcagcgcgcaaaacctgctggacgaactcacacgacggctggacaacgaccacgaaaccgagcagcaagaagcgctggaacagctgcgtgagatcaccctgctacggcttaaggagagtttttcatgagcacaatcagcacccatattctggataccgcgttggggaaacccgcggctgacgtggcaatcttgctggaacagagcacggcacaaggctggtcaacttatgccagcggcgtcaccgacggcgatggtcgcctcaaggacttgacgccagagccgatcgcgccaggccattaccgcctgacggcggcgattggcgactactttcgcgtgaccggacgggatgcgctgtacgtcagtgcgcaaatcgatttcgtgattgctgcaagcggcagccattaccatctgccatttttaatctcgccctggagctggtctacctatcgcggcagctgacggggttatcaggcgcggcacttttccgctgcgcttgagagctaccggctatcaaaaccttcggcccatccgaatatattcttgctaacaccagggttatcttaaggatgacaatgtgaaggcaacggagccgataatgagcacgccaaaagataatgatgtagccgcttcaggaaaatgtccctttcatcacggtaaatcggaagaagaaagcgttctggctcgcggagccggtagtggcaccagcaatcgcgactggtggccaaatatgctgcgcgtggacctgctgaaccagcattccaatcgttcaaatcccctcggcgaagactttaactatcgcgaagaattcagcaagctggactatgctgcgctgaaagccgacatccgggcgttgcttaccgactcccaatcctggtggcctgccgactggggcacctacattggcttgtttatccgtatggcctggcacagtgccggtacttaccgcaccatcgacggccgtgggggttcaggtcgtggtcaacagcgctttgccccgctgaattcctggccagataacgtcagccttgataaagcccgtcgcctgttgtggccggtgaaacagaaatacggccagaaaatctcctgggccgacctctatatcctcgccggcaacgtctcgctggaaaactcaggtttccgtaccttcggttttggtgccggtcgcgaagacgtctgggaaccggatatggacgtggactggggtcatgaaaccgagtggctggcacatcgccatccagaaagcctggcgaatgcgccactgggcgccacagaaatgggcctgatttatgtcaacccggaaggccccaacgccagtggcgatccggcctctgccgcgcctgctattcgcgccaccttcggcaacatgggcatgaacgatgaagagatcgtcgcgctgattgcgggtggccacaccctgggtaaaacccacggtgccgccgctgcgagccacgtgggcgtcgatcctgaagcctcacctatcgaagcgcagggctttggctggagcaataaccatggtagcggcgtgggtgcagatgcgattacctcgggtcttgaagtggtctggacgcagacaccaacgcagtggagcaactacttcttcgagaacctgttcaaatacgaatgggtaaaaacgcacagcccggccggtgctattcagtatgaagcagtcaatgccgacgacattattccggacccgttcgatccggcgaaaaagcgcaagccgaccatgctggtgacggatctgacgttacgtttcgacccagagttcgagaagatttctcgccgtttcctgaacgatccgcagtcctttaacgaagcctttgcccgcgcctggttcaaattgacccaccgtgatatggggccaaaagcgcgctacatcggtcctgaagtgccaaaggaagatttactgtggcaggacccgttaccgcagcctacgcatcagccgacgccaggcgatattagcgaactgaaagcgaaaatcgctgcgtcgggcctgacggtcagccaactggtgtctgttgcctgggcgtctgcatcgaccttccggggcggtgacaaacgtggtggcgctaacggtgcccgcctggcgctggcaccacagaatagctgggcggtaaacgccagcgtggttaacgacgtattacctaaactgcagcagattcagcaggaatccggtaaggcttcgctggctgatgtgatcgtactggcgggcagcgtcggtatcgaaatggccgcagccgcagcaggcgttgccgcacaggtgccgtttatcccaggccgtgtggatgcgcgtcaggatcaaaccgatgtggaatcctttaacgtgctgcaaccgctggccgatggtttccgtaactaccgtcgcgtacagggtggttcatcgacagaaaccctgttgctggacaaagcgcagcagctgacgctgagtgctccagagctgaccgcgctggtgggtggcttacgtgtactgggcaccaactttgacggcagccatcacggcgtgtttaccgaccgagtgggcgtcctgagtaacgatttctttgtgaatttgctggatatgcgcaccgcatggcgtgcgactgacggcagtgaagagatcttcgaaggccgcgatcgtcagagcggagcggtgaaattcagcgcgacgcgtgccgatctggtgttcggttccaacgccattctgcgtgctctggccgaagtttatgccagcagcgacgcaaaacagaagtttgttactgacttcgtggcggcctggacgaaagtgatgaatctggatcgtttcgacctgcagtaatcctgaatcacccccggcctgtccgggggtgacgtcattccgttagcgtaaagccatcagcatcgcgccaggccgggaaccgttcgcggtatgcccgcaggtctgacagcgataacgcggcatcaacgcagcctgctttgcaggattcacctgccgccagaatctcgccctgtggcgaaataatccgactgtccccactgtactcgtgctgattgccatcgctgcccacgcgattgcagcctgcaacaaatgcctgattctcaatcgcccgtgccaacagcaacgcctgccagtgcagggtgcgcggtgccggccagttagcgacatacagtgccagatcgtaatcatcccggttacgcgagaacaccggaaaacgcaggtcataacagatttgcggcaaaatacgccagccgcgccactgaatcaccgtgcgtgccttaccggcaatatagtgatgctgctcgtcggccatgcggaacaggtgacgtttatcatactgatgcaacgtgccatccggctcaaccagcagaaaacggtttacggcgccctccgcggtatgaatggcggcgctgccgcccaccagcgcatcacagcgtcgcgcatgttgtcccaaccactcgaccacctgcgcctgcggtagcgccgactgggcggcttccatcgcaaagccggtggtaaacatttccggcagaataatcacatcccgttgcgtgaggttggctaagatccgatcgaaatggcgcagattggcctcgccatccatccacgtcaggggctcctgtagcagcgttatcgctaaagtcgacataaccgctccgctgctgcatcgagtgtggcttcctgtttcgcaaagcacagccggatgagtttgtgggggaaaggtccggcacaaaacaccgacagggggatcgccgcgacgcccacttcgcgcgtcagccactggcaaaactccacatcgttcagatcggaaatcgcgctgtagtccatcagcagaaaataggtgccttcgcacggcaacaggcggaaccgactgctgctcagcgcctgcatcaaccgatcacggcgcgcgcgataaaaatcggggagttcgcggtagtgctctggatgctggcgcagcatatcggcaatcgccagttgagccggcgtgttcacggaaaacgtcaggtattgatggatcttgcggatctcggcgctaatagcggcaggcgcaacgcaatagcccactttccagccggtcatgtgaaaggttttaccaaaggatgacaccgcaattgcacgctggcgcaacgcgggatgggccagcacgctggcatggcctgcctcggcaaagcagatgtgctcatagacttcatcgctcagcacgtagatttcccggtcagagatagcctgccacaacgcggcatagtccgcctggtgccagacgctggctgaaggattatgtggcgtgtttaaaatgaccaggcgggttttgtcacttaacagcgcggagaacgccgaccagtccaccgcgaacaacggcggctgcaacgtgatgcgtttcagcatgccgcctgccagctccaccgcaggcgcatagctgtcgtaactgggatcgaaacagatcacttcgtcaccgggccgcaccagggcggtgatggcggcataaagcgcttctgtcgcgcctgccgtcacggtgatgtcgtcgttaacgcaggggcgatagccgtagagcgcggcggttttatccgcaatagcttcgcgaagcggttgcgcgccggtcatgggcgcatactgattcgcgccctggctgacatggtaagccagtctctcctgcaggtaagacggaccgtcaaaatccggaaacccctgggaaagattaatggcattatgctgctgtgccagcgcgctcatttgcgtgaatatcgttgtgccgagtgcaggcagtttgctctcgggcgtcaggttggactgcgtcatgattaggtagccttacgcgcaaaaacggtagcggagaaacccttagttgatgccactataaacaggatgctagtatttggcaatcaagacgcttagacggctaaaaggaacggtgatgtccgattcatctgcagtagaaaacctggtggaagcctgtcactggataggcgcgaagggctgggcaccggccactggcggcaatatgtcggtgcgtcaggatgctcatttttgcctgctgagtgagtcgggcaaagataaaggcagcctgacgcgcgacgattttatccaggtcgagattgccacctgtcaggcgccttcgggtcgcaaaccttcggcggagaccgcgctgcatacgctgatttaccggttgtttccggaggcgggcgcggtgttgcacacgcacacggtaaacgccacggtgttgtcccgggttgagcagggcgcggccttgttgctgtacggttatgagatgcaaaagtcgctgagcggccagacgacgcatgatactaccgtggcgattccagtattcgacaacagccaggatgtggcggcgctggcgtcagagatcgaagattatgctgcccgctttccgttgcgctatggctttctgctgcgtggacacggcctgacctgctggggcaaagacgtcgctgaagcccgtcgccatctggaaggtctggaatttttatttgaatgcgagcgccaacgtcgcctgctggagaaagcatgataaaggccattgttaccgatattgaaggcaccaccagcgatatccgctttgtacacaacgttctgtttccctatgcccgtgcgcatctggcggactatgttcgccagcatcaggcgcagactgacgtgcaacaggcgctgaacgcggtgcgtgccgaagcggggcaacccgatgccgatataaacggcgtcattgatattctgttttcttacatggatgcggatcgcaaatcgaccggtttaaaggcgctgcaggggatgatttggcgagaaggctacctgaacggcagtttcaccggacatctttatcctgacgtgctgcctgcgctcacggcctggcacgcgcaaggtattaaattgtatatatattcctctggctcggttgccgcgcagaaattgttatttggctacagcgatgaaggtgatattactggtttgttcagcggctactttgatactcacgtaggtgccaagcgcgagatgacgtcgtatcagaacatcgccgcgcaaacaggcttgccggctgatcaactgctgtttctttctgatattcatcaggagctggacgcagcagagcaggccggctggcacacgctgcagctgattcgtgacgcggcagatgatgacagccatcatcgtcaggtcactaatttttcccagattaacccggagtcgatttgagatgagtgcactgaccatttttagcgatagcgatcccagccagccgatatggcacagcaccgatgccgaagcgattcgcgcgcggctgaatgccaaagacgtccgttttgaacgctggcaggccgaccgcgatctgggggaaaacccggatgcggaaacggttatcaatgcttatcaacatgccattgatcgcctggtggccgagaaaggttatcagagctgggacgtgatcagcatgcgcgccgataacccgcagaaggacgttctgcgccagaaattcctgtcggaacacacgcacggcgaagatgaagttcgcttctttgtcgagggcgcagggctgttctgtctgcacctcgacggtgaaattttgcagatcctgtgcgaaaagaacgacctgatctcggtgcctgctggcacaccgcactggtttgatatgggatcgtccccgcattttactgcgatccgcatttttgataaccaggaaggctggattgccaatttcaccggcgacaagattgcagatgcctatccacgactggcgtaagtaagccggtatcgttaagcgcgctgcttcctgtggggaagcagcatcgctcatcactgtggctgaaagaggccgtcctgaacctgctgtggggtgaccacgcccgtatccagtacccaaccgctgataagcgccgctggcgtgacgtcgaaggccggattgtatacccgggcatcggcaggtgcccactgcacgctaccgaagctaccagcaacgccggtgacttcgctggcggcacgctgttcgataggaatggctgaccccgtcggacacaggcgatccagcgtggtatgcggggcggcaacgtaaaagggaataccgtgatagtgcgccagcaccgccaggctgtaggtgccaatcttattggcaacgtcgccattggcagcaatgcgatcggcaccgacccagatggcatcgacgttgcccgccgccatcaggctggcggccatcgcgtcggtaatcagatgatagggcacgccgagctcgccgagttcccacgccgttaagcgtccgccttgcaacaaagggcgcgtttcatcgacccaaacgttacgaaccttgccctgctgatgcgcgcgcgcgataacacccagtgctgtgccgacgcccgcggtagccaggccaccggtattgcagtgggttaacagctggcttccgggtttgaccagcacgcttccggcttcagcgatgcgctcacagagctgtttgtcttcattaaccagacgcagcgcttcgtccaccaggctcgccaccctttcaggtttttccagcgcctgcttcatcctgtccaggttattcatcaggttgaccgcggtcgggcgggcggcgcgcaggatcgccagtgactgcgccagctgctcgcgcgtttcaccttgttccgccagtagcgccagcagcagcgaggcagacaagccaattaaaggggcgccgcgtacccgcagcgcatgaatgtgttcaaccaactgcgcgaccgaatgggcaggcagccagttttgttgctgtggcagggcctgctgatccagtatccagagctggttgttgcgaacctgtaagctggtggtttggaatgtctgcattcttggtgaattccatgttgcgttaatggcggatattgtgccaacatgcttaacggatgtatagacgtctgaacggcttattacgaaagattaatcaggtccggcttgcaccggcgtttgttgatgaggaaaggtcaatgtcgcaataccgtacattcactgcagctgacgctgtggaatatgccaaaacgtttggcggcatggatgatccttctgttttatgcagcgcggaagagatcggcgatggtaacctgaatctggtcttcaagatttacgacaatcaggggaaaagccgcgtcgtggtcaagcaggcgctaccctacgtgcgttgtgtcggtgagtcgtggccgttaacgctcgatcgcgcccgcattgaggcgcaaaccctggttgagcactacaaatattgccctcagcacacggtcaacgtgacgcattacgatgcggaactggcggtgatggtgatggaagatctctccagccaccaaatctggcgcagtgagctggtcaaaggcgcgtactatcctgaagcacctcgtcagctgggtgaatacctggcccagacgctgttccatacctcggactttattctgcacccgcaccataaaaaagccgaagtggcgcgctttatcaacccggaactgtgcgaaatcaccgaggacctgttcttcaacgatccctacactgaccatgagcgcaacagctatcctgaagcgctggagccgctggtcgcctcactgcgcaccgacgacgcgttgcgtattgccgttgccgggcttaaacaccgtttctttagccatgccgaagccttgctgcatggggatatccacagcggctccatctttgtggctgacgggagcctcaaagcgatcgacgctgagtttggctattttgggccaatcggcttcgatgttggcaccgcgctgggtaatctgctgattaattactgcggtttgcccggcctgctggcaccgcgcgaagccgttgatgcccgcgagcagcgccttagcgatgtgcgtgatgtctggaatacgttcgcagcacgtttcctggcgctggcagaaagcaagacgcaggatgtagccatggcttatccaggctatgcccaggcgtttctgcgtaaagtctgggcggataccattggctactgtggcactgagttgatccgtcggacggtgggtatgtcgcacgtggcggacatgaagcttattcgggatgatgagatgcgcaccgattgcattcgtaatgcgattacgttgggccgcacgctgattctggccgccgggcacgttgaggatgtcgaagcattgattgcccgcattcgtcaggcagggtaaaaaaaaggccgacatgatgtcggcctgatggattatgccgcctcgctggggagggcgggcttagagacagcctgcttggccggaacggccagcgcatcagcctcaaactcatccacgttaatggaacgcagacggctctgctcggcgcgtttcaacacctctgcttctttgtcgtcaatccagcccttctccagcgcctgttttgccagtgcatcaagtcgggtgaacgagaagtgttttttatgctgtttgcacaggcggtcgtgaatcacttctgccgccatcacatcctgcagtgcctgctctaactgacctgctgggttatgctggctcggttccagatactgaccgcgacccaggcgcgagcgcgttgcggaaggcacctgcagcatttttgccagtttatggtcaaggcgatcggatggagcagggcagtgctgaccaccggcgaacaccaccagtcggatcaccccagccaccagacgattcgggaagttgctcagcagatcgtccatggctttttctgccttattcagcgcatcctgcacgccccactgcaccagcggtaaatccgcctcgtgacgcccttcatcgtcataacgtttcagggtggcagatgccagatagagctggctcagcacatcacccagacgggcggacatgcgttcgcgacgtttcagactgccgcctaacaccgccatagagacatctgacagcaacgccaggttggcactgatgcggttcatgtgctgataatagcgacgcgtggcatcgcgggtaggcgcagcgctggtgcgtccgccaagcaggcccagccacaggctgcgcatcgcattgctgcctacgtgaccaatatggctgaacagcgctttatcaaaggccgcaacatcgttgctggcagcggcagccatttcctgcaggacataaggatggcaacgaatcgcgccctgaccaaagataatcatgctgcgggtcaggatattcgcgccttccaccgtgatagcgataggtgcgccctgataggcacgcgccaggaagttgctgtcgcccagcatgatgcctttaccgcccgcgatatccatagcatcgatgatcgactgctgggcgcggtgggtacagtggtatttcacaatggctgacagcacggcgggtttctcaccctgcataatcccggtggtaatcagcgttgcggctgcgtccatcacataagcattacctgcgattcgtgccagcggctcttcgatgccttccattttgccgatagacagcttgaactgacgacggatgtgagcataagcaccggtcgccagcgccacacttttcaggctgcccgttgagtttgacggcagcgtgatgccacgaccgaccgacagacattccaccagcatccgccagccctgaccggccatttccgggccaccaatgatgaaatcaataggaacaaaaatgtctttgccacgggttgggccattctggaacggcacgttgagagggaagtggcgatgaccgatttccacacctggcgtgctggtcgggatcagggcacaggtaatgcccagctcctctttctcgcccagcaaatgctctggatcggagagtttaaatgccagacccagcacggtagcgataggggctaacgtgatatagcgcttgttccaggtcaggcgcatgcccagcacctgctggccctgccactcgcccatgcagaccacacccgtatcgggaatcgcaccggcatctgaaccggcttccgggctggtcagcgcgaaacagggaatttcatctccccgggccagacgcggtaaatagtggtctttctgtttttccgtaccgtaatgttgcagcagttcgcccgggccgagtgagttaggtacgcccacggtaatcgccagaatacccgatacgcccgacagtttttgcaacacgcgcgcctgtgcataggcagagaattccagcccgccgtactcttttttgatgatcatggcgaagaagcggtgctctttcagatatgcccacagttctggcggcatatcagccagctcatgggtgatctggaaatcatttgccatgcggcaggcttcttccactgggccatcgataaaggcctgctcttccggtgtcaggcgcggttgtggatagttatgcagtttctgccagtcgggtttgccctggaacagatcgccttcccaccaggtggtgcccgcgtcaatcgcctctttctctgtgcgtgacattggcggcatcactttctggaagcgttgcagcatcggttgggaaaacagtttgcggcgcatactggtcaggttcagcggcagcagaataatcgccagcggtaacagcagccagggcgtccaaaggtgggccgccgccatcgctgcagtccacagcaggagaattgcgctgctgaggggcagagagaggcggtgataaaacagcgcgccaattagcaccactgtcgcaagaatcgagacaaccatcataatgaagtgctccgttaagtagtaagaggtctgacctgttatgagtagaggtgtaaatcagatgctggcatttatcaatttttttacatcgcaattacaacctgactcacaaaatcagccaaacagcgcgttggatgaaaacagcaggcgcgaaaaaacgctgggcatgcggtatctggctgtgtggtgctttgcgcgcgtcagccattccgttaaacttgctgcgattaacctcccctacaaaggacaagtctatgtatcaggacattattcgttcagagctgaacgaggctgcagagacgttgaataactttttgagtgacgacgcgaacattcacaccatccagcgggctgcggtgatgttggctgacagctttaaagcgggcggcaaagtgctttcctgcggcaacggtggctctcactgtgatgcgatgcattttgcggaagaactcaccggccgctaccgtgaaaatcgtcctggatacccggctattgccatttcagacgtcagccatctttcctgcgtgagtaacgattttggctatgaccacgttttttcccgttatgttgaagcggtagggcgcgcaggcgacgtgctgctggggatctctacctcgggtaactctgccaatatcatcaaggctgttgaagccgcgcgcgcgcagggcatgaaagtgatcaccctgaccggcaaagatggcggtaagatggcgggcagcgcggacattgaaattcgtgtaccgcattttggttatgctgatcgcattcaggagatccatatcaaagtgatccatatcctgatgctgctgattgaaaaagagatggtcaggtaacagcacgactggcctcctggtcgacaggaggcgttttgacataaggcggttgctatgtgcgaattgctcgggatgagcgccaatgttcccaccgatatttgtttcagttttaccggattggtgcagcgtggcggcggaacagggccgcataaagacggctggggcattacgttttatgaagataaaggctgccgcacctttaaagatcccttaccgagttttaattcccctattgcgcgtctggtgcaggaatatccaattaaatctcattcggtcgtggcacatattcgccaggcgaatcgtggaccggtctccctggagaatacgcatccgtttacccgggaattatggggccgtcactggacttatgcacacaacgggcagcttaaaggctacaggcaactggagaccgggacgtttcgtccggtaggggaaaccgacagcgagaaggcattttgctggattctgcataagctggccacgcgctatccacgcacgccggggaactggcctgcagtctttcgctacattggggagctggcgggtgagctgcggcagaaaggcgtatttaatatgctgctgtcggatggtcgctacttaatggcattctgctcaaccaatctgttttggattacccgccgtgcaccttttggtcgggcgcagctgcttgatcaggacgtggagattgatttccagaaacacaccagcgcgaacgatatagtgaccgtcattgccacacaaccgctgacgggaaatgaaacctggcaccgaattgtgccaggcgaatgggcattattttaccttggagagcgccaggaatgactgggatgccgcttcaggttgggtgatcaccgggctgctgttcatcacatatctgccgctggtcacattcacggtcggcggctgatgatactgcgcaaagtaggtgtagccgggctgaagttgcttccagaaatccgcataggtggaatagcgatgacgctgcatattgctgtcggtcatgcgaaacggataaatggcaatattcacttcctgctgaccattacgtaatgccgcattcacataggtgaaaatctcatccatataggcattggtcatggcatagcagccgatagacttacagtcgccatgaatcattaaatagttaccgctgtagccctggtcgcgatcgtattgattggggaagccaatattaatcgcgcgatagaaacggctgtccggctttagctgattcatttttacgctgtaaaaaccttccgggcttttaaaatcgccttcacgacgttttggccccaggccgccagaaaagttgcagatgcgataggtatccagtaagcgatattcgttgccaatcttgccgtacagctcaagggtacgctcttccttgaagatctgaatataaaccggcgtaccgattaactgtttctttaattctttgctcaccggcgccagtggctgaaccggctcaggagtcattgccatgctgagggctggcagtaaaatcatcgcaaacagaagtgcgattttgcccatgctgtgtacaccttgaagtgaagaagaacaacggcgcgataagtgcgcctctgtttgcattatcggaactttccgctaccgcagcgcaacattaaacattgtgtgtttttttagcaatacagcgcagagcaaaatgtccatttctttgacggaatagcgccgaaaatttgtaaagtttgttagcaactgcaagaaatattgcacaagcctctttggactgtatacttatccagtgctggaggggcgatgcgtaagatcattcatgtcgatatggactgcttttttgccgcagtggaaatgcgtgatgacccttcattgcgcgatattcccatggcgattggcggcagccgcgatcggcgcggagtgatcagtaccgctaactatccggcacgcaaatatggcgtgcgcagtgcgatgccaacgggcatggcgctgaagctatgtcctcatctgcgtttattacccgggcgctacgaagtctacaaagaggcatccagccagattcgcgccatcttttcacgttttacctccctcatcgagccactgtcgctggatgaagcctatctggatgtcaccgacagcacgcactgtcagggatcagctacgctgattgcccaggaaatccgcgccactatctatcgggaaacccaactcacggcctctgcgggcatcgcaccgattaaatttctcgccaaaattgcttctgacttaaacaagcctgatggccagtttgtcattactcctgcacagatgtctgattttttactggcgttgccgttggcgaaaattcccggtgtgggaaaagtgtcggcaaaaaagctggaagagctgggattacatacctgcggtgatgtgcaaaaagccgatttggcgttactgcttaagcgcttcggtaaatttggtcggatcttatgggagcgcagccacggtattgatgaacgcggtgtggtggttgaacgcgaacgtaaatcgctgggcgttgagcgcacgctggctgacgatatcgacagttgggaacgctgcctggagattattgattacctctatgccgagcttgatcggcgcttaactcagatacggcccgataagcatattgcgcgtcagggagtgaaactgaagttcagtgactttcagcagacgacccaggagcatgtctggccggtgctgaataaagacgacatgattgccgtggcgcgtaaaacctgggatgagcgccgtgctggacgcggcgtgcggctggtgggattgcatgtgacgctggtggacccgcaactggagcggcaactgctgctgggattataggggggggccgccgttggcggggatggggtttgctttggttctgcccggctggcccgggcgatgcggttttgctctgagcatgttccgcctgcgaggcggttgggatacggttttgccgctgagcatattctgcgcggccgggcgctacggttttgcactgagtatgttccgcccgccaggcgtccggcagccgtcgctgtcccttcgtcactcactgcggcctgacggaccgtccggatgcgccctccgtggcgcagccgtcctcgtcgcggcgtccctgccgcgccgtcctggcctccgttctctcctcagcgcgccggatgcctccagcaaaccctcgcctgtgagggcgtatatttttcccaaagaccggcttcgcctgttattaaagggatacagtggaagtctgatgaaacaaaaatgggctgtgatgcttttctggcatctgaagcgacgcggaaagtagttttggcacaggtatcaaagcgggggagtgggccggccttcccgtcccgctgagcggatgcaggatttccggatgagccgacaggacgtcggcgaaagccaggccgcgccagggatggcgcgtcctggcggtccggcagaaatcctgaagccgcgaagggaccgcgcagcggcgggtgggcaggacgggagcccggggtcaaggggccgcggcgactggcggccccttgtcggtcgcccgcacggggcggactgaaactgcccgccgcctggcgagcgaaaccttcccggagctttatgactgaacgccgctcaggctggcaacccggcaacccggcagcccggggtcaaggggccgcggcgactggcggccccttgtcggtcgcccgcacggggcgggctgaaactgcccgccgcctggcgagcgaaaccttctcagagttacatgactggatgccgcccaggaaggcaaagccatgttcatgcaatgaacgccgccgcccaggccaccatccaaagccacgttcatgccatgaacgccacccgcccaggcgccagcccttacttcttatattttgcttccagcgtcgcaaaccatggctggacgaaatcctcattactgccccagcctggaatgattttgttcaacgacgctacgttcaccgcaccaggatggctgttaagcgcctgctgagaaatcgaagcggctttaaattcataggtagctggcgtggtttcaccggcaatcttgtttgccaccaggcgcatattgacggccccgatggttttaggatcgaccgcgacagtctgtacccacgggctgcctttctgacgcatcaactgcaagtcctgattcgagacatcgatgctgtacagtttgatctctgtacggccattttcctgcagcgctttgtaagcgccctggctgaacgcgtcccatgcaccccagatggcgtcaatcttgcctttagggtatttcgccaggatagcgccaactttattggcggtgtcgccctgaacatccgttgataccgcgccaatcgactcaagttgatgaatgccagggttctctttcagcaatttctcataaacaacctgacgacgttccatcggcgggaaaccggcaacccataatttaacaatgttggctttgccgttgaaatccttgattaactgtcccagcgacaactgggccagagacgcatcatcctgcgcggtgaccgtgacacccggaatcgggttgtccacgggcgtatcaaataccgataccttaatgccggcgtccgcaatgcgttttaccagcgcactggcgtacggcgctttgccgtgggacagcacaataccgtcgtatttctggctgatcgcctgattcacgaaatcctgaaagcgcgcatcgtcgccgttgctgagaaacgtactgactttaaagcctaactggcggccttgctgaatggctcccgcaacaaactgtgtggtgttgtcgtctgagccaaggttacggatgacggcaatgcgtatcgggccttcatggttagcgatagcggcaggaaccggcgtgacggtgtcggcaaacgctgcactggcgtttaacaggctgaatgccagcagcgagagtgttatctttttcattattcttaactccagttggggatgcgccttagcggcgctgtacgtaagtgatagccagtgctaatgccagcaccagccctttgataatgtccatggcgtaataggggaccgacagcatcaccagaccgttttgcagcacgccaagaatgacggcacccaccagcgtacccagcgcattcggcttaccggaaccggccagagaaaggccgatccaggctgccgcaaccgcatccatcagataaccgccacccgcgttaacctgcgacgatccgatgcgtgatgccagtaaaataccgcccagcccggctaacaatgacgcgatgacgtaggccagtacgcgataacgtgtcgtgcgaataccggaaagcctggctgcctcgggattaccgcccagcgcgtacatgcgccgaccgtgctttgtcaaagataatgcgagctgtgccacgaccgtgacgaccagcatgataataacgattgtcggcacctgacccagcaggttaaacgttgccggaattgtgccttcagccatatcaccgcttggcagcaccatattttccgtaatggagccaccaaaactgtaggtcattgccacgccctgaatcacaaacagggtggccagtgtcgccagcatgtcgggaatccgcagcaccacgatcagaaacgcattgaacagcccgaccaatgtacaaagcaccagcgtgatggcaatggccgccgtcgtatcaaagccgtaccagacgaatagcgaaatcaccagggcgttggccagtgaggcggtagaaccaacggacagatcgaagccgccgacggtcagcgaaacggatacgcccaccgcaatgacggttacgatggcgatggagcgtaaaatattgatgatattgttcggctccagaaaactgtcggaagccaaaccaaaagcggcgatcaatatcaccaccgttagcagcatgccccacttatacaggaaatcgaacagctgatggcgcagcgaggaagatgctggcttcagggataagtctttactactgctcacgcaggggttcctccggtggaatagagcaaaagtgtctcttctgtggcttgccgtccctctaactccgccacaatacgtccatcccagagcacacaaatacggtcgcataagccgaccagttcagaaaattcgccagaggcgtaaataatgcctttgccttcatgggcaaggttgctgatcagcgtgaacagctctgttttcgcttttacgtccacgcccttggtcggttcatcaaaaatcagcacatcggcgttattgcgcaaccatttgccaatcgccactttctgctgattgccaccagagagccgacgcagttgctgcgccgggcccgtggtacgcacgctgaggcggcgaatcaccgcttctgcccagcgccaggcctgacgatgaccaaacaggctccagcgggaaaagctgtcgtctgcgctgatgctgaggttcatcgccaccgactcatcaataaaaatgccttctttacggcgctcttcaggcaccagcgccatgcgctgttgcaccgagtcgtgtggcgatcgcggcttccagcgtttaccgtgcaactcaccgcgtgaaacgcggctcttactggcaccaaacagcgccttgcacagttcggttttccccgcgcccgccagaccggcaatgcccagaatctcgcctttatgcaaacgcagtgaaatatcctgcagcaggtgttcatcatgcaaaccgtccaccgccatgatcacgggctgcggctgaggtggacgccgcggtggatagatatcggttaacggatgccccagcattttttcaacaatctgctcaccgctcagcgccgccatcgggccgctttcaatcagtcgtccatcgcgcagcaccgtcaggcggtcgcaaatggccttcagctcgtggatacggtgagaaataaacacgacacctatgccgctggtttgcagacgacggacgacagcgaacaggcgttcgctctcgtgctggtcgagcggcgcagtgggttcgtcaagaatcagaaagcggcagtgatgggagagggctctggccagcagaatttgctgcttttccgccagcgagcagcgctctaccgggcgtttaacatctattgatgcatccagctgggccagcagatggcgagcccggcgacgaatatcgctccagcggaaaccgtgacctggctctgctaactgatccaacagaatgttttccgctacgctgagctgtggcactaatgccacatccacctcctgctgaacaaggtgaatacccaactgtttggcgtcccgcgggctgcgaatcgaaaccggtttaccgtccaggagaatctcaccgctgtagtgactatgtgcacctgacagcactgccatcagcgtggatttaccggccccattggccccggtcagcgcatgaatcgagtgaccttcactcagaaaatccaccgacgttaacgcggcaaatccgccaaaatcgatggagatgttacgcatctcaaggcgatttaaagcatgcattgcagggatctccattaaagtcactgaccacattttttcctgaagcatcaggcacggcaacagccgaaagcgcataagttagcacagaaacttattagccatccagacatctggacataatggcggctaaagctggttaagcgcagtaagttggtgatttagcggtaggaagcggcattcccccagcggattatgctgcgaatgactaaccgaaaattgttaagtcagtcatgcgctttcacgattcaagggagatttattgaatgtggcagacagggtaaggcttcagataaggtgttaacctgcagaacagggtgacagaaccggttatttcagtgcgtagacctcggctaagtcggccagatcccagtttccgcccgtcagcaggacgcagactttctcgtcgggtttcagactcaccgaacccgccagtagtgcaccgagaccaattgaggccgccggttccgcaattaattttgcatccctggcaagaacgcgcatgccctgaataatgtgttcttcatccaccagaataatctcgtctacatacttctcaataatcgggtagggattgcgtcctggtacgctaagtcttaatccgtcagcgatggtgttttgcagcggcagggaagtaggctgtttattgatccggctttgataatatttaggcgtcagggccggctcagcgccaatgactctgaccgccggacgggtttctttcagcgccgtggcgacaccagaaagcagaccgccgccgcccagcggcacaatgacggtatccacatccggtaaatcatctaatatttcgcaaccgatcgtaccctgtccggccatgaccatcggatcttcaaagccatgcaccaccgcatagttattggcttcggcaatttcatacacttctttccagcgcgaggcgttgtcgccatcaaacaaaataatctctgctcccagcgcgcgggtattctcgattttgatttttggcgtggtgaccggcaagaccaggacaacttttacacccagcattctggctgcgtacgacagaccctgagcatgattgcctgacgaactggaaataataccgttggcaaaagcctcaacgggcagggagagcactttatttagcgcaccgcgaattttaaacgcaccggtaatttgcagcgtctccggcttgagataaagctggcagcccacctgcttttcgattttatcggcgcgcaacaacggtgtgtgacgaatatgcgcagcgatacgctgttgcgcttcatgaatatcttgcagggtcggatactgatgcgtcatcacggttacctttatctgaaggaaaaacgttattcaaaaaatgcaaaatacgtaccgacacctttttcgagggcattgcggtaaattctaccggcggtcgtgttgtcctgtatggaaaggccggtggagtcaaaaaaggtaatttcctcctcgctttctctgcctggcttcttccccagtaatatctcaccgatttcagcatgaatgtcgttttcacggatgatattcctgttcagcccgtgccaggtttcacccttttgcgtgcactgagacagggagtccacgaccacttttacccggctgaaaatgtgaggatcaaattcctgtttaccctgctggtcggtgccaatggcgatgatatgtgtgccaggcttaatccagctggcttcgagcagcggccctttgccccgggtcgttgtaatcaagatatcggcttgcgctaccgccgcctggcaggaatccgccacagtgaccgggataccaaactcgctttcaatatcatttttaaaggccagccgggatgctggcgtgcggctccaggcatggatctcttcaatttgcataaccctggcgatggctcttacctgcatcctggcctgattacctgtgccaatcatcgtcaattttttggcgcttgtgcgtgccagtgccttcacggaaacggcacccgatgcgccagtgcgcagaccggtaatcaggctaccatccatcacgcagcacagcgcacaggtccgggcatcaaacaatattaccgttcccatgccgctcggcaggccatattccacagggttctgtggaaaggggccagaggaggctttcatcgaaatcagttcgttgcttttgtaataactggttttaaagtctatttccccacgcggcgcgggaaggtgcaaaccgatataagccggctgttccaccagattgctgttgaaggctttataggcttcttccaccgcatcaatcacgtcgtcggtgctgatgagctgactgacttcctgtttggtgagcaataacgtcttcatgcaccctctaatcacgttgtgaagaacggctctccggtacacagatgacctgatgccgttgtcagagaaaggttggctttgggacattattgcaccggcagcacgacagaaaatgtcaatctggggggcggataaacgctttttactgttttagcgggcggtggcgaaagctaatgcttagtggctggcgatgaaaggacgtcaggccgaaatagccgataaaaaaagggtttatgttgaacataaaccctcagagagattaacgcgcctgaattacttttcaggtatcacgttcagcagcgttgtcagcagtttccagtaaagccccacgctctcgatatgcacctgctcatcaggtgagtgagggccggtaatcgttggtccaatcgaaaccatatccatgtcaggataaggctttttgaacaggccgcattccagacctgcgtgaatcacctggatgttaggcgtcttattaaacagcgcgacataggtttcacgggtcagcgccataatcggcgagtccgcgtctggctgccagccgggatagccaccttttggcttcgtttgtgcgcctgccaactgaccgagtgaggtcagcatctgcacgacgtaatcacgcccggtatcgatcagtgagcgaatcaggcagttaatttctgctttatctgcctccatcgtgaccacacccacattcagcgaggtttcgaccacgcctttggcgacgtctgagttacggataacaccgtttggcgtgctgttcagcagattcaggaagcggtcacggctctctgtggttagcgcgtcaccctgatgggcaaccggctcgctgacaaaggcaatgttcttctcttttacgccgtgttcattttgcaacgcagccaggaagccggcggcggccgatttcaggctgtctactttgctgctgtcgacagacacggtggcaaaggcttcacgtgggattgcattacgcaacgtaccaccggtgaattcaaccagacgaagatccagctctgccgcatgggccgccaggaaacgcgccagcaatttgttcgcattgcccaggcccatgtggatatccgcgccggagtgaccgccacgcaggcctttcagggtcagcttcaggctttcgtgggaagccggcaccgcctcacgcgtcagcggaagcgtggtgacgaagtcgataccacctgcgcaacccatatagatctcaccttcttcttccgaatcggtgttgatcaaaatatccgcctgcagccagcctggctgtaagccaaacgcgccatccatgccggtttcttcggtcatggttaacaacacttccagcggaccgtgggtcaggctgctgtccgccagaacggccagcgcagatgccataccaataccgttgtcggcacccagcgtcgtaccgcgcgctttgacccactcgccatcaacataaggctgaataggatctttggtgaagtcgtgtacggtgtcgttgtttttctgcggcaccatatcaaggtgggcctgcagcacaaccggcgtgcgtttttccatgcctggcgtggccggtttacggatcagaatattgcctacctgatcgcgctcacaccagaaaccttgttctttggcccagccaacgatatagcttgccagcgcttcttcatggaaagagggatgcggaatagagcaaatcttagcgaaaatatcccacagtggctgtggagagagttgggacaattcagacacgacaagtctcctgtgtcagtgcgccggccgggccggacattgcgaagttccagtaaaagatcgccgtcagagaactgacgagatagggcgagaatatcactgtttctgactcggtgtgttattcaacgcgctaaaaaaccgcaaccagaagccaggtgctggtttttagcgcgtcatgtccttataatctcgcgcaaccttttccccgttgcacattttttaagccacactgactggctgggatacctatttatgagcgaaaaatacgttgttacctgggacatgctgcagattcatgcccgcaaactggctcaacgcctgcttcctgttgaacagtggaaaggcattattgcagtcagccgcggcggtctggtaccggcttcgctgctggcacgtgaactgggtattcgctatgtcgataccgtgtgtatttccagctatgaccacgatcaccagcgtgaaatgaaagtcctgaaacgcgctgaaggcgacggtgaaggctttatcgttattgacgacctggttgataccggcggcaccgcacaagccatccgcgaaatgtacccaaaagcccgtttctgcaccatctttgctaagcctgctggtcgcgagctggtggacgattatgttgttgatattccgcagaacacctggattgagcagccgtgggacatgggcgtggtttacattccgccgattgtgaaaagctgattgatgtaacacaaacaacgcccggttttccgggcgttgtgctttctacgcctcgcgacttgttttgcggtacagtacacttacttaccgctgttaatgctgtcagagaggtaacatgcctggcaaaaacctgagcgttgagctgttcaagcctcgttttaaacaccccgaaacctcatctctggtacgactgcgtcgtcacgccacgcatgaggtgcactccgccctggatggcgatagccagcgtggctggtatcgcatgcttaacaagttgatgtgggcctggcgtggtttgccatcgcaggaggtcagcgaggtgctggcgcgtatcgcaatcagcgacgctgagcacacccatccggcgctgctggatacggtcattggttaccgtaatggcaactggaatttcgagtggagcaggcaggcgggcttctggcagcagcgggcgcttgaggcgaacgaaagtgaacacgatcgggccggtcatgactggcttcatgcgtctcacctctatagcgtggcggcgtatccttatatcaaaggcgatgaactggctgatcaggcacaaacgctcgccagccgcgcttatgacgaggcaacccgccggctacccggagaactcaaaacgctgaccttccccattgaaggcggtagcccggtcagtggttttctgcacatgccgcctgctgtggaggcaccttatcccacggtgatgttttgtggtgcgctggattcgctgcaaaccgatcattatcgtctgttccatgactatctggcaccgcgtggtatcgccatgttgacgcttgatatgccttccgtcgggaattcaatgaagtggaagctcagccaggacaccagctttctgcatcagcaggtactgcgcgatctggcgtccgtaccgtggatcgatcatacgcgcgttgccgcgctgggcttccgctttggcgcgaatgtcgcggttcgtctggcctatctggaagcaccgcggctgcgggcggtggcctgtctggggccgattgtgcatagtctgctgacgcaggccacgctgcagaacaaggtgccggatatgtacatggacatgcttgcgagccgacttggcatgactggcacaacggacagcgcattacgggctgagttgctcagctactcgctgaaaaatcaggggcttctgggacgaagaacgtcaacgccgatgctgtctgcacactggccgaacgatctcttcagccccgaggaagagagcaaattaatcgctaactcctcgtcgcaaggtaaagccttgttaattcccgtaaaaccggtcatcgccagttttgataaagggcttaatgaaatctgcgattggctggcccagcgtttgaaaagatagctggcaaaatttacagtgtttgctacaactactagctggaatcattcggatcgtcaaaagagagtgcagcacggctgctacggttcggaatatcaagcctgtccttatggagaattagcatgacgttaccgagtggtcatccccgcagtcgcctgcttaaacgcttcacggaactgggaccttacatacgcgatggaaagtgtagcgaaacccgttttttcttcgactgcctggctgcctgcgtgaatgtaaagcctgcgcccgagttgcgtgaattttggggctggtggatggagttggaagcgcaagccgatcactttacctacgtttatcacatcggcctgtttgataaagaaggcgactggtcagttgccacgatcaaaggcaaagataacaatgcccgcgtggaagaaaccttacgtaatttccacggccgtttaaaaacgatgctgaaagagtttgaactggatctggtgccagccagtgactttgatgaaaaaccgataaaactcagcgcctgacatcaggcccctgcgggggcctttttttataggccgggcgggaacgtttgcctacgcatcgacgtgccggaaagcggacagagcggtgggacggaacacaaaaggaaagggcgagttttgcaactcgcccttttaacagacacattcacattgagggtaaagcactaagtctgtccatcacgcgggccgtcaatccctcgaccgtccctctcgtcaggcaagactcagattcatcagaactggtaagtcaggccgactgcaacgatgtcatcgttgttaagtgccagcttgttgtctttatccagttggttaattttgtaatcaacaaacgtcgacatgtttttgttgaagtagtaggtcgcgcccacgtcgatgtatttaaccaggtcttcgttgccaataccgttttcgatatctttgcccttggtctgaacgtaaccaatggatggacgcagaccgaagtcaaactggtactgagcaaccagttccaggttttctgctttgttggcagatccagaaacaccaccacccgcgacacggtttgttccgctgattggtgtcatgttgcgcgtttcggtgtagatagccgccagataaacactgttagcgtcatatttcagacctgtgccccacgaagtggccttatcgccgtgaccatatgtgcccgcctgctgtgcgttggtacggtcagaagaagtgatagcaccgagtacgctcacgccagaatcagcaatggtatagcccagtgacgcgccgtagccgtcaccattttgacgacttgtatcgatggcgttattcgttcctaagccacgtgtgttcgcgcttttatcgtcatttttaccctgatactgcagggcaaacttcaggccatccaccagaccaaagaagttgttgttacggtaggtcgctacgccagtggcgcgctgtgccataaagttgtcagtacgtgctgtgccatcgccgccaaattccgggaagacgtcagtcagtgattcaacgtcatacagcacgccatagttgcggccgtagtcgaatgaaccgtactgagagaacttcagaccggcaaagcccagacgggtcttgttgccgctgttcgcatcggagccttctgagttgttcgcgttgtactgatattcccactggccgtaaccggtcatcatatcgttaatctgcgtctgtcctttaaagccaatacgcacgtaagatttatcgccattagcaccggcattatcgctgaagtaatgctcagctttaaccttgccgtagaaatccagcttgttaccgtctttgttataaacttcagcggcctgagcagcagaggtcagggccagagcagataccacgattgccagtgtacttttcttcatttgctatcaatcccaatgagtaaaatttttttgtcctcaacgtcttcttgttacaggcatggctgcctttattctccggatgctcagtcaacaggccggggggcattcagttgccgccttgttacaacaagaaaacttttgaggcattaatgaaaaagtttgtaaaacacggactttttaccgatcaatgatgaactttttatgacaattttgatgttttgttgttaatggggaacttttggtctaattgacgctctgcgaaatttgcagtttttcccttacaggctgttggcttccctcactgcacctgttaaaaagtccgttcacagaaattttttacggcaggacaacatgagtggcagtcagacccttgtggtcaaattgggtaccagcgttcttaccggcggttcacgtcggttaaacagagcgcacatggtggaattagtgcgtcagtgcgcgcaacagcacgccgccggccatcgtattgtgattgtcacctctggcgcgatggcagccggtcgtgaacatctgggttaccccgaactgccgccgaccatcgcctcaaagcagctgttagctgcggtggggcaaagtcgtcttatccagctgtgggaacagctgttttccatctacggcattcatatcggtcagatgttactgacccgcgccgatatggaagatcgcgaacgcttcctgaacgcgcgtgataccttgcgtgccttgctggacaaccacatcgtgcccgtcattaacgaaaatgacgccgttgccaccgctgaaatcaaagtgggtgacaatgacaacctctctgcgctggcagcaatgttgggcggcgcggacaaactgcttttgctgaccgaccagctgggactctttaccgccgatccacgcaataatccggatgctgaattaatcagcgatgtccatatcatcgatgacgcgttgcgtgccctggcgggcgacagcgtatcaggattgggtacgggcgggatgtcgactaaactgcaggctgcagatgtcgcctgccgggccggtattgacgtgattattgctgcgggcagccgaagcgacgtcattagtgacgtaattgcgggcaagccggtgggcaccctgtttcatgctcagcaaacgccgcttgaaaaccgtaagcgctggatttttggtgcgccgccggccggtgagatcaccgtggatgacggcgcgcttgccgcgattattgagcgcggcagctcactgctgcctaaaggtattcgcgatattcagggcaatttctctcgcggagaagtgatccgtattcgcagcctgcaggggcgcgatatcgcccacggcgtctcgcgctacaacagcgacgcgatgcgcatgatcgcaggtcaccacagtcaacagatcagcgacattctgggctatgagtacgggccggttgcggtacatcgtgacgacatgatcgtcagctaaggaacgaatatgcttgaagaaatgggaaaggcggcgcgtgccgcggcctgggcaatggcggatctgtctgcagccgaaaaaaatcaggttttactgacgattgctgaccgacttgaagcggaaagcagcgttattttgaccgcaaatgagcaggatctggctgaggcacggcagaacaagatgagcgaggcattgctcgatcgtctgaccttaacgcctgcacgcctcagcgcgattgccagcgatgttcgccaggtctgccagttagccgatccggtcgggcaggtgatggatggcggtcagttggacagcgggctacggattgagcgccgccgggtgccgctgggcgtgattggcgtgatttatgaagcgcgtccaaacgtcaccgtggatgtcgccagcctgtgcttaaaaaccggtaacgcagccattttgcgcggtgggaaagagacgtggcgcaccaatgcggctacagtgcgggtgattcagaacgcactccagcagcatggtttaccggcggcagcgattcaggctatcgaaaatccggatcgcgaactggtgaatcagctactcaaactggatcgttatgtggatatgctgattccgcgcggcggggcgggtctgcataagctctgtcgcgagaacgcgaccatcccggtcattaccggtgggattggggtttgtcatatttatatcgatgagacgatggaaatcgcaccagcgctggacatcatcgtcaatgcgaaaaagcagcgccccagtgcctgcaactctctggaaacgttgttgattgacaccgctattgctgaccgtttcctgcccgcttttactgcccgcatggctgaagagaatatccctctgcatgccgatgccaatattctggcgcagctgcagcaggggccggccagcgttactgccgtgcaacagggcgactatgacgatgagtggttgtcgcttgatcttaacgtcaagcgggtcgcagatatggatgaggcgattgcgcatattcgtatgcacggcacgcagcattcagacgctatcctgacccgcagcacgcaaaacgcggcgcgtttcgttaagcaggtcgactcttcggccgtgtacgtaaacgccagtacccgttttaccgacggtgcgcagtttggtctgggcgcagaagtggcggtcagtacgcaaaaactgcatgcccgtggtcctatggggctggaggcgctgaccacctacaaatggattgcctggggtgatgataccctgcgtgcataacggtattttttaaacaaacgggggcccattcaggcccccgttttttttcatgctgcttttttccgcaccactcaatggtagagtttttccgccgttgatggctttttaagcggtggggattattttttactgcggggatgagtcggccgcggtgcaattttttacaaaagattgctgaaaggtgagacggtacgcggctttgcgccctgttttatggttcgctgtgcggtaaaactgcaaataataatcagaaatgcttagtaatgcggttaggtagtaaactggcggtaatataaaatgaactggtagcaataatgaaaataacattcagctcctcttcaatggtcgattattaactgatggttaaaaaagagagtacccgacaagctttcaccgccaggctgatagccgcttgtgaaagtgcgggcattacaggacacggacgcaacaaacaggtcgcctgtgcgttacaacgccagggttgtaagatttcagcgccgggcgtgtggaaatggtttaacgctcagtctgtgcctgataatggcaatttactggcgctcagccagctgcttggcgtgcgggtagagtggttgcaatatggtatggatcagcatccagaaccttacccgcttcacgacgtcccctgccaaaaaaacaccttccgcgtgaacagttttgatttagggcagaagtcaggcgcaggtctgcctgtgggggatgattttgtcgaaaccattcaggccatcgaatacggtcaggatgaagcccgcgtgttgttcagcggccgtccggcagatcatattcgattaattgcgatcaacagcgatgccatgtccgacacttttgcaccacgcgatcagctgtttgtggacataagcgtccagcagtttgacggcgacggtatctatatttttaccctggatgaacagctgtatctcaagcggctgcaactgcaacacaaaagaattgccgtcatatcagataataagcgttatgaaacctggtatctggacaggaatgaggcggggaatttaaacgtgctggcaaaagtcattatgagtcaggccgggcagtatcacattctgggatagacaattcagcaggctgggccacctgtaaggcaaaaaaataatcggtctaaattcaaaaagttaacttgtggtaaaaaataaattaaccagtggtgtttgataaagcataagaacctgttaataatttgaacatggatgaaagaacgtgttaccacatggatgaaacgctcttaaacaattgaggcgctgcacaagcgcgaatcaaaccccccaaaagccaatgagctttgggatggggtggatgcgcataatgcagcgtcgtcagatgccgcctgtacccttttgctgacccttccacctgactgattattcagccgggaggagagcctgtgaacaccattcagcgacattcgagcttgttcttcaaacccaaaacgctcgcctgccaccctatcgccaaagactcattcacaggaggagttatggcgataattcattatggcaaaagcgtttttatgggcaatgcacgtacccgccgccatcagcggcgtcaacctctcaaccgtcttaaacaaagcattgacgaagcacttaactacccacccgaaacgcgtcctttgcggcgtgctgaacaaatttgtcagcggcaggttaccccagcggtcgatcgtgctgtaaccgcgccgcgcctgagaaataaagacgtctcgggttttgataactgttgtctgccccatgttcatctctacgcggttcgctgaatcgtgtgaccgctgttgattcactgcctgtcgcaggtaacgccatccttccttcctgagcctgacctttgcgcaaatgctttagtgctgctgcacctttaatcgcaattcccgctgcgtttatctctggcactaatcagtttgttttatgttttcccgcacgggatgggttgcctgcacccttactaaggagtttttatgagccagattattgcaattctgaattttgaagaaggttacgctgaaatgccttatctcgacaccctggggttccccacggtcgccgccggcatccggattggccctaaaggcgcatcgttaagcaattatgtcctgcgggtgccgcgccgcgtaggcgatgtctggaagcaatgcattctggaaaacaagatgacagatatgcagagtcgcgctcccctgaaacaggtgctggcaaagtgcaatgatgcgcgtaccgacgtgctgttgagcatggcgtaccagttgggcgttgatggggttttacagtttaaaaatatgctcagcgcaatcgctcgtgaacactttacggaggcgggcgatgccatgcttaacagcctgtgggcacggcaaacgcccggtcgagtgagacgtcatgctgacgttatgcgcagcggtaactatgacgtttatcgggggctgttatgagatggctgttttttattatcgcggtattagttgtcgtgattattctgctgttaatgcagcgcttcaccacgctgcagtttgtttctcacgccaaattgttatttaaaacctggtctgtatggttggcttcgctggggtcaatgctcagcgcctgggttcagtcatttccgtcgtctgcgctgaatgcctggcaaacgttgcctgacgatgtgaagagcatccttccccacaattaccttggtctcatcggcgccttcatggtggcgatgggcgtcatcgcgcaatttgttcgccagaaaaacctgctgaatgaaaagcgccccagcaataaggagacatcatgacgtttatttctctgtttaccagcggctggcacgggctggcggcgatgggtgcactgatcatcgccgtcgttgccagctacgtgggaggtaagaagatcggcaaggtgcaacagcaagcccggtcggaagccgacagcgccaggcaagaggcaaatcgcatggcgaatgttactcatcaacagcaacgcaatagtgaggaggcgaagcgtgtggcgactgataaccttaatcttgatgacgctgctgctcgcgacaagctgcagcagtccaaataccaccaaccttaaacctgccacctacagcgattcagcctgcattctcttttcccccatctacacccatggcgatgacgctcacaaagcagatattcgcaccgtgcgcgccattaacagccacaacgatttatgggatgtcctgtgtggtcattccgctgccgaagattctttaactttctgatttacagcctattatcctgaggaggatatcatgattgaagttaactcatttgctgagcttcgtacgaccatgccgtcaaaaccaggtgaaattgccgtactgaaacgctactacgataaagattccagctttcgtggcggcggcgattttgtgggatttaccggcaccacgattttaaaagatgatggcggtacggtagccataggaaacggcttctactggaaacgttcaatcaacgatccgcgagaagtgaacatcctgcattttggtgcaaagggcgatggcgtcacggatgacaccgatgcgtttaaacgtattctcggctggtcacaaacttacagccagaatatgaagggattgccggtacgtttccctggcgggcgtttcctgattatgcccatggacttgagtgagacggaaatccccttctttggtctggccggggacgatctggcgctgggttctctgcccggcaccaccatcgtgtcagataaaagtgccaataccctgttcaaagttcaggctcggcgtaccaccattcgcgggattacctgggacggacaggccagtgccgatactgtcaccaacacggcaaccattacccctgaaatgtgcagcaatgttcaggcgttttttgaaaacagttgtatggcagggcaaatcgttaatatcagctgctttcgggggcagcgcagcggcggaaccatctttaagctgcaggacacgctcgacagtaagtttgagcaaatctataccaataccacctactcgcgcgttttcgatatcggctggtcaggttcacccaaaggcgtctgggatcactccacagccattgagttatgtaatgccaatttccagacgggctatggcgatgccacgctgtatatgccgcgcatgacgcaggcgatcatgcgcaacgtatggatcgaacatacgcgcaatcccggcgatttatccgatggcggctggaccattgatacgctcaatgtcgagaactgtagtgcgcctttaatcctgaataatgcacgtgtggtaatgcgtcatattaacctgcagtcaggctccaaactcagtcaggatctggtcggggggaaatggctttccacctttgagtatggttaccgccgtgacgagaactacggcacctttatgagtggttcgctgcgggcagggtactttagcggctacaaggtggtgaataacaccgagacggataactggtaccgtttaggtcaggtgttttttccgtcacccaatcagcaatgggtcattgagttgatcggtaaagcggataacaccacgccttcggggacagcaggatcgcccatcaacatgcccggcaccgggaagacctggatcaacctgcaacgactggatacggtctgggctgatgcctgtcatatggggcagccagcggttattgatatccgttacaaccgggtgggcaccacctatgctggcgtgtgggttaagctaagagccaacagcggcgaaaccatgtttaacctgaaaaccaccggaccaacgcgctttgatacgggttcctgttccctgtttcaaagtgatatgtcgctggttgatgacgtatcgaaggtgggaacgctcaagccagcggcacgctttggattgcacaatggcgtggcagggctgggagccaatgaaaaaggcgtggtgaccctcgctaccgcggtgggcacaccgaccaacaaaacgacgccgaccggttttgtgctcatcaatattaacggtaccgatcgtaaggtgccttattacgattaacgtcggcaaccctacgcgaggcttcggcctcgctttttttttgcgttgtgcccagcattgtgcggctcccaggcttctcttcactgtgagcactatctgagagtgtgccgcagatagcgtaaaacagcttctgcacccgttttaatcaacactgcgatcgggcttaaaaaatagaatattgcgctgcatcaataaccatacagagacaatggttttcggggctaaataaccttatagtctgtgcaactttttgttgttgttcttttactctggaggctacatggaactcagccgaagaaaattcttccgcatctgcgcaggcggcctggccggaaccactgttgcatctctcggatttttatcctctttctctttgcaggcagcaacccgtcaatacaaactgataaaagcgaaagagacacgcaataactgtacctactgctctgtcggctgcggcatgttgatttacagcctgggcgacaccgctaaaaacgtgagagaacgtatctaccacgtagagggcgatccggaccatccggtcagtcgtggctcgctctgcccgaaaggggccggtgtactggattatattcacagtgaaacccgtttgcagtaccccgagtatcgtgcgccgggatcaaacacctggcagcgcatcagttgggatgaggccatcaaccgtattgcccgtctgatgaaggacgatcgcgatgcgaattttattgagaaaaatgctcaaggcgtcacggttaaccgctggaccacaacgggcatgttgtgctcctcggcggccagtaacgagacgggcatgctcgatggtaagtttgcccgcagtttaggcatgaccgcgatagactgccaggcacgtttgtgtcatgggcccacggtgtctgcgctgtctccaacgttcggccgcggcgccatgaccaataactgggtcgatatcaaaaatgccaacgttgtgctggttatggggggcaatgcggctgaagcgcatccggtggggtttaaatgggttattgaggcgcagactaaaaatgacgccacggtgattgtggtggacccgcgtttcaaccgaaccgccgccgttgccgatgtctatgcgccgattcgcgccggttcggacaacgtgttcctgcttggcgtcatccgctacctgattgaacatgaccgtattcaacatgaatatgtccggcattacaccaatgccagcctgctgattcgcgatgattacgcctttgataacggcttgttcagcggttttgacgcggataagaagcagtatgataaatccagttggttctatcagctcgatgaacagggaaatgcgcgacgggattccacactgcgtcatccgcgctgtgtgtggaatctgcttaaaaagcacgtcgaacgttatacgccagagatggtgaatcgattatgtgggacctcagtcgcagacttcacccgtatctgtgaaatgctggccagcaccagcgtgccgaatcgcacagcaacgatattgtatgcgctgggatggactcatcactcttccggtgcgcaaattatccgggcggcggccatgttgcagctgctgctcggcaatatcggtatggcgggcggcggtattaatgcgctgcgcggtcactcgaatattcagggctacaccgatctgggattgctgtcgaccaatctgccgggctacatgcctctgccttcagagcatcagccagattatcagacctatatttcacagattacaccgcctgcactgggggttaatgaggtgaactactggcagaacacgccgacgtttttcgtcagtatgatgaaaagcttctggggggaacatgccactgcggaaaataactggggctatgactggttgccgaaatgggatcgtctttatgatgtgatgacgcaggccgaattgatgctggagggcaaaatcaacggctatattgttcagggtttcaatccgcttgctgccttccccgataaaaacaaatcgtctcgcgcgctttcaaagctcaaatacatggtggtcattgatccgctggtaacagagtcctccaacttctggcaaaaccacggcgaaatgaatgatgttaagccagagacgatccagaccgaagtcttccgtttgccgtcatcctgctttgccgaagagaacggatcgattgtgaattccggccggtggatacagtggcactgggcggcggcagagccaccgggcgaggcattacatgatggtaaaattctgggacggctctttatgcgattgcgagagctttaccagcaagagggcggggctaatccgcagcctttactcaatctcaactggaattataacgatccctacgatccgcatcctgaggagcttgctcgtgaggcaaatggtatggcgcttcaggatctgtatgacgcagagggtcggttaatcgcgaaaaaaggggagcagctcagcagctttgcccagcttcgtgatgatggatctaccagcagttactgctggatctactgcggcagctggacggagcagggtaaccagatggcgaatcgcgataacagcgatccttatgggctgggctgtacgccaggatgggcatggtcgtggccagccaaccgccggattctgtataaccgggcctctgccgatccgtccggtaagccctgggatgcaaaacgcgcactgctgcactgggatggtcaaaaatgggcagggatggacgttgcggattacaacgcgtctccgccagacagccatgtcgggccatttatcatgaacccggagggcgttgcacgcctgttctcgatcgacaaaatgaatgatggcccttttccggagcattatgagccggttgaatcacccattggaacgaacccactgcatccagcggtcatctccagcccggtagcgcgtattttcagtgacgatatcgccaatatgggcaaagccgatgcgtttccctatgtcgccaccacctattccattaccgagctgttccgtcactggacaaagcacgcccggcttaacggcatcgtgcagcctgagcagtttattgagattggcgaatcgctggccaatgagaaaggtattgccgcaggggacatggttaaggtgatgtctaaacgcggctatatcaaggcgaaagccgtggtgacaaagcgtttgcagacgttaacgatcgacggaaaacgtgtagataccatcgggattccctgccactggggatttgaaggtgcaacgcgcaaaggctttctgtccaatacgttgacgccatcggtgggtgatgccaactcacatacgccagaatacaaagcgtttctggtcaacattgagcgggcgtaaggagggaacccatgtctatgcaatctcaagatattattcaacgctcggcgaccaacagcttaacgccgcccccgcaggcgcgggactttcaggccgaagtggcaaaacttatcgacgtctccacctgcattggctgcaaaggctgtcaggtggcttgctcagaatggaatgatatccgtgatgaagtcggtcactgcacgggtgtctacgataatccgatggatttaagtgcaaaatcctggacggtaatgcgcttcagcgaaactgtgcaggagggcaaactggcgtggttaattcgcaaagatggctgtatgcactgcgcggaaccgggctgtctcaaagcctgcccttctgctggcgcgattattcagtacgctaacggcatcgtggattttcagtctgagcattgtatcggttgcggttactgcattgccggttgcccgttcaatgtgccacggctgaatcccgatgataatcgcgtttataagtgcacgctctgtgtggacagggtgagtgtgggtcaggaaccggcttgtgtaaaaacctgcccgacaggtgccattcagtttggcagcaaaaaagagatgttgagcgtggcagacgcgcgcgtggcacagctaaaaaaacgtggctatgcccatgcgggtatctataacccaccaggcgtcggggggacgcacgtgatgtatgttctgcaccatgcggacaagccagagctttaccaccatcttcccgccgatccaaaaatcgctacgccagttaatgtatggaagggcgtgctcaaaccgctttccgctgcgggatttattgcgacctttgccgcgcttatttatcactatgtgggcatagggccgaataacgagacggataatgaagaggagaacgatcatgagtaagcgcaacatgatcctgcgtacccgatttatcgaccgcgcctgccactggaccgtggtgatcagcttttttctggttgcgctttccggccttgggctgttttttccaacactacagtggctcactgcaaccttcggcacaccgcagatgggacggattttacatccgttttttggtgtactgatcttcgtgttgttgatggtgatgtttgtgcgctttgttcgtcacaacatcccagacaggcaggatatgccgtggataaaaggcattgtcgaagtgctcaagggcaatgagcacaaagtggccgatgtaggtaaatataatgcaggccagaaaatgatgttctgggccattatgtctttgatcgtggtgctggtggtgacgggcattattatctggcgaccttactttgcggcgtatttccccatcacggttatccgctggagcctgctgatccatgccgcagccgcgatcgtgctgatccatgccattttgattcatatctatatggcgttttgggttaaaggctcaattaccgggatgattgagggtaaagtcagtcgtcgctgggcgcggaagcaccatccgcgttggtatcgtgaggtggaggcgacggagaaggcggcggtggagaccgccaggcggtgtcgatagcggttttgcaatggttctgcccgcgaggcggtggggacaccgttttgcactgagcatgttccgcccgccatgcgtcggggagtttcagcctgtccgtgcaggcggtcgggttaaggggctcgcgccagccccttaacaatcccggcgtccggcagccgtcgctgtcccttcgtcgctcactgcggcctgacggaccgtccggatgcgccctccgtggcgcagccgtcctcgtcgcggcgtccctgccgcgccgtcctggcctccgttctctcctcagcgcgccggatgcctccagcaaacccccgcctgtgggaacctgttctttatttggtgcggctttgcctgaggatttgcattgaatgggttttgcccgccggggggatttgtggttttgcactaagcatattctgcccgccaggtgccggggatgcggctttgctctgagcatgttccgcccgcgaggcggtggggatacggttttgcactgagtatgttccgcccgccaggcgtcggggagtttcagcctgcccgtgcaggcgttcgggttaaggggctcgcgccagccccttaacaatcccggcgtccggcagccgtcgctgtcccttcgtcactcactgcggcctgacggaccgtccggatgcgccctccgtggcgcagccgtcctcgtcgcggcgtccctgccgcgccgtcctggcctccgttctttcctcagcgcgccggatgcctccggaaaaccctcgcctgtgggaacctgttctttatttggtgcggctttgcctgaggatttgtattgaatgggttttgcccgccggggggatttgtggttttgcactaagcatattctgcccggcaggcggtggggatgcggctttgctctgagcatgttccgcccgcgaggcggtggggatacggttttgcactgagtatgttccgcccgctaggcgtcggggagtttcagcctgtccgggcaggcgttcgggttaaggggctcgcgccagccccttaacaatcccggcgtccggcagccgtcgctgtcccttcgtcactcactgcggcctgacggaccgtccggatgcgccctccgtggcgcagccgtcctcgtcgcggcgtccctgccgcgccgtcctggcctccgttctttcctcagcgcgccggatgcctccagcaaaccctcgcctgttagggcttatatttttccgaaatactgcttcgcctgttattaacatgcgtaatcagaactgaagacagggaaacctgacgaaaatgaaaaaatgaacagcaataagctgtgatgcttttctggtatctgaagcgatgttttctgacatctgaagcgatacaggcgttggttttcacacagttatcaaagcgggggagttgggccggccttcccgtcccgctgagcggatgcaggatttccggatgagccgacaggacgtcggcgaaagccaggccgcgccagggatggcgcgtcctggcggtccggcagaaatcctgaagccgcgaagggaccgcgcagcggcgggtgggcaggacgggagcccggggtcaaggggccgcggcgactggcggccccttgtcggtcgcccgcacggggcggactgaaactgcccgccgcctggcgagcgaaaccttcccggagctttatgactgaacgccgctcaggctggcaacccggcaacccggcagcccggcagcccggcagcccggcagcccggcagcccggcagcccgggggcaaggggccgcggcgactggcggccccttgtcggtcgcccgcacggggcgggctgaaactgcccgacgcctggcgagcgaaaccttctcagagttaaatgactggacgccgctcaggctggcaacccgggttcccgcatggagctggctgaagctctctactgcctggcgaacgcaaccctctcaacgctaaataaaggcccaccgctcaggtgatcaggcaaagccatgttcatgccatgaatgccgccgcccaggccaccatccaaagccacgttcataccatgaacagcccccactcaggctaattcccccactatttttgcctgaactggctcgcatcaatggcatagcgtttcatctttcgccacagggtcgtgcgtccaatattcaacagattcgacatctcctgcacccgaccgtgggtaacacgggcggcatgaataatggcttctttttcaatcgcgctaaacgataaattatccggtaataacgaagaggacgtttcgctataaggctgttcagcgaataaagactcaggcaggttactcaaccgaatgtgaccgtgctcgctactgatagcgatattctcaatgacgctgtttaattcaaaatcattacccggccagccatagttgactaaccttgccatcgcgtcgttatcaagtttaaaccgggatgaaaactgtttttccagtcggcgcaggcggtgagtgactaacgtgggaatgctgttacgccgcgcccgtaaaggaggaataacgatttcaaacgaatgcagagcgtaatagagctggcggctaaaacgattttgttccacccgttgtgctaaatcgaccgacgtggtggcaatgatcttcacatcaacggggattaaccgctgtgcctcaagacgcgtcaaaaccccttgcttgatcacctgtaaaagaatcgattgcaaggcaggagccagatactcaattttatccagaaacaacgtaccgccgtgtgccagctcaagacgactcagccgaccattttcctcctcgctgggcgcattaccgataaaatcctttcccaacgtgctgtcggcatataactgacagttaacggcaatatagggcccgctcgcccggtcactttcgttatgaatagcctgactcagcagctctttgcccacgccttcttccccactcagcagtacgggaaagctgcctttggcggcctgacgaccaaaatgtattaaacgccgcgtgtccgcatcctgttctggcatctgttcaaaagtgtggctgacttttcccagttggcgggtcatgagttgacgaacctgctcaacagggtggagcagtaaaataaagctgttgccctgaacttcaacaataggcttcagagtaatcaccgcatcaacaaactgatgctggctctcaaaggtgacttccacatgctttaatccctgcgcctgcttaattgcccggcgcaacagggcgggcagagtaataaggtcagcaatgttcctcccctgactgcttaaggcatccagatgcagcagccgggctgcctgtgcattcagaaattgcagaacgccttgctcattccacgccataacaccatcatccatgctctccagcaggccataaagctggttcagatggcggttggactcggctaataaattgtccgttaatagcgaattacccacttcccgggcgatagacagcgtgagggaaagatcagaggacgcctgatcctgacgcagacaggccagcgcgatagagccaaataaacggccatgattatcaaatatcggggttgagcagaaagaccaggcatggagcgcccgtttaaagtgatgttcgccgtgggtttttactggctggccttctaaagccgccagcgacagggcgcaggtaccaatgatgctttcagcacagtagctgccgtcgtgcagacctaatgcctcaagctgcatcagcgtctgtgcatcaccacagcggttcaaaatacaggcggattcatccaggataaacagggcacaaggccggttctccatgtactcccacgcatcctcaagtgttgcctgaccaagggtgagtaaggcagttttgcgccgacaaattgattcgtaggttaatccctgtgcctgatgtggcgtttgccagttaccccgctgcatatatttactgcaacgctgccatgactgagtgatcaccgcagaaacgtccttatcgctatcgggagttaacgctgtcatatccatttccgctaaaagaccatagaaaatccccttagcagacgcggctaaggggaagttggtgcccttactgattgggccagcggtttaccggtgacagattaacgcgacagccactgctgtcccagcaggtcggcagtgataatcgccgcataaacgctgtctggtgtaaccgggaacggcatattgtggatggtttccccttccacacaggccgcgtcggcaaccgcccgaatttttctctcgatatcctgtttcacgcccatctgccccagggtaacaggcagtcctactttctggcagaaggccagcacggtttcgatctcttctgtcgggctgttctgcaaaattaactgtgacagcgtaccgaaagcgaccttttcaccgtggtaaagatgatggcactcctccagcacggtaaacgcattgtggatggcatgcgcagcggcaaggccactgctttcaaagccaataccgctaagataagtattggcttcaacaatacgttccagtgcctctgtcactacaccggcctgggccgcaaagcgtgccttttcgccctcagccagtagcgtgtcatagcacagtcgcgccaggcttaatgcggcggcggtggatttgccgcctgccatgctggttgcgccagagtcataacacgcttttgcttcaaaccaggtcgacagggcatcgcccattcctgctaccagtaagcgtaccggtgctttagcaatgatcgtagtatccatcaccaccatatcgggatttttggggtagatcagatactctgcaaactcaccggtttcggtataaatcacagacagtgcgctggtgggcgcatcggttgaagcgatagtgggaatcaccaccacaggcagtttgagataccaggcaatcgccttggcagtatccagcgttttaccaccgcctaagccgatcacgccacgacagccgttctgttctgctaacgccatcaggcggtcgatttcagttcggcaacattccccgccgaagcgctctgcatggcaactgacgtcatggtcggcaaggccgctcaagaccttatcgcccgccagtttcattacaaaatcatctgcaatcacaaaaaaacgatcggccagatcctttgcatactgaccaaaggacagggcggcattgggtccctgaatatatttggctggagactggataatttttggcattcctttcaccctcaagtaagaacatgttcgcatggtgtacgctggcgtctctctggcttaactggacatgaaagccggatgatggccgacgtcgctactcactctacgatcgacggtggggtgaaaaagttttgcgggcaacgttcttatatggaacaccttgccgccctccatgtttcatactggaacaataaaccacggtaaaaagtgatgttgcgatcgggatcgtccccggcaatgttaaaatggcaaaacgataccgcgataagcgcggttaaaacgccaatgtcatagccagcccaaaaaatcgtgcttagtcagtgggatttgcctgtcaccacgggaatcattacctgctttgcctctcatttttacccgatagccgcgcatgatgtttcattatggaacataaaaatcatcatattgttccgttatgaaacccttctggctgacattttttttatcctgaactccctgagaatcagtgcatcgacgagcggcctcccgccgtcaggatttcccaacaatcgggttgtctttgcctcaggcacagacgacagcacaccgcctccgacggagcatgaataatgaaaaagctgattaaccgagtggaagatgtattgagtgaacaacttgcaggattggcgctggcccatcctgaactgacgcttcatcaggacccggtatgtatgacgcgagccgatgcgcctgtggcaggcaaggttgcgctgctttccggcggcggcagcggtcatgaaccaatgcactgtggttttattggccatggcatgctgtccggtgcctgtcccggcgaaatctttacctcgcccacgccagacaaaatgtttgagtgcgccatgaagattgacggcggtgaaggcgtgctgatgattatcaaaaattacactggcgacatcctcaactttgaaacggcaaccgagttactgcatgaaagtggcgtaaaagtgacgacgatcgttgtggatgatgacgttgccgtcaaagacagcctgtatacggcgggacggcgtggcgtagcgaacaccgtgctgattgaaaaactggtgggggccgccgcagagcgaggcgattcacttgaggcctgcgctgcgctggggagaaaactcaacaattgtggtcattccattggcatcgcactgggtgcctgcaccgtgcctgccgcaggaaaacgctcgtttgaactccaggataatgaaatggagtttggtgtggggattcatggtgaacccggtatcgatcgccgcacctttacttcgctggataacaccgtcgatgagatgttcgaaactttgctggagaatggcacctacagccgcacattgcgtcactgggatttaaacgccggcgcctggcaagaggtgcagcaaagtaagcaggccttgacgcgcggcgacaacgtcattgcgctggtcaataacctgggcgcgacgccgctgtcagaactatatggtgtttataaccgcctggcgcaacgctgtgaagaacatggcatcactctcgcacggagcctggtgggcagttactgcacgtcactggatatggtgggcttttccatcacattgctgagtgtggatgatgattctctggcgctgtgggatgcgccggttcatacacctgccctgaactggggccattaaggagttcgacatgtcacttacccgctcccaaattgtgcgttggctttaccgttgtggcgaggtttttacccgcgaaagtgattttcttaccggcctggatcgcgaaatcggcgatgccgatcacggcttaaatatgcatcgtggcttcagcaaggttgttgagaaactgccttctattgaagataaagacatcggttttattctcaaaaataccggtatgacgctgctctcaaacgtaggaggagccagcgggccgctgtttggtacgttctttattcgtgcggctcaggttacccaggcgcatcagagcctgacgctggaagaactgtatcagatgatacgtgagggcgcagaaggggtgatcaaccgcggcaaagctgagccgggtgataaaaccatgtgtgacgtctggctcgccgtggtggaatcactgcgtcagtccagtgagcagaatgtgtcgctgagtgcagcactggatgccgcctgcgaacaggcagagtcagccgcccagtccaccattacgatgcaggcccgtaaagggcgcgccagttatctgggcgagcgcagtattggtcatcaggaccctggggcaacctcggtcatgttcatggtgcaaatgctggccgccgccgccagggagtaaggagaagcgaatggtaaacctggtgatcgtgtcccacagtgcgatgttgggggaaggcgtagaaatgctggcccggcaaatgttaaccggcgataagtgcaagctggccgtcgccgccggcattgacgatcctgatcatcccatcggcacggatccgctgaaagtcatggcggccatcgaatctgttgcggcggataccgatcatgttctggtgatgatggatatgggaagtgctctgttaagtgctgaaacggcacttgatctgctcgatcctgccatcgctgccaaagtgcgcctgtgtgcggcaccgctggtggagggcacactggcggcgaccgtcagtgctgccgcaggtgccgacatcgataaggttattgaggttgccatgcatgcgctggaggctaagcaggcccagttgggcataatccccgccgtgcacaccgccacactgaccacaacggctcgcgatccggatgcccgttcggtcacggtcatcatcaagaatcatcatggcctgcacgttcgtcctgcctcacggctggttgctgccctggcaggactcaacgcggaactcgtattagagaagcagggccagtgcgttaaaccagacagtatcaatcaaatcgccttgctgcaggtgcgctgtaatgatgccgtcaccttgtcggcgagtgggcccgatgccgaacgcgccctggcggcgtttgcatcccttgcggcggaaaactttggcgaacatcccgagtcgatgttactaaaaacatcggcctccgccatcgaaaaggtcgagggtaaggcggtgttttatcccttgccgctggcgcagcctgccaggtatcacggcagcgatgtcggggatgagcatcggcggctgcaacaggcaatcgcggctacgctcagcgacctgaatgcgctggctacactggcagagaaaaaatatggttcgtcggtggccgctattttctcaggccaccatacgttgctggacgatgacgacctgtttgacgctgcctgtgaggtcattcgcaacgaccagtgctgcgcggaatctgcgtggtatcaggtgcttatggaactgagcgagcaataccagcaactggacgatgcctacctgcaagcgcgttttattgatatcgaagacatcctgtatcgtagcctttgccatctgaaaggcagtgacatcaggctgccgaccccggacgtcccggcaattattgttgccgacaacatctttccttctgcggtcgtcagtctggatgcgcgacaggtaaaaggcatttgtttgcgggaaggcagtgcgctttctcatgctgcgattattgctcagcaggccgggatcgcttttatctgccagcagggcgcggtactggatattattcagccaggggacaggctaatgattgatgccgatggaccgcgcgtgagcagcttatagctcggtttttatttgcctctgatgcgtgcctcaggggctttattttatttggctgtcactcaaatttttagtcagatttctctctcccgtccttttaaattcaacgcatccctttacgttctgacgcatttttagccagtaatcactcgatatttcaagcagaaaacataaataaatgtattttcatcaatgcatctcaggcagcggttgcctgtaaatttcatgtttatttttattggggaataccagggagggctgcattttagttaaccggtgcggcaaacacccagcaaaccacaggtaaaaacagcagcagtggaggcggcattggtgtcacggtgggcaaccatacacagcttaacggtgcggtcatcgccagtcaggccgatgcggataaaaaccgtctggatacgggtacactgggctttaccgatctgcataacgaggccgactacgaaaccgaacaccagggcataggcatgagttcaggtgccagcttgggcggtcagtttgccggtaatatggcaaacactatgctggcaggtgcaggcgataaaggccatgctgaagggactacccagtcagctgtggctaacggtacgatagtggtgcacgatcaggctgaccagaagcaggataccgccacgctgagtcgtgacacggcacatgccaacgacagcatcagcccgatctttaacaaagagaaagaacagcaacgactgcaaaccgcgcagatgattggcgagattggcagccaggtggcggatattgctcgtacacagggcgagattggtgcgctgaagaaagcccagacggtaaaaggccccgcacgcgtctgagaaagagcggaaagcttatattaagagccttaaagcgacacctgagtacaaaaaagcaatcgctgactccggcaccggaagttcattacagcaggggattctggcggccatcgcagcagtgcagggacttgtaagcggagattttaaagcagcattagcaggcgcatcagcaccctaccttgctgaaatgattcctaaaatgaccacaatcacaggcccggatggcaagcaagtggtgaataccgcagtaaatcagatggctcatgcggttgtgggcgccgtcattgcacaggctcaagacaatagcgcgctgtccggtgcaagtggcgcagcgctgggcgaatttatcgctcaggagatgtatccgggtatcgcgcggacggatttgaatgaaatgcagaggattgcctgatggcactactgtaataattaaatctaacagcacaaaggaccagaaatgaaacatgcaactgaaaatttattatcaatatgtagcgggcagatttctgattcatatgcagatataaatttatcaatttctgatgtagtactgtaagcacacccgttttagttccacgcactttttgaggtttccggttttacggccatcagccggtactcctccggtgtcaggttattcagggattcatgaggccgctcgctgttgtattccatcagccagcgacttgtgatttcccgagcttcattcagcgttctgaacaggtaaaaatccaggatttctgttcggtacgtccggttaaaccgttcgataaaggcgttcttgcgttggttttcccggcttgataaattccagcatcactctatgctcttcagcccactgtgccagcgtcagtgagaccagttctggtccgttgtccatccgcagtttcagtggataaccccggtttgccacgattctgtccagcaccctgaccacccgctgtgccgggatattcagatcgatttctatggcgagggcctcgcggttaaagtcatcaaccacattaaaggtccggaagcgtctgccgcagaccagcgcatcatgcataaaatcgatggaccagctctggttaagcgcttccggcgtagccagtggcgccgggttacgcgcgggtaaacgctgttttcccttgcgacgaaaattcagtttcagcaggcagtaaatccggtgaacgcgtttatggttccaggtgttaccctgcctgcgcagcagctggaacagttttttgaagccgtatcgcgggtagcgctctgccagctcagtcagcacctggatcaccggttcatcacgccgggtatcgggctggtaaaaatagaccgtcctgctcagcgataacgtcctgcaggcctggcgaatgctcatggtaaattgcgcagtcaggtaaccgacgagctcacgctttatcgctggttttaaagctttttttcgatgacttctttaagtgcccggcattcaaggctgagatcagcaaacatctgtttgaggcgacggttttcatcctccaggtctttcatcttttttatatcagaggcttccataccgccaaacttcgctttccagttgtaatagctggcttcagagataccggcttcacggcagacatccttaacggtacgtccggcttcgacggacttcagaacggcaatgatctggtgttcggtgaatcgggctttacgcatggtgatctcctcacaggacataatcagtatgtcggaagatctctaaaagcgaatggttcggtttaccgggatgcttacagtaccagttgtcaatgagttacatgagttactaaacatcaaaaatggattttatggctttgagtctgcgttacatgtttatccctcacaatcaataggttcagaaattggtttgattgagtggaataaaaaatatctttggattgatgcatatgagaaccttgcttcggatagtattttttttgcagaggatttgtttggtggacagttttgtttaaaaaaggatggtgtttactcctttgatccagaaacagcattaagtgagaaaatatccgatgacctagagggatggtgcgatgcgattatcagggattatgatttcatgacaggttatacactttcacatgcatggcaacagaaaaacggaaggcttttaccgggtcatagactaattccaaaaatcccgtttgtattaggtggggagtttgatataaataatctatatatggaaaagtcagattatgctatgagaatgagagcaaacatagctttacagctaatgaatttaaaagatggtgaatccattgagctaaaagggatttgattttgtattaatttaaatttttcaaataataaatttttgcgtgcacgacattatcgttaatgtgcagaaaaatatgtcaaaaattggctaaaaaccaaaaggtttttatctcaaaccccgaaccgagcgagccgtaacatctcttatatatgactttgcgaaagaatggcaaagcagcatcgttgttaaaagttcagcactacgtagactcagcaccaacacaaaaccccaccatcccaacacccattttaaaacctccccaccacccgctccctcaaccacctatgccccaaatcccggtgcgatcgctcatgccacagcatcaccagctcaaagcccggaatcgccatcggcggtagcacggtcatcaatcccggcatcatcgccgccactctctctggcatcaacgccaccaaatcgctggtgcttagcacgctgcccatcagcaaaaagtggggcacagacagcaccactttccggctcaaccctctggcttccagcacgctatccgtcaccccgcgaaagccgccgccgtcggacgataccactacatgctccagcgcgcagagcgcttcggcggtgatatcagagtgcagggcgggatgaccctgacgtcctgctacaacatagcgttcctgaaacagcgggcggatatgcagcccgtctggcacgccgtcacgcaaatgaagcaccagatcgaccgtgcctttttccaactgctgggcgatcaacgcgggtttcatatccagaatggcaagccgggtgccaggtgcgtcctgacgtaatgcagccatcaggggaaccagtgcagtttgggcaccgtaatccgtggccgctacgcgccactcctgaacggcgtcggcagggataaacgggcctggcgcagcaatcacctcatcgatcatgccgctcagttgcgccagcgaaaggcgtaacgcctcggcgcgcgcggtggggcgcatgccgtgagataccggaatcagcaggggatcgttaaaccactcacgcaggcgctcaagccgggcactgacagaaggctgagaaagattaagccgctgcgcggtccggctcacgctgttttcctgtaacagcacattcagggtcattaacaggttgagatcgggtttcatggtatcagtcttgcctatagtgaatatccattcatttacttttactgatagcacattcggatgcaggctacatctcagattcccatcaaagcaggtgattttatgaatgtgttaatcgttgttgcccatcccgaacccaattcccttaacggcgcgctggcgcgtttctccgtcagccacctggagcagttgggtcatcaggtgcgcgtttccgatctctatgccataaactgggaggcgcgcgtatcgcccgctgatacgcagcatcgccagaatgccgaacggtttgatccctcttttgaatccacccaggcttttgaaggcggcttccagagtgaagatattgtgcaggaacaggaaaaactgttgtgggccgatgcggtaattttacagtttccgctctggtggttttccatgccggcaatcatgaaaggctggatcgatcgtgtttacgcctgcggctttgcctatggtgtgggggagcactcagatacgcactggggcgaccgctatggcgaaggtacgctggcagggaagcgtgcgatgctggttgtcacgatgggcggatgggagtcccactacagcccacgcggcatcaacggccatattgatgacatcctgttccctattcagcacggcatcttgttttatcccggttttgacgtcctgccgccttttacgctttatcgcaccggccgcaccgacagcgcgcgctttgcagcagcgtgtgcagaactgggcgagcggctggataatctgtttgtgaccgaacctgttgcctattatcggcaaaacgacggcgattacacgataccgtctctgactttgcgtgacgatctcgccgccggtgaacaggggcaccaggttcatctccgcaaacagtaatagacgattgggtcagattgccgctcgcgggctcgtctggcccaccttcatttttttcaaaataagccttgcatgcatcagcaggatatgacctaatgaatcgtcggtttgattaacagacactatcaaagtaagtaaccaaagcagttctcatctctaagcctgtcgcgagacattccttctttttgagtcttctcttacgttctgattaaaatctgttctcaggccattacgccggaaggctctattattaaggaattaaacatgtctaacaaaatccgcggtaccgttaaatggttcaacgcagagaaaggcttcggtttcatctctcctcaggacggcagcaaagatgtattcgtacatttctctgcaatccagggcacagatttccgttcattagatgaaggtcaacaagttgagtttacagtagaaaatggtgccaaaggcccagctgctgcgaacgttgttggtctctaaggactgaaaattacgagttttaaatgtcctcactgtagtggctcgcagtacagaaaatcacatttcgatgtgacaagagccaacccgcatggagcgaaatgcattttttgcaaaacgatcgttgttcaaatcaacacgaccaggattgcagctcagagtcagccacaggcactctgaaaaggctaaagagctctatagcgttgttgcatttaccgtaataagaggctgccattggcagccttttttatttcccttctgacccctttcccgctgctatttactaaaccatcagggcaagaacgccgccccaaaacagcagacaaaaaacaacagccgcaatccaactcaactgacgtgcacgcccgcgaaacaagggcttacgagcaacgggtagcgcttcactatgcatatttatattctcaagtggtggatatcaagcctcactgggcaggggtaagctgcccgttacgtcttagctcgcggcttccattgctttaaaaatcacgtcagacagctcattcagttcaaacttagcgacatagccatcggcacccactttgcgcacgtgatcttcgttcgcgctgccagaaagtgatgagtggatcaccaccggaatatggcgcagtgtcgtatcgcgcttgatgttacgtgtcagcgtaaagccgtccatctccggcatttccagatcggttaacaccaacgcaatcttgtcatggatggattcgccctgcgcctgagcctgctggtgcatctctttaattttttcccatgcttcaaggccggtattacacatgatggcaggaatgcccatgctcttcaggccctgctccagcaactgacgggcaactttagaatcttctgccacaatcgccactgaacccggcttcattttgaactgacgctctttaggcgcttcaggctcaacgccgcgcaccgaggggatgatgtcatacagaatttgctcaacatccagcaccatagccagattgcttttttgttcatcgtcatcaaggcaggcgatactggtgatattacgaccaccgatcccggcttccgccgtatgcacctggctccagttaaggcgcacgatgttttctactgactcaacggcaaacgcctgggtgttacgcgcgtactcagtcaccagcagcaggttcagccccgtttctggaacacagcctgctacggcaggtaaatcaatcaccggaataaattgcccacgaatgctggccatgccgagcaacggtgaacgcatgcctgctgctttggtaatcggcggcatcggtacaatttcacgcaatttaaatacgttgataccaaacagctctgatttaccttttaactggtcagagcccaggcgaaacagcagcagctcaaatttgttcgatagcgcgagattcgctctctcgtcgatctctttctgaaaattatccattgttgcctcagcatcagcgcagcaggtgaaaaggggtgtgatgaagttatcggcagcaagtgaaaaaaggtgagaggggaaaatccaacagcagcatattattcttgtgccaggcttaacagtgataactaaacatggacacctttccccttaaaggagtacgagatgaagaaagtgttactggcaacgctgttggtgatggccacttccggcgcatatgcagaacaaggcggcttcaaagcaggcgatacgccgccgccacagaacaagcaggatgcgggttataaaggttcggaagatacagggcaaacccacatcgatcagatccgtgacttccgtcagggcggttatgtgacgctggaaggctatatcgttaaaaaattaaagggcgataattatcagtttcgtgacgaaaccggccatttgaccattattgcgccgaagaaaacgttcgatggtaaaacctataccgctgacgacaaggttcgggtgagcggcaaggttcatgggaaaggcgataaaacgacgctgcacgtaacgcggattgatgagccataagtcagagtaagggcgagagtgactctcgcccatttttttagtcttttaacagcacagcccgacaggttttacctttaattttaccctgcttaagcttcaccagcgcgtttttagcctgagccgcttctatcgcgacgtaagcgtgggtaggcgtgagatcgattttaccgatttgatcggcacgataaccggcttcccccgtcagcgcgccgagaatatcgccgggacgaattttcgctttacgcccaccatcaatgcacaacgtcatcattgcggcgggtaatggctgactgcttttcttcagcgaactggcggcaatccagggcagtttctgttgcaggaagtcttcaagtgcgtgcgcgcgcgccatttcatctgcggcaacaaaactcacggcagcgcctttttcgccagcgcgtgcggtgcggccgatacgatgcaagtgcacttccgggtcccatgccagttgatagtttaccactagcgacagtgacttaatgtccagcccacgggctgcaacatcggtggccaccagtacgcgaccactaccgttagcaaaacgaatcagcacccgttcgcgatcgcgttgctccagatcgccatgcaggggcagggcgctgatatcgcgcgcattcagcgcagcggcaatatcgtcgcattcacgttttgtgttgcagaacacgacgcaggaagagggctggcgttcgctcagcagactgatcagcagcgagagtttttcatcgtggctggcctcaataaactgttgttcgatagccgggagttcactcacttcttctgtgaccacgctcagcgcttcacgctgaaagcgctggctcagggcggcaatcccttccggccaggttgccgaaaacagcaacgtctgacgcgaagcgggcgtggcagcgatgatggtttccatatcgtcgcggaagcccatttccagcatacgatcggcttcgtccagtacaagcgtacgcaggctgtacagcttcagcgtctcacgcttaatgtggtccagaatacggcctggcgttccgacgacgatatgaggcgcatgcaccagcgaatcgcgctgggcgctcattggctggccgccacataaggttaaaattttaatgttgcgtgtaaagcgggctaactgcctcaggacgttactgacctgatcggccagctcccgggtggggcacaaaattaacgcctgcgtctgaaaaagagcgctgtcgatatgttgcagcaagccaatgccaaaggcggccgttttaccgctgccggtttttgcctgagcgcgcacgtcgcgtccggctaaaatagcgggcagcgtttcggcctgaaccggtgtcatgctggtatagcccatctcgcgcaggttatcgagctggctatcgggaagagaattaagcgaggaaaaagcggtcacgggtgcggcctctgcggctaaaagtgggggcatcattgcgtgtgcaagtctgtcagaaagcgagcacaacggcaacgttaactgcctgaataaataatatccatttcaccccgcttttttttaggaataaactgaagattacgtgcgttaggtggattattttaatgaatggctgcggaaaaaaaagccaaaagggaagcctgataaacgtctgagaacgttaataaattcataatcttttgtttataagagcgaatattgaggttatcggagaagcccgtttttttcgcattgaaaatagcattaataatgtaacagtatgggcttaaacccctgtaaaaatcattcattaactcctttatattgagcaacatagatcgatataaccactggcagagggtttttcattgaataatatcccgaagatattgcatgaagacatacttaaaatcgttggtcgtgctgtcctgacattgcatctttatggcgaaagcttatcggctgataaggttgcctccatgatcgaatgttatgccgaagacgatcccgttgcccctgacggcgcgcatctgtatgcgctggccatggagttgatgtcaaagaaaagtgaggcaagccgggtttaacatcgctgtgcctcagatgtctgcgcctcactttaagcaatagcgttaaagtgaggcgcatctgcgttacacctgctgttgcataaacaggggttttccccgcgagaaggtcgccgtaacgggcgaaatccgcgctaccgcctccgctgaacaactggcctgaaccagcatcatatcggcactgtctccgatgcggggccattgacgttcgccactggcagagagaggaagcacgtcattggtggcaatcgccagggcgcgactcaatgagaactcatcagaaccgccgtacaactgggcatagagattggccttttccagcatgctgcctgtgccaaacggcgaccagtgatcgatcacgctgtcggtgccggtcatgacttttatccctgccgcctgtaactgcggcacgggcatggtcagcttgccgatgggcagcgtggaggcaatgctgaactgctgctccgccaggtcggcaatcaggttatcccgttcagcgccctgtaaggttgccagtgcaaaaccatgactgagggtgactttaccgcgtaagacgggattctcccgcacggttttaatcatgtaacggatagcctgaacgccagcggcagaggtttcatgcaggtgaatatcgacgccacgctggtagtcgagcgcaatctgaaacagggcatccagggatttctccatcgcaccatccacattcgtgggatcaagaccgccgacatagtgcacgccacgttgcatggcttcacgcatcagcccgtcgacctgagaatgcagcagtccatgctgggggaaggcgacaatctcacaggggaaatcgggatgcagtgccagcgcagcctgtaaatgttccaggctcttgagaccactgaccgggtcgatattacagtggctgcgcgcccgggtggtgcccctggaattcagcagggcaataagcccttcggcccgcgcctgagaagtgggcagcaactgtggaatcagcacctgctcacgggcaatcatgtccataatcgttttgcctttacgcgggcgaggtgcctgccaggggcccccataaaaggttttgtcgagatggatgtgcatatcctgcgtggacggcagcagcagggcaccctgcgcatcccagaacggcaatgaacgcgtaccttgcccggccgggctgaactggtgaaagtggccatcgcgaagggtgatgtcgtagcgcgctgttttcgttgcaacaatctcgctaccttcgcgtgcgaaaccctcttcgagcaatacattgcctaaaacatagtggttgctctggggcaacgcgccaggtgagaggacgggcgttgcgttagcgttggcggcaacaccggaagccgcgatcccggcgatgatcatactcatactgctggcggcggtcaggcgaaccccctgacggagaaagcggcggcggctggtggaagaggcggtctgcatcagcgattcctgcgaaagtaagtgaaggcttaatctgacaaaccgcggctttctctgctgaggagtttttcactgcctgctatttaaaaactcactgccagctcaggccggcgaaatcggccagagcgttggccagctggcgctgaaggccatcttctggctgacggcaaaacagcgccagctcaaaggtatcgattaccggcaagccctgttggctgccgagcacccgatgcgaaggtaagcgacaactggccggtaacagcgttatccctaagccctgcgcgctggcggcggacagcgccaccaggctggcgctgctgtaaccaattcgccaactgcggccaagtaaatccagtgtctggcagatttcctcccgatacagccccagttgcggaaacagcactaagggaatgggggactgttcgaagcagggatgggcagcgctgtccagccacagtaacggctccggtcgggaagccagcgggcgttccccgtagggctgtttgatcagcatgatatccagctcttcccgttgccaggcacgacgaagttctacctgcatcccgctcatcacatccagccgcaggtggggatgctcgcgactgaacagcgccagtagcccggcggtgggtgcagcgaaatcctccggtacgcccagccgcaggacgccatcgcgccacttatcgctcagcacatcgtgggcttcaccgttcagggcaataatccggcgagcataacccagcaatttttccccttcttcagtgatctgcacctgatgggacgagcgtgccagcaaaggcttgccgaccatctcttccagccgccgtacctgttggctcacggtcgactgtgacaggtgaacccgttcagcggcgcgcgtaaagctggcggtttcgcatacggcgacaaagctcagcaattgctgaggcgtaaacatgggctggcgattcatttttccactgcctgtcatcctgatatttcatttccaaatagtaatggctgctgtcaggctgacaatgtttaattccaggattgcccatgaaaaaagatcacttattacttattgccgccctgatactggcgggactgaacatgcgtcctctgatgacctccgtcagtccgctgctggatgagctgcgtgaaaacattggattatcatcgctcgccgcctcactcctgccagctattccgatgatgatgatgggcgccatcgcgttagtgagcgcgccgctcctgcaacgtatccgactgcgtgggctgctctgtggcgggctggcgttgctggcgctggcgctggccagccggttttttatctcgcaaggccagtggctggtatggagcacggtccccggtggtatcggcatcggcattgtacaaatggccatgccgggtttgattcgccagcgctttgcgcagcgcagtgccatgatcaccgggctatgggcggcggcattaatgggtggcggtggactgggcgctgcgctgacgccatggatcagcctgcatctgggctggcacggcgcgctcagcagctggtctgcgcctgcgctgctggccgttatgttctggtggtggattccggcggcgtctccgccaccgcagacatcgacagccatgccatcagtctggcgcaatacgcgcgcatggatgctggcgctgagttttgggttagtgaacggcggttatgctatttgtgtcgcctggttgcccgatttttatcatcaactgggctggagcgcccaggcgggcggcggcctgctgggcgtgatgattgcctgtcaggttgccggtgccctggtgtttcccatgctggtaaagggggcggatcgacgaccgttgctcctgctgacgctggtattacagcttggcggtatgctcggtctgctggtggcaccgctctaccatccctggctgtgggcagggatagcgggcattggcctgggtggcgcattccctctgtccatggtgctggcgctggatcacctggcgcatccgcaggccggtgcgcgtctggtggcatttatgcagggtgcggggtttatcatcgcgggcagtatgccttttcttgccggacaactgcataacctgacaggccatttttccagcatctggctgctacagggcagcgtaacggtgatcctgattggcctgaatctgcgttttcacccccgaagctaccaacaagcctttccgcagcactaattggtcctaccaacccggcaaaacgttttcagcggctcacataacgttaaaaatagtgccgcaactgttgcctagagttaacagtgggttaagtatctgtaacgagcaaaccctgatcgcctgattggtaggaccaattggtgcatcagaggtgacagatgcgccacccgcctttgccgatcgcgcatcgctttcatcatcccatggagataatggcatgcaggtctggcaacaacattacgatccgctcaacaacatctggctctccagcctgattgcattgcttcctgttttgtttttcttctttgcgttaatcaagctaaagatgcaaggctatcaggccgcgaccatcacggtcatccttgcgctgcttgtggcgctgttgctgtataaaatgccgctacagcaagcgttggcatcagcggtttacggctttatgtacggcctgtggcccatcgcctggatcatcgtcgcggcggtttttgtctacaggatctcggttaagaccggtcagttcgacattatccgcgcctcaattttatcgatcacgcccgatcagcgcttacagatgctgattgtaggcttctcctttggcgcctttttagaaggtgcggcagggttcggcgcgccggtggcgatcacggccgcgctactggtggggctgggttttaatccgctctatgccgcgggcttgtgtctgatcgtgaataccgcgccagtggcgtttggcgcgatgggaatcccgattattgtggccgggcaggtgaccgggctggacagcttcgctattggccagatggcaggtcgacagcttccgtttctgacaatcatcgtgctgttctggatcatggcgatcatggatggctggcgcggcgtgaaagagacctggcccgccgtgatggtggcggggggatcgttcgcgattgcccagttcctcagttcgaattttcttggcccagagctgcccgatatcatctcctcgctggtctctttaatgtcgctgacgctgtttttacgcgtctggcaaccggtccgcatctttcgcttcagcgaagcagaaagccagcaggaaaagcagccgctgacccgacaaaaatacactaccgggcaggtggtgcgtgcctggatgccgttcctctttttgaccgcgaccgtcacgttatggagcattccaccctttaaagcgctgtttgcaaaaggcggggccttcgcaaactgggttttcagccttcccgtgccggggctggacggagggataacacggatgccgccggtggtcgcgcaacccagcaactggccagccattttcaaactcgacctgctgtcggcaaccggcacggcaatcctggtcgccgccatcgtctccatcgtttttctgaagatgaaacctaaggctgcggcagtgacctttgcagaaaccctgaaagaacttatgcttcccatctactcgatcgggatggtgctggcgtttgcctttatctctaactactccggcctgtctgccaccctggcgctggcattggcgcataccggtcatgcgtttacctttttctcgcctttcctgggatggcttggcgtgtttctgactggctcggatacgtcatccaatgcgctgtttgccgccttacaggcggcgaccgcgcagcagattggcgtttccgatattctgctggtggcggcaaataccaccggtggcgtgaccggcaagatgatctcgccgcagtcgatagccattgcctgtgccgctgttggtctggtgggcaaagagtccgatctgttccgctttaccgtcaagcacagcctgatatttacctgcctggtgggcatcattaccacgcttcaggcttacgttttcccctggatgatcccatgaaaaccagtttatcgccgcacgccgatccgctgcgggttcggctcgaacagtatattcgcgagcatcagattgaacccggcatgcgtttgcctgccgagcgccagctcgccgccgcgcttggcgtctcccgttcatcgctgcgcgaagccattcagcagcttatcagcagcgggatattgacgagccgacgcggcgacggcacctggctgcgtcaacctcaggaaccctggtctgaacagcgcattgtggaaccgattcgtcagctgctggccaacgatccggattaccgctacgacattctggaagcgcgttacgccattgaagccagcaccgcatggcatgccgcactgcgggcgacagagtccgataaagaacgcctaaggtacgcgtttgacgccacgctggcgttaaaagagagcgacgatccccatctggccggtcaggccgacctgcggtttcacctcgctatcgcggaagcctcacataacgtggtgctgttacaaaccatgcgcggtttttttgatttgctccagtcgtcgatgctgcacagccgcaggctgatgtacaccagcccgatcatttttgaccagctgacagatcaacaccgtgccatgcttgacgccattttactcggcgatgccgaggccgcgcgcttagcggcgatggatcatcttggttttgtgcataccacgatgaaaacgcgagatgaagacgaagccagacaggcgcgtattacacgtttacctggccatgacttgcacaatcacaaggagacacgctgatgattatttctgctgccagtgactaccgcgccgccgcgcaacgcattttgccgcctttcctgtttcactatctggatggcggggcttatgcggagcacacgctacgccgcaacgtgaccgatctctcggacgtggcgctgcgccagcgcatcttacgtaatatgtctgaactcagtctggaaaccaccctgtttaatgaaacgctgtcgatgccagtggcgctggcaccggtagggctgtgtggcatgtatgcacgacgaggcgaagtacaggccgcccgcgcggcggcagggaaaggcattccctttacgctgtccaccgtctccgtgtgccccattgaggaagttgcgccgcagattaaccgccccatgtggttccagctctatgttctgcgcgatcgtggctttatgcgtaatgcgctggagcgcgccaaagcggcgggctgctctacgctggtgtttactgtggatatgcctacgccgggcgcgcgttatcgcgatgcgcattcaggcatgagcggggaaaatgcggcgctgcggcgctactggcaggccatcacgcatcccagatgggcgctggatgtggggttacagggaaggccgcacgatctggggaatatctcaacctatctcggcaagcctaccgggctggaagactatatcggctggctggccaataattttgatccttccatttcctggaaggatctggagtggattcgcgatttctgggatggcccgatggtgatcaaaggcattctggaccctgaggatgcccgtgacgcggtgcgctttggtgctgacggtatcgtggtttctaaccatggcggtcgccagctggacggtgtcctgtcctcggcccgtgccttacctgcgattgcggatgcggtcaaaggcgatatcacgatccttgctgatagcggcattcgtaacggactggatgtggtgcgtatgattgcgctgggcgcagacagcgtcctgctggggcgcgcctttatctatgcgctggcaacacatggacagcgcggcgttgagcatttactgacgctgattgaaaaggagatgaaagtcgcgatgaccttaaccggcgcgaagcgcattgccgatatcacacaggattcgctggtgcaggcaaatgccctcttgcaggaagcaaacctgcgcccggcatagttgcctgcggcgaaatcagaggtgttgtctatacttaccttctttaccaacaggaggaatgacatgaccattcataagaaaggttcggcgcattgggaaggcgacatcaaaggcaaaggcacagtcagcaccgaaagtggtgtactgaaccagcagccctacggctttaatacccgttttgaagggcaaaaaggcactaacccggaagagctgattggtgcggcacatgcggcctgtttctctatggcactgtcgctaatgctgggcaatgccggtcataaagcggaaagcattgataccagcgcagatgtgtcgctggataaaaaaggtgaaggttttgcgatcaccaaaatcgccttaaccagcaccgtttctctgccaggtattgataacgatacctttgatgagatcatcaacaaagccaaagcgggctgcccggtttctcaggtgttgaatgctgaaattacgctggattacaccctgaacaactgattgcggaccggcatcacttttacgtgatgctgacgcgaatcttgccttacccagatgcgccttcgggcgcatctttgcgttgtgcagaaggacgcggagatgacaaacgcgtttcggcaaacaaacacggaaaaggcggctggtcttgctggaaatctgtggcgcacgcatggtaatccgtcaggcggcgatgatatgagcatgaggtcgtggctttctcgccataagcctggcgtactgctgatggtggtgttactgcgggcgttactctgtttgctggttaccgcttcctggttaccctggaacgcgtcttaaacgtcaggcgtaaatctcttctgcgcgcctggcccgcacgtcgctgcgtgcaatccgataagccttaccgggatcgcccgccagaaattcaaaggtaggtgaatagtagaacgggagccagccgccataagcgccttcccattcccagcgtaccgggcagggccagataatgccttcatacaaaatgtaataaacccaacgcccagttggacggcggggacgagtagttttcatgggattcacaactatgttggtgtaaaacagcttatattttgaacgctaacctgcaagcttgcaatgttgtatgtgcatttttgtgtccttgacctgttcagttatctgaacgatgcacttcaccacacatcagtaccacgttgggacggaccttgtggatgcggtttgccatcacttcgcaggcggttttcgttgggtaaatgcgctctgataccggcaacgcttcacaggcatcatgtccacaggcgcttaccaacaatacaaaaccaattaacataaccgactccttctcccgtcgcgcacgtcacgagaggggtgaatgttcctttttataaaaccagtatagctaattgccggaagggacaatcatcacgctgggcggtatcggattgctctgagcgattatacgccttccggacgcgtacagcagtgaaatcttacccatcgctgcaatgggcaacgcatcgttcgcgctgcatttctgaccagctacaagggcgacttttcattcctgccataacgaattttaaaatcggtaaattttcatacccgttgactagtttggcggtaatcccttaaggcaacgcgttttgatatttctcacacttctgacatgcaaatctgaaaccggttgcagaaaatctttcccctgtgtattcgttaattattcatcacacggaggaatgaaccatgcccaaaattttactgtgctgtgccgccggaatgtccaccagtatggtggtgcaaaaaatggaaaaagctgcgaaagagcagggaatggatgtagagataaaagcagtaggaattgaagagtttagcgaggcaattgccgactatgactgctgcctgttggggccgcaaattaaatacaagctggccgatttcgagccgattgctcagcagtacagtaaatccgtcgcggtgattaacagcatggattacggaatgatgaatggcgaaaagatattaagtgccgcgctcaagcttattcctggctgatcgctaaagaactgaaaaatatagcgcaaacctgcattcactttatgcagggttattctcttttgcctgagcaaggagtgacgggatgagtcgcttgagcgaatctttattcggtgtcatcgaaaatcgtattagtccgctggctggccgcctctccagccagcgccacgtcatcgccatccgtgatggttttattgcctcaatgccgttcctgattgtcggttcatttatgctgctgtttgcccatccgcctttttcggcagacagtagctgggcgttcgcacagtggtggctcggcatggtgaaggcgtatgaagaacaaatcatgatgccttacaacatgacgatgggcattatggcgctctatattgccagtgctatcgcctacaacctggcgaacagctacaaaatgaacggctttatggccgccagcctgtcgctgatggcgtttctggtcgtggctgcgccgcaaacgggcaaaacgctgccggtaggttcgctgggcggtgaggggatttttaccgccattctggtggcgttatttgctacggagctgatgcattttctgcagaaacacaatatcggcttcaaattacccgaacaggtaccgccgaaaatccgtcagtcgtttgatctgctgatcccgattatcaccatttttattaccctgtttccgctcagcctgtgggtacaggcacagtttggtatgctgctgccgcaggccattatggcgatcttttccccgattatttctgcctcagattctctgcccgccgtattgatcgcggtgctgctgtgtcatctgctgtggttcgccggtattcacggcgccgtgattgtcggtggcattttacaggcattctggttgaccaaccttgggttgaatcagcaggcgctgaacgcaggcgagcctgtcagccatgtgtttatcgaacccttttggcaattttttatcgtgattggtggctccggttccacgatggggctggtgctgctctatttgcggagtcagtctgcccatctgcgctcaattggtaagctcagcattgtgcccagcatgttcaacatcaacgaaccggttatttttggctcgcccgtggtgatgaaccccattctgtttattcccttcgttcttgccccgctagtcaatgccgtcattgcctggaccgccacgaaaaccaatctgatcaatcacgtgatctcgctggcaccctggacgacgccagcaccgattggggcagcctggtcaaccggctgggactggcgcgtcatcgtgttgattgccctgctggtgacgattgccacattgatttactacccgtttttcaaaatgtacgagcgtcaattgctgcagcaggaactggccgcagcgcaaccggtaaaggagtaatgcatggaaattgatgaaagcacggtcatcgaactgattatccaggcgggcgaagcgcgatcctgctcaatggaagccttgcgcgcggcccgcctgcaaaactgggagcaggcagacagcctgctcagcgccgcgactgcggcggcaaaggcggcgcaccagacgcagacgcagcttatcggtgccgatgagggcagcggaaagatcccggtcaacctgattatggttcatgcccaggatcatctgatgaacgcgatgctctgccgcgagctggcggaagaaattattcaactgcgccgggagttagccgcacgctaaaaaggaggtgttatgcaacattcgacagtgaccgcgtttccagaaggctttctctggggcgcgtcgacctcggcttatcaggttgagggcggatggaatagcgatggcaaagggccatctgttatcgacaaagcaacgttccatcaggacatcacggactttaccgtttgcagcgaccactatcaccgcttcaaagaagacatcgccttgctggcggagatgggcctgaaaacctaccgcttttccatcgcctggagccgcctttatcccgacggcgatggcccggtaaatgaggcgggcgtggccttttatcagcagttgattgatgagatctgcagacagggcatcacgccactggtgacgctttatcacttcgatctgccctgggcgctgcagcaggccggtggctggtcttctcgccgtacggtggcggcttttgagcgttttgccatcacctgttttgagcgctatggcagccaggtcaactactggctgaccatcaatgaacagaacatgatgatcctgaaaggggacgtgattggcaccttgccgccgggtaccgccgatccgcagaaaaccctgtaccagcaaaaccatcacatgatgctggcgcaggccaaggcgatgattgcctgtcatgaacggctgccggaggcgaaaattggcccggcacccaatatctcttgcgtatatgccgcgagttcccggccagaggatgtgctggcggctgataatttctcggcaatccgtaactggctctacctcgatttggccgttcacgggcgctacaaccacgtggtatgggcttttctgaagcagcgagattggctacccaccattgaggcggaggatatggccatcatcgccgccggtaagcctgattttatcgcttttaactattatgcttccgccacggtaggcgcagaaggagagcataatacgcccgacagcaggccacatgccgatcaacaaatggccggaattgaccggtctgtgtatgtcggttgcgataatccgcatctgaaacaaaaccagtttggctggtatatcgatcctgtcggcttccgcattaccgcacgacagatttatgcgcgttatgccttaccgctcatcgtgaccgaaaatggtttaggggcttttgacaccctggatgcagagaataaagtgcatgatgattatcgtatcgactatttgcgcgagcatatcgctcagttgcagctggcgattgccgatggcgttgagctgttcggttattgcccgtggtcggcaattgatctggtgagtacccatcagggcatcagcaagcgttacggttttatttatgtgaaccgcgatgagaaagatctcaaggatctggcgcgctaccgcaaaaaaagctttttctggtaccaaaagctgattcgcagtaatggagccacgctgaacgcgtcagtggactactgaggtggcgcggcagggaggccgcgtcttactgcttataagggccgtccgtcaccgatgcgcgcgcgatcaggtgaccgctaaatggcggcagggccgtgaccgcttcgccttccagcatggcaaccagctgcgccagcgtgtgctgaatcatctccgcgaccggcacatgcaccgtggtgagcggcggcaggaaaaattcagccatgcgaatatcatcaaagcccagcagtgagacatcttctggcagccgttttcccgccgcattgagagccagcgcggcaccaatcgccatatcatcgttactggccatcagcgcgctaaaggtcactcccgaatccagcagctgttttgccgccgccatcccactggctggcgtccaggcgccctgcacgatgcaggctttatctgcgatgccatgctcgaccagcgcctgctgatagcccgccagacgcgcgtcagcggtcggtgaaccggccaggccacgaataaaggcaatctcgcggtggccgcgttcaatcagataacgcgtggcgtcaaacgtattctgctgatgcgtggcccaaacgcagtgggcaggatggcgcttaagctggcggttcaccaccatgatgggaatatcatgctgttcaataatggcgtccagcgcctcggtatccagaaagcggggatagatgatgatggcgtcacagcgcaggtcgagcaaaaactcaatcgcggcccgctcatcatcagcgcaggttttgccatcagccagaattaactgccgaccatagttattggtcagcgtggccgcctgaaacagcagttcgctgaagtaggggccattaaagagtgaatgggtaacaatgaggccaatattttgggatttttgggtcgccaggcttcgcgccagcagatttgggcgataaccggtttcggcgatggcctgaaagaccttctgttgcgtactcttactgacgtaacgatttccggccagcacgcgtgagacggtggctttagagactccggccttacgggccacatccagcatggtaatcattggcttgcagaccatccatccctgtgggtaaaaaacgatactagctgatttttcgcaggttattgcaggacaggtaataaaaaagtgaagcctgtcaggcgaaataccaggcgggcaggatggcaatcaggttgttcaacgtatgcaggaagaccggcagggccagcgtattgctgcgcaggcgcgcgtagcagagcagcaaagagaaaagcgtcagcgccaccaccgtttcccagtggacatactgagtatgcatcaacgcaaacagcagggaagtgagtagcatgcaggcaaagcggctgttgggggcccacagcaggaagccttgcaacaaaaagccgcgaaacatcacttcttcaaatacgggggccagcaacacggcggtcagtaacaggataagcattgagctgcgtccctgttgtgattgcgccaccagccagccttcaggctgtaaatactgcgtttgtgccgccattaaaataaacagggcgccaataaacagtaacgtctggccggagcgtaaaaaccccaggggaatatccgtgcgacgctggcagtaaaaacgatacagcggatagataactgcaaactcaaacaggcagagcacgggcaccagcaaaccgtcattacgcaggataccgtaattagggaacaaggtaatcagcatggtaacaaggtaatagacaacaaagctgccgacataaaacagtgtcagcgtcactctgtcggaattggtgttcataggcgacccagccagcaacgataagcgcatagtagcaacgcgtcggatcgctgtcgagagaacggacgacacaatattattcgtttatgatcgtttcaggtttgtgcgaattttaagtgaataatatcagtttgttaactaattgccctgcggtgttgcaaccgggcgtcaggcgcttgttcgcctggcccgagaataaggcccacagtcaatcgggcgtgatgacagattaccggacgcggatgccgtcagggtaattgacgcggcaacgccgataaaaaagagcggctttgttattcccgcaggaataatctgccgactgtctcagcggcttattatcgtgatttcagccagcagctgtgattcatctacaaatagcgttattagccagcatttaatgcttaatattgtgcggtaagtttgattttaacggttcatacctgcagtcaggcttgttactcttcgatgtcaggttttacacgtcgatgaggagaaaacacgtgaatcactatggaaaagcgctgatggccaccggtttcttactgcttacggcctgccagtcggccacgcaacccgaccaggctgccaggctgcccgacgcgcaagcggacagctgtggtgcgtcccagtatcaacatttcgtcggtaagccgctgtccgccatcgataatcagcgtttcactcagaaggtgcgcgccatcccgtggaattctgcggtaacaatggactttaatttcactcgcctgaactttatggcagacaaaaacggtaatattagccgcgtctattgtgggtaagtgtcaaataaacaacgcattgtcatagagttgtcatggcgtcaggcgaagatagcgcctgtatcctgtcgggccgcgctaaccgcgatcggtagcgttaaaccaccagggtaaggatttcctcgtcacttcaatatgcaatgctcgtcttgtttattcccgctcaggcgggaatttttttctggttcaggccgaaagaaggagcaatgcatggtacctctccagcggatttcactgtcagttttacttctggtcagcccgcttgcgctggcgtccagtcctgacgcatggcaacaaagccagcaggtgatgcgccaggcgtgcatcaatgccagcaccttaagcaaggtaaaggtgttggggcaggcggttgagtatgacgacagcgtaggctatagcgcgttactgctcgaagggcattatccacagcaacagatgaaaaaccggcgtggacgagagctttgcctgtttcagcgcagcagcggtcgggccagcgtaagcgaagccaatcagctccgatgggttaagtaaccggaatgcggctcactcacgtggccgcgtttccatcagccggtccagcagggcgcgatagcgttgcagtcgctgctcatccccttcaaattccagcttattgatgacgcgcgcgataacggccttattggtggttggctgaccggcttccatcagttcccgcattatcacggccagcagatcggactcgggcggaacattccagtccgggctgttgaagtaatcggtgatagcacggctggcgctgttaggttgcactctcattctccctctccgcgaacagacagcccgcccgatgcagagatgcgcagcaggcagagtcaactgagttagtggctcccaaaaagaacggtggcagttttatcgggagcattacgcgggtcagaacagcccacgtaccgcacgaaactggcggttttttaaacataggtcggtcatcaggacttgtcagtaacaacctgcaatatttttcaaatgtgatgaatggtttttgaataatgacgatatgttatgagagcgtttagggttttattcctttgaataataagtttttttaagcacatcaccggtcgtcaaacgcgcgcgttgagacgcgctataggccaggtaagagccgtggcggcaaatgtgtttttcgcgatcgcctgtgcattgacggcgtgagcagagtgggggcaagtgagcatgaaaagctgagggaggactggcctcgcgggaacgtattatctgtttcctgaaaaccgttccgattatattttcgcgtaaaagcaccctgttatttgaagcggaaatattgcatctttcatatcggtgtcatcaaaataaaatagtcatgccttgggtttcgagtagataagcggtttcgcgattcaataaatgaaataacataacatcgcagccggctgattattttaaccgcctgataaacccaatgaaaaattccttttttttattccgacgggtgatatttttttctgcacctggctgaaggggcatcggcatgaaaaatctcatcgctgagttactgattactctggcagaaaaagaagaagcgtctaaagagcaggtggcgcagattgaagcgctggagatcgtcatcaccgccatgttgcgcatgatgccgcctgaacagcatcagtccattgt
